US011396679B2

(12) United States Patent
Bitenc et al.

(10) Patent No.: US 11,396,679 B2
(45) Date of Patent: Jul. 26, 2022

(54) DETECTION OF COLORECTAL CANCER

(71) Applicant: Universal Diagnostics, S.L., Seville (ES)

(72) Inventors: Marko Bitenc, Ljubljana (SI); Kristi Kruusmaa, Ljubljana (SI); Juan Martinez-Barea, Seville (ES); Christian Hense, Seville (ES); Marko Chersicola, Ljubljana (SI); Primož Knap, Ljubljana (SI)

(73) Assignee: Universal Diagnostics, S.L., Seville (ES)

( * ) Notice: Subject to any disclaimer, the term of this patent is extended or adjusted under 35 U.S.C. 154(b) by 171 days.

(21) Appl. No.: 16/428,865

(22) Filed: May 31, 2019

(65) Prior Publication Data
US 2020/0377954 A1 Dec. 3, 2020

(51) Int. Cl.
C12Q 1/68 (2018.01)
C12Q 1/6886 (2018.01)
C12Q 1/686 (2018.01)

(52) U.S. Cl.
CPC ........... *C12Q 1/6886* (2013.01); *C12Q 1/686* (2013.01); *C12Q 2600/112* (2013.01); *C12Q 2600/154* (2013.01)

(58) Field of Classification Search
CPC .................. C12Q 1/6886; C12Q 1/686; C12Q 2600/112; C12Q 2600/154
See application file for complete search history.

(56) References Cited

U.S. PATENT DOCUMENTS

| | | |
|---|---|---|
| 6,265,171 B1 | 7/2001 | Herman et al. |
| 6,605,432 B1 | 8/2003 | Huang |
| 6,812,339 B1 | 11/2004 | Venter et al. |
| 7,144,701 B2 | 12/2006 | Huang |
| 7,745,391 B2 | 6/2010 | Mintz et al. |
| 7,807,358 B1 | 10/2010 | Huang |
| 8,048,634 B2 | 11/2011 | Lai |
| 9,745,622 B2 | 8/2017 | An et al. |
| 9,850,523 B1 | 12/2017 | Chudova et al. |
| 10,006,925 B2 | 6/2018 | Bitenc et al. |
| 10,428,388 B2 | 10/2019 | An et al. |
| 11,001,898 B2 | 5/2021 | Bitene et al. |
| 2007/0237813 A1 | 10/2007 | Misawa et al. |
| 2010/0167940 A1* | 7/2010 | Feinberg ............... C12Q 1/6886 435/6.12 |
| 2010/0240549 A1 | 9/2010 | Brown |
| 2010/0298158 A1 | 11/2010 | DePinho et al. |
| 2011/0318738 A1 | 12/2011 | Jones et al. |
| 2013/0012410 A1 | 1/2013 | Zou et al. |
| 2013/0085681 A1 | 4/2013 | Deciu et al. |
| 2013/0189684 A1 | 7/2013 | Ehrich et al. |
| 2013/0288247 A1 | 10/2013 | Mori et al. |
| 2014/0128283 A1* | 5/2014 | Feinberg ............... C12Q 1/6886 506/9 |
| 2015/0011403 A1 | 1/2015 | Lo et al. |
| 2015/0072866 A1 | 3/2015 | Weisburg et al. |
| 2015/0152505 A1 | 6/2015 | Lapointe et al. |
| 2016/0333416 A1* | 11/2016 | Babiarz ............... C12Q 1/6811 |
| 2016/0355885 A1 | 12/2016 | Weinhausel et al. |
| 2017/0016048 A1 | 1/2017 | Blauwkamp et al. |
| 2017/0101674 A1 | 4/2017 | So et al. |
| 2017/0335401 A1 | 11/2017 | Allawi et al. |
| 2017/0356051 A1 | 12/2017 | Ishioka et al. |
| 2017/0369948 A1 | 12/2017 | Markowitz et al. |
| 2018/0051338 A1 | 2/2018 | West et al. |
| 2018/0119137 A1 | 5/2018 | Matsuguchi et al. |
| 2018/0148777 A1 | 5/2018 | Kirkizlar et al. |
| 2018/0245157 A1 | 8/2018 | Allawi et al. |
| 2018/0251859 A1 | 9/2018 | Ahlquist et al. |
| 2018/0258498 A1 | 9/2018 | Ahlquist et al. |
| 2018/0305765 A1 | 10/2018 | Feber et al. |
| 2018/0363063 A1 | 12/2018 | Guerrero-Preston et al. |
| 2019/0025308 A1 | 1/2019 | Cummings et al. |

(Continued)

FOREIGN PATENT DOCUMENTS

| | | |
|---|---|---|
| EP | 2481813 A1 | 8/2012 |
| EP | 2497834 A2 | 9/2012 |

(Continued)

OTHER PUBLICATIONS

Chen, J. et. al., DNA methylation biomarkers in stool for early screening of colorectal cancer, Journal of Cancer, 10(21):5264-5271, (2019).
Chen, J.J., et. al., DNA methylation assay for colorectal carcinoma, Cancer Biology & Medicine, 14(1):42-49, (2017).
DOE Joint Genome Institute, AC012313, (2003).
DOE Joint Genome Institute, AC024563, (2002).
International Search Report for PCT/EP2020/064813 filed May 28, 2020, 8 pages, (dated Dec. 22, 2020).
Kok-Sin, T., et. al., Identification of diagnostic markers in colorectal cancer via integrative epigenomics and genomics data, Oncology Reports, 34:22-32, (2015).
Kutsenko, A., et al., NotI flanking sequences: a tool for gene discovery and verification of the human genome, Nucleic Acids Research, 30(14):3163-3170, (2002).

(Continued)

*Primary Examiner* — Stephanie K Mummert
(74) *Attorney, Agent, or Firm* — Choate, Hall & Stewart LLP; William R. Haulbrook; Samuel R. Polio

(57) ABSTRACT

The present disclosure provides, among other things, methods for colorectal cancer screening and compositions related thereto. In various embodiments, the present disclosure provides methods for colorectal cancer screening that include analysis of methylation status of one or more methylation biomarkers, and compositions related thereto. In various embodiments, the present disclosure provides methods for colorectal cancer screening that include screening methylation status of one or more methylation biomarkers in cfDNA, e.g., in ctDNA. In various embodiments, the present disclosure provides methods for colorectal cancer screening that include screening methylation status of one or more methylation biomarkers in cfDNA, e.g., in ctDNA, using MSRE-qPCR.

11 Claims, 20 Drawing Sheets

Specification includes a Sequence Listing.

(56) References Cited

U.S. PATENT DOCUMENTS

| | | |
|---|---|---|
| 2019/0032149 A1 | 1/2019 | Van Engeland et al. |
| 2019/0085406 A1 | 3/2019 | Mortimer et al. |
| 2019/0112645 A1 | 4/2019 | Woodhouse et al. |
| 2019/0161805 A1 | 5/2019 | Ahlquist et al. |
| 2019/0256921 A1 | 8/2019 | Mueller et al. |
| 2019/0256924 A1 | 8/2019 | Vogelstein et al. |
| 2020/0017916 A1 | 1/2020 | Ren |
| 2020/0377959 A1 | 12/2020 | Bitenc et al. |
| 2021/0139948 A1 | 5/2021 | Bitenc et al. |
| 2021/0230707 A1 | 7/2021 | Bitenc et al. |
| 2021/0277487 A1 | 9/2021 | Bitenc et al. |
| 2021/0332440 A1 | 10/2021 | Kruusmaa et al. |
| 2021/0355542 A1 | 11/2021 | Bitenc et al. |
| 2021/0404010 A1 | 12/2021 | Bitenc et al. |
| 2021/0404011 A1 | 12/2021 | Bitenc et al. |

FOREIGN PATENT DOCUMENTS

| | | | |
|---|---|---|---|
| EP | 2886659 A1 | 6/2015 | |
| EP | 2899275 A1 | 7/2015 | |
| EP | 2977467 A2 | 1/2016 | |
| WO | WO-02/081749 A2 | 10/2002 | |
| WO | WO-2005/001142 A2 | 1/2005 | |
| WO | WO-2007/149269 A2 | 12/2007 | |
| WO | WO-2010/118559 A1 | 10/2010 | |
| WO | WO-2012/034170 A1 | 3/2012 | |
| WO | WO-2012/047899 A2 | 4/2012 | |
| WO | WO-2012/104642 A1 | 8/2012 | |
| WO | WO-2012104642 A1 * | 8/2012 | ........... C12Q 1/6886 |
| WO | WO-201 2/154979 A2 | 11/2012 | |
| WO | WO-2012/167145 A2 | 12/2012 | |
| WO | WO-2012/170715 A1 | 12/2012 | |
| WO | WO-2013/057581 A2 | 4/2013 | |
| WO | WO-2013/097868 A1 | 7/2013 | |
| WO | WO-2014/032227 A1 | 3/2014 | |
| WO | WO-2014/062218 A1 | 4/2014 | |
| WO | WO-2015/116837 A1 | 8/2015 | |
| WO | WO-2015/153283 A1 | 10/2015 | |
| WO | WO-2015/153284 A1 | 10/2015 | |
| WO | WO-2015/159292 A2 | 10/2015 | |
| WO | WO-2016/060278 A1 | 4/2016 | |
| WO | WO-2016/109782 A2 | 7/2016 | |
| WO | WO-2017/012592 A1 | 1/2017 | |
| WO | WO-2017/043497 A1 | 3/2017 | |
| WO | WO-2017/048932 A1 | 3/2017 | |
| WO | WO-2017/192221 A1 | 11/2017 | |
| WO | WO-2017/201606 A1 | 11/2017 | |
| WO | WO-2017/212428 A1 | 12/2017 | |
| WO | WO-2018/087129 A1 | 5/2018 | |
| WO | WO-2018/140781 A1 | 8/2018 | |
| WO | WO-2018/195211 A1 | 10/2018 | |
| WO | WO-2018/209361 A2 | 11/2018 | |
| WO | WO-2019/068082 A1 | 4/2019 | |
| WO | WO-2020/069350 A1 | 4/2020 | |
| WO | WO-2020/232109 A1 | 11/2020 | |
| WO | WO-2020/239895 A2 | 12/2020 | |
| WO | WO-2020/239896 A1 | 12/2020 | |
| WO | WO-2021/016441 A1 | 1/2021 | |
| WO | WO-2021/094017 A1 | 5/2021 | |

OTHER PUBLICATIONS

Lowe, T., et. al., A Computer program for selection of oligonucleotide primers for polymerase chain reactions, Nucleic Acids Research. 18(7):1757-1761, (1990).

Mitchell, S.M. et. al., A panel of genes methylated with high frequency in colorectal cancer, BMC cancer biomed central, 14(1): 54, (2014).

Written Opinion for PCT/EP2020/064813 filed May 28, 2020, 13 pages, (dated Dec. 22, 2020).

Yang, Y., et. al., Identification of regulatory role of DNA methylation in colon cancer gene expression via systematic bioinformatics analysis, Medicine, 96(47):1-7, (2017).

Meyer, D. et al., Package 'e1071', Misc Functions of the Department of Statistics, Probability Theory Group (Formerly: E1071), TU Wien, https://cran.r-project.org/web/packages/e1071/index.html, 63 pages, (2019).

Fan, C.H.. et al., Noninvasive diagnosis of fetal aneuploidy by shotgun sequencing DNA from maternal blood, Proceedings of The National Academy of Sciences, 105(42):16266-16271 (2008).

Hemmasi, G., et al., Prevalence of colorectal adenoma in an average-risk population aged 40-50 versus 50-60 years, European Journal of Cancer Prevention (ECP), pp. 1-5, (2014).

Karsenti, D. et al., Adenoma and advanced neoplasia detection rates increase from 45 years of age, World Journal of Gastroenterology, 25(4): 447-456 (2019).

O'Connell B., and Crockett S., The clinical impact of serrated colorectal polyps, Dove Press Journal, Clinical Epidemiology, 9: 113-125 (2017).

Snyder, M.W. et al., Cell-free DNA Comprises an In vivo Nucleosome footprint that informs its Tissues-Of-Origin, Cell, 164: pp. 57-68, (2016).

Galanopoulos, M., et al., Abnormal DNA methylation as a cell-free circulating DNA biomarker for colorectal cancer detection: A review of literature, World Journal of Gastrointestinal Oncology, 9(4):142-152, (2017).

International Search Report for PCT/EP2020/064815 filed May 28, 2020, 6 pages, (dated Apr. 9, 2020).

Kordowski., F., et al., Aberrant DNA methylation of ADAMTS16 in colorectal and other epithlial cancers, BMC Cancer, 18(1):4, (2018).

Kruusmaa, K. et. al., MSRE-qPCR for analysis of gene specific methylation can be accurately used for detection and validation of colorectal cancer-specific patterns, 4Bio Summit (Jan. 1, 2018). <www.universaldx.com/wp-content/uploads/2017/05/4Bio-poster-November-2018.pdf>. Retrieved on Aug. 19, 2020.

Melnikov, A. A., et al., MSRE-PCR for analysis of gene-specific DNA methylation, Nucleic Acids Research, 33(10): e93-e93, (2015).

Written Opinion for PCT/EP2020/064815 filed May 28, 2020, 6 pages, (dated Apr. 9, 2020).

Yan, H., et. al., Identifying CpG sites with different differential methylation frequencies in colorectal cancer tissues based on individualized differential methylation analysis, Open Access Impact Journal, 29(8): 47356-47364, (2017).

Aberle, D.R., et al., Reduced lung-cancer mortality with low-dose computed tomographic screening, National Lung Screening Trial Research Team, 365(5):395-409, (2011).

Andersson, I., et al., Mammographic screening and mortality from breast cancer: the Malmö mammographic screening trial, 297(6654): 943-8, (1988).

Breast Cancer Screening (PDQ®)—Health Professional Version, <https://www.cancer.gov/types/breast/hp/breast-screening-pdq#section/all>. Retrieved on Jul. 17, 2020.

Demissie, K., et al., Empirical comparison of the results of randomized controlled trials and case-control studies in evaluating the effectiveness of screening mammography, 51(2):81-91, (1998).

Krueger, F. and Andrews, S.R., Bismark: a flexible aligner and methylation caller for Bisulfite-Seq applications, Bioinformatics, 27(11):1571-2, (2011).

QIAamp® Circulating Nucleic Acid Handbook, For concentration and purification of free-circulating DNA, RNA, miRNA, and viral nucleic acids from human plasma, serum, urine, or other cell-free body fluids, Oct. 2019.

QIAamp® MinElute® ccfDNA Handbook, For concentration and purification of circulation cell-free DNA from plasma or serum, Jan. 2020.

Rahib, L., et al., Projecting cancer incidence and deaths to 2030: the unexpected burden of thyroid, liver, and pancreas cancers in the United States, 74(11):2913-21, (2014).

The Cancer Genome Atlas Program, <https://www.cancer.gov/about-nci/organization/ccg/research/structural-genomics/tcga>.

Vainio, H., et al., IARC Handbooks of Cancer Prevention Programme Head: Harri Vainio. vol. 7: Breast Cancer Screening, pp. 1-236, (2002).

Adler, A. et al., Improving compliance to colorectal cancer screening using blood and stool based tests in patients refusing screening colonoscopy in Germany, BMC Gastroenterology, 14:183, (2014).

(56) References Cited

OTHER PUBLICATIONS

Beikircher, G. et al., Multiplexed and Sensitive DNA Methylation Testing Using Methylation-Sensitive Restriction Enzymes "MSRE-qPCR", DNA Methylation Protocols, Methods in Molecular Biology 1708:Ch21:407-424, (2018).
Bray, F. et al., Global Cancer Statistics 2018: GLOBOCAN Estimates of Incidence and Mortality Worldwide for 36 Cancers in 185 Countries, CA Cancer J Clin., 68:394-424, (2018).
Calderwood, A. H. et al., Colon adenoma features and their impact on risk of future advanced adenomas and colorectal cancer, World Journal of Gastrointestinal Oncology, 8(12):826-834, (2016).
Chang, C. P.-Y. et al., Elevated cell-free serum DNA detected in patients with myocardial infarction, Clinica Chimica Acta 327:95-101, (2003).
Capman, M. et al., MethyLight and Digital MethyLight, DNA Methylation Protocols, Methods in Molecular Biology, 1708:CH25:497-513, (2018).
Chen, Y. et al., Tissue-independent and tissue-specific patterns of DNA methylation alteration in cancer, Epigenetics & Chromatin, 9:10, (2016).
Chiu, R. W. K. et al., Noninvasive prenatal diagnosis of fetal chromosomal aneuploidy by massively parallel genomic sequencing of DNA in maternal plasma, PNAS, 105(51):20458-20463, (2008).
Esteller, M., CpG island hypermethylation and tumor suppressor genes: a booming present, a brighter future, Oncogene, 21:5427-5440, (2002).
Fackler, M. J. and Sukumar, S., Quantitation of DNA Methylation by Quantitative Multiplex Methylation-Specific PCR (QM-MSP) Assay, DNA Methylation Protocols, Methods in Molecular Biology, 1708:CH24:473-496, (2018).
Frommer, M. et al., A genomic sequencing protocol that yields a positive display of 5-methylcytosine residues in individual DNA strands, Proc. Natl. Acad. Sci. USA, 89:1827-1831, (1992).
Galeazzi, M. et al., Dosage and characterization of circulating DNA: present usage and possible applications in systemic autoimmune disorders, Autoimmunity Reviews, 2:50-55, (2003).
Gasc, C. et al., Survey and Summary: Sequence capture by hybridization to explore modern and ancient genomic diversity in model and nonmodel organisms, Nucleic Acids Research, 44(10):4504-4518, (2016).
Gonzalgo, M. L. and Liang, G., Methylation-sensitive single-nucleotide primer extension (Ms-SNuPE) for quantitative measurement of DNA methylation, Nature Protocols, 2(8):1931-1936, (2007).
Herman, J. G. et al., Methylation-specific PCR: A novel PCR assay for methylation status of CpG islands, Proc. Natl. Acad. Sci. USA, 93:9821-9826, (1996).
Hussmann, D. and Hansen, L. L., Methylation-Sensitive High Resolution Melting (MS-HRM), DNA Methylation Protocols, Methods in Molecular Biology, 1708:CH28:551-571, (2018).
Imperiale, T. F. et al., Multitarget Stool DNA Testing for Colorectal-Cancer Screening, Correspondence to the Editor, The New England Journal of Medicine, doi:10.1056/NEJMc1405215, 371(2):184-188, (2014).
Imperiale, T. F. et al., Multitarget Stool DNA Testing for Colorectal-Cancer Screening, The New England Journal of Medicine, 370(14):1287-1297, (2014).
Ivanov, M. et al., In-solution hybrid capture of bisulfite-converted DNA for targeted bisulfite sequencing of 174 ADME genes, Nucleic Acids Research, 46(6):e72, 9 pages, (2013).
Laird, P. W., Applications of Next-Generation Sequencing: Principles and challenges of genomewide DNA methylation analysis, Nature Review, Genetics, 11:191-203, (2010).
Leon, S. A. et al., Free DNA in the Serum of Cancer Patients and the Effect of Therapy, Cancer Research, 37:646-650, (1977).
Liles, E. G. et al., Uptake of a colorectal cancer screening blood test is higher than of a fecal test offered in clinic: A randomized trial, Cancer Treatment and Research Communications, 10:27-31, (2017).
Liu, Y. et al., Methylation-sensitive enrichment of minor DNA alleles using a double-strand DNA-specific nuclease, Nucleic Acids Research, 45(6):e39, 11 pages, (2017).
Masser, D. R. et al., Targeted DNA Methylation Analysis by Next-generation Sequencing, Journal of Visualized Experiments, www.jove.com, ©Creative Commons Attribution-NonCommercial License, 96:e52488, 11 pages, (2015).
Nakamura, A. et al., Relationship between sodium excretion and pioglitazone-induced edema, Journal of Diabetes Investigation, 1(5):208-211, (2010).
Navarro, M. et al., Colorectal cancer population screening programs worldwide in 2016: An Update, World J Gastroenterol, 23(20):3632-3642, (2017).
Oh, T. et al., Genome-Wide Identification and Validation of a Novel Methylation Biomarker, SDC2, for Blood-Based Detection of Colorectal Cancer, The Journal of Molecular Diagnostics, 15(4):498-507, (2013).
Potter, N. T. et al., Validation of a Real-Time PCR-Based Qualitative Assay for the Detection of Methylated SEPT9 DNA in Human Plasma, Clinical Chemistry, 60(9):1183-1191, (2014).
Schwarzenbach, H. et al., Cell-free nucleic acids as biomarkers in cancer patients, Nature Reviews / Cancer, 11:426-437, (2011).
Shaukat, A. et al., Long-Term Mortality after Screening for Colorectal Cancer, The New England Journal of Medicine, 369(12):1106-1114, (2013).
Singh, K. E. et al., Colorectal Cancer Incidence Among Young Adults in California, Journal of Adolescent and Young Adult Oncology, 3(4):176-184, (2014).
Swarup, V. and Rajeswari, M.R., Circulating (cell-free) nucleic acids—A promising, non-invasive tool for early detection of several human diseases, FEBS Letters 581:795-799, (2007).
Van Der Vlugt, M. et al., Adherence to colorectal cancer screening: four rounds of faecal immunochemical test-based screening, British Journal of Cancer, 116(1):44-49, (2017).
Wittenberger, T. et al., DNA methylation markers for early detection of women's cancer: promise and challenges, Epigenomics, 6(3):311-327, (2014).
Lam, K. et al., DNA methylation based biomarkers in colorectal cancer: A systematic review, Elsevier Science BV, Biochimica et Biophysica Acta 1866:106-1202 (2016).
Li, H. et al., Identification of novel DNA methylation markers in colorectal cancer using MIRA-based microarrays, Oncology Reports, National Hellenic Research Foundation, 28(1):99-104, (2012).
Adalsteinsson, V.A. et al., Scalable whole-exome sequencing of cell-free DNA reveals high concordance with metastatic tumors, Nat. Commun., 8(1):1324, (2017).
Adusumalli, S. et al., Methodological aspects of whole-genome bisulfite sequencing analysis, Briefings in Bioinformatics, 16(3):369-379, (2014).
Bacolod, M. D. et al., Application of Multiplex Bisulfite PCR-Ligase Detection Reaction-Real-Time Quantitative PCR Assay in Interrogating Bioinformatically Identified, Blood-Based Methylation Markers for Colorectal Cancer, The Journal of Molecular Diagnostics, 22(7):886-900, (2020).
Heidary, M. et al., The dynamic range of circulating tumor DNA in metastatic breast cancer, Breast Cancer Res., 16(4):421, (2014).
Kirkizlar, E. et al., Detection of Clonal and Subclonal Copy-Number Variants in Cell-Free DNA from Patients with Breast Cancer Using a Massively Multiplexed PCR Methodology, Transl. Oncol., 8(5):407-416, (2015).
Kukita, Y. et al., High-fidelity target sequencing of individual molecules identified using barcode sequences: de novo detection and absolute quantitation of mutations in plasma cell-free DNA from cancer patients, DNA Res., 22(4):269-277, (2015).
Leary, R.J. et al., Detection of chromosomal alterations in the circulation of cancer patients with whole-genome sequencing, Sci. Transl. Med., 4(162):162ra154, (2012).
Lianidou, E., Detection and relevance of epigenetic markers on ctDNA: recent advances and future outlook, Mol. Oncol., 15(6):1683-1700, (2021).
Michels, K.B., The promises and challenges of epigenetic epidemiology, Exp. Gerontol., 45(4):297-301, (2010).

(56) References Cited

OTHER PUBLICATIONS

Perakis, S. et al., Advances in Circulating Tumor DNA Analysis, Adv. Clin. Chem., 80:73-153, (2017).

Zhang, S. et al., CRISPR/Cas9-mediated knockout of NSD1 suppresses the hepatocellular carcinoma development via the NSD1/H3/Wnt10b signaling pathway, Journal of Experimental and Clinical Cancer Research, 38(1):467, (2019).

Blesa, J. R. et al., NRF-1 is the major transcription factor regulating the expression of the human TOMM34 gene, Biochemistry and Cell Biology, Biochem Cell Biol., 86(1):46-56, (2008).

Liu, W-B et al., TMEM196 acts as a novel functional tumour suppressor inactivated by DNA methylation and is a potential prognostic biomarker in lung cancer, Oncotarget, 6(25):21225-21239, (2015).

Margolin, G. et al., Robust Detection of DNA Hypermethylation of ZNF154 as a Pan-Cancer Locus with in Silico Modeling for Blood-Based Diagnostic Development, The Journal of Molecular Diagnostics, 18(2):283-298, (2016).

Mitchell, S. M. et al., A panel of genes methylated with high frequency in colorectal cancer, BMC Cancer, Biomed Central, London, GB, 14(1):54, 15 pages, (2014).

Zhou, X. et al., Identification of epigenetic modulators in human breast cancer by integrated analysis of DNA methylation and RNA-Seq data, Epigenetics, 13(5):473-489, (2018).

\* cited by examiner

|  | CRC | Training (n = 70) Healthy + Non-Advanced Adenoma | Healthy | Non-advanced Adenoma |
|---|---|---|---|---|
| Female (%) | 15 (21.4) | 20 (28.6) | 15 (21.4) | 5 (7.1) |
| Male (%) | 15 (21.4) | 20 (28.6) | 15 (21.4) | 5 (7.1) |
| Age (Range) | 64 (41-80) | 60 (46-84) | 60 (46-77) | 60 (48-84) |
| BMI (sd) | 25.0 (±4.4) | 26.7 (±4.3) | 26.7 (±4.7) | 27.2 (±3.0) |
|  | CRC All | Proximal | Distal |  |
| Localized | 17 | 6 | 11 |  |
| Advanced | 13 | 9 | 4 |  |

Fig. 2

|  | CRC | Validation (n = 63) | | Non-advanced Adenoma |
|---|---|---|---|---|
|  | CRC | Healthy + Non-Advanced Adenoma | Healthy | Non-advanced Adenoma |
| Female (%) | 11 (17.5) | 25 (39.7) | 20 (31.7) | 5 (7.9) |
| Male (%) | 9 (14.3) | 18 (28.6) | 11 (17.5) | 7 (11.1) |
| Age (Range) | 61 (45-84) | 57 (47-80) | 55 (47-80) | 63 (55-70) |
| BMI (sd) | 25.4 (± 3.8) | 26.3 (± 4.0) | 26.3 (± 4.0) | 26.7 (± 4.0) |
|  | CRC All | Proximal | Distal |  |
| Localized | 13 | 5 | 8 |  |
| Advanced | 7 | 4 | 3 |  |

Fig. 3

| | CRC | Control + NAA | Control | NAA |
|---|---|---|---|---|
| Validation= 82 Samples | | | | |
| Female | 20 | 14 | 11 | 3 |
| Male | 23 | 25 | 19 | 6 |
| Age (Range) | 63 (36-84) | 65 (45-83) | 64 (45-79) | 66 (55-83) |
| BMI (sd) | 27.2 (± 5) | 26.04 (± 3.3) | 26 (± 3.4) | 27.5 (± 2.5) |
| | CRC All | Proximal | Distal | |
| Localized | 24 | 12 | 12 | |
| Advanced | 19 | 9 | 10 | |

Fig. 10

DETECTION OF COLORECTAL CANCER

SEQUENCE LISTING

The instant application contains a Sequence Listing which has been filed electronically in ASCII format and is hereby incorporated by reference in its entirety. Said ASCII copy, created on Jun. 11, 2019, is named 2011722_0041_SL.txt and is 2,771,304 bytes in size.

BACKGROUND

Cancer screening is a critical component of cancer prevention, diagnosis, and treatment. Colorectal cancer (CRC) has been identified, according to some reports, as the third most common type of cancer and the second most frequent cause of cancer mortality in the world. According to some reports, there are over 1.8 million new cases of colorectal cancer per year and about 881,000 deaths from colorectal cancer, accounting for about 1 in 10 cancer deaths. Regular colorectal cancer screening is recommended, particular for individuals over age 50. Moreover, incidence of colorectal cancer in individuals below 50 has increased over time. Statistics suggest that current colorectal cancer screening techniques are insufficient.

SUMMARY

Despite improvements over time, only about 40-44% of colorectal cancers are currently detected by screening in an early, localized stage. This is at least in part due to insufficient sensitivity and/or specificity of current screening techniques. Currently recommended techniques include colonoscopy and/or fecal blood testing for those over age 50.

The present disclosure provides, among other things, methods for colorectal cancer screening and compositions related thereto. In various embodiments, the present disclosure provides methods for colorectal cancer screening that include analysis of methylation status of one or more methylation biomarkers, and compositions related thereto. In various embodiments, the present disclosure provides methods for colorectal cancer screening that include screening methylation status of one or more methylation biomarkers in cfDNA, e.g., in ctDNA. In various embodiments, the present disclosure provides methods for colorectal cancer screening that include screening methylation status of one or more methylation biomarkers in cfDNA, e.g., in ctDNA, using MSRE-qPCR. Various compositions and methods provided herein provide sensitivity and specificity sufficient for clinical application in colorectal cancer screening. Various compositions and methods provided herein are useful in colorectal cancer screening by analysis of an accessible tissue sample of a subject, e.g., a tissue sample that is blood or a blood component (e.g., cfDNA, e.g., ctDNA), or stool.

In certain aspects, the present disclosure provides, among other things, a method of screening for colorectal cancer, the method including determining the methylation status of one or more colorectal cancer methylation loci selected from: (a) one or more genes according to Table 1 (which includes, e.g., ALK, LONRF2, ADAMTS2, FGF14, DMRT1, ST6GALNAC5, MCIDAS, PDGFD, GSG1L, ZNF492, ZNF568, ZNF542, ZNF471, ZNF132, JAM2, and CNRIP1); and/or (b) one or more differentially methylated regions (DMRs) according to Table 7 (which includes, e.g, ALK '434, CNRIP1 '232, CNRIP1 '272, LONRF2 '281, LONRF2 '387, ADAMTS2 '254, ADAMTS2 '284, ADAMTS2 '328, FGF14 '577, DMRT1 '934, ST6GALNAC5 '456, MCIDAS '855, MCIDAS '003, PDGFD '388, PDGFD '921, GSG1L '861, ZNF492 '499, ZNF492 '069, ZNF568 '252, ZNF568 '405, ZNF542 '525, ZNF542 '502, ZNF471 '527, ZNF471 '558, ZNF471 '662, ZNF132 '268, ZNF132 '415, and JAM2 '320), in DNA of a human subject, and diagnosing colorectal cancer in the subject. For instance, in some embodiments, methylation status can be determined using one or more members selected from the group consisting of methylation specific restriction enzyme quantitative polymerase chain reaction (MSRE-qPCR), methylation-specific PCR, methylation specific nuclease-assisted minor-allele enrichment PCR, and next-generation sequencing. In various embodiments, a diagnosis-confirmatory assay is performed on the human subject, e.g., a diagnosis-confirmatory assay provided in the present disclosure, subsequent to screening or diagnosis. In some instances, a diagnosis-confirmatory assay is a colonoscopy. In some instances, a diagnosis-confirmatory assay is performed within two weeks of screening or diagnosis, within one month of screening or diagnosis, within two months of screening or diagnosis, within three months of screening or diagnosis, or within one year of screening or diagnosis.

In certain aspects, the present disclosure provides, among other things, a method of methylation specific restriction enzyme quantitative polymerase chain reaction (MSRE-qPCR) for colorectal cancer screening, the method including: (a) contacting DNA of a human subject with one or more methylation specific restriction enzymes; and (b) performing qPCR of enzyme-digested DNA, or amplicons thereof, to determine the methylation status of one or more colorectal cancer methylation loci selected from: (i) one or more genes according to Table 1; and/or (ii) one or more differentially methylated regions (DMRs) according to Table 7. In various embodiments, e.g., as specifically referred to above, the DNA of the human subject is contacted with the methylation specific restriction enzymes, e.g., to digest unmethylated non-tumor derived DNA. In various embodiments, a digested DNA and/or DNA remaining after digestion, is preamplified (e.g., amplified in an amplification step that is prior to qPCR) for all or a portion of one or more of the selected colorectal cancer methylation loci. In certain embodiments, preamplification includes amplification of one or more samples of digested DNA, or DNA remaining after digestion, in an amplification reaction including one or more or allolignucleotide primer pairs of Table 13, e.g., where the oligonucleotide primers are provided in a single pool. In subsequent qPCR, those of skill in the art will appreciate that methylation status will be separately, individually determined for each individual methylation loci (e.g., each DMR). In various embodiments, e.g., as specifically referred to above, the DNA is an aliquot of a sample, such that a separate aliquot of the sample that has not been contacted with the methylation specific restriction enzymes can provide a reference pool of DNA for qPCR, which reference pool of DNA can be subjected to the same or comparable qPCR conditions as the digested DNA (e.g., preamplification using the same oligonucleotide primer pairs and quantification with qPCR).

In certain aspects, the present disclosure provides, among other things, a method of treating colorectal cancer (e.g., a colorectal cancer that is an early stage colorectal cancer), the method including: (a) diagnosing an colorectal cancer (e.g., a colorectal cancer that is an early stage colorectal cancer) based on methylation status of one or more colorectal cancer methylation loci selected from: (i) one or more genes according to Table 1; and/or (ii) one or more differentially methylated regions (DMRs) according to Table 7, in DNA of a human subject; and (b) treating the colorectal cancer (e.g., the colorectal cancer that is an early stage colorectal cancer). In various embodiments, e.g., as specifically referred to above, a diagnosis-confirmatory assay is performed on the human subject, e.g., a diagnosis-confirmatory assay provided in the present disclosure, subsequent to diagnosis based on methylation status. In some embodiments, e.g., as specifically referred to above, a diagnosis-confirmatory assay is a colonoscopy. In some embodiments, e.g., as specifically referred to above, a diagnosis-confirmatory assay is performed within two weeks of diagnosis based on methylation status, within one month of diagnosis based on methylation status, within two months of diagnosis based on methylation status, within three months of diagnosis based on methylation status, or within one year of diagnosis based on methylation status.

In certain aspects, the present disclosure provides, among other things, a method of treating early stage colorectal cancer, the method including: (a) diagnosing an early stage colorectal cancer based on methylation status of one or more colorectal cancer methylation loci selected from: (i) one or more genes according to Table 1; and/or (ii) one or more differentially methylated regions (DMRs) according to Table 7, in DNA of a human subject; and (b) treating the early stage colorectal cancer. In various embodiments, e.g., as specifically referred to above, a diagnosis-confirmatory assay is performed on the human subject, e.g., a diagnosis-confirmatory assay provided in the present disclosure, subsequent to diagnosis based on methylation status. In some embodiments, e.g., as specifically referred to above, a diagnosis-confirmatory assay is a colonoscopy. In some embodiments, e.g., as specifically referred to above, a diagnosis-confirmatory assay is performed within two weeks of diagnosis based on methylation status, within one month of diagnosis based on methylation status, within two months of diagnosis based on methylation status, within three months of diagnosis based on methylation status, or within one year of diagnosis based on methylation status.

In certain aspects, the present disclosure provides a method of analyzing or using methylation sensitive restriction enzyme-digested human DNA, e.g., methylation sensitive restriction enzyme-digested human cfDNA, in an in vitro method of screening for colorectal cancer, the method including determining the methylation status of one or more colorectal cancer methylation loci selected from: (a) one or more genes according to Table 1 (which includes, e.g., ALK, LONRF2, ADAMTS2, FGF14, DMRT1, ST6GALNAC5, MCIDAS, PDGFD, GSG1L, ZNF492, ZNF568, ZNF542, ZNF471, ZNF132, JAM2, and CNRIP1); and/or (b) one or more differentially methylated regions (DMRs) according to Table 7 (which includes, e.g, ALK '434, CNRIP1 '232, CNRIP1 '272, LONRF2 '281, LONRF2 '387, ADAMTS2 '254, ADAMTS2 '284, ADAMTS2 '328, FGF14 '577, DMRT1 '934, ST6GALNAC5 '456, MCIDAS '855, MCIDAS '003, PDGFD '388, PDGFD '921, GSG1L '861, ZNF492 '499, ZNF492 '069, ZNF568 '252, ZNF568 '405, ZNF542 '525, ZNF542 '502, ZNF471 '527, ZNF471 '558, ZNF471 '662, ZNF132 '268, ZNF132 '415, and JAM2 '320), in the DNA, and diagnosing colorectal cancer in the subject. For instance, in some embodiments, methylation status can be determined using one or more members selected from the group consisting of methylation specific restriction enzyme quantitative polymerase chain reaction (MSRE-qPCR), methylation-specific PCR, methylation specific nuclease-assisted minor-allele enrichment PCR, and next-generation sequencing. In various embodiments, a diagnosis-confirmatory assay is performed on the human subject, e.g., a diagnosis-confirmatory assay provided in the present disclosure, subsequent to screening or diagnosis. In some instances, a diagnosis-confirmatory assay is a colonoscopy. In some instances, a diagnosis-confirmatory assay is performed within two weeks of screening or diagnosis, within one month of screening or diagnosis, within two months of screening or diagnosis, within three months of screening or diagnosis, or within one year of screening or diagnosis.

In various embodiments, e.g., as specifically referred to above, an aspect of the present disclosure can include determining whether the one or more methylation loci are hypermethylated as compared to a reference, where hypermethylation is indicative of colorectal cancer.

In various embodiments, e.g., as specifically referred to above, an aspect of the present disclosure can include determining the methylation status of at least one DMR of each of ZNF471 and FGF14. In various embodiments, e.g., as specifically referred to above, an aspect of the present disclosure can include determining the methylation status of at least one DMR of each of ZNF471, FGF14, and PDGFD. In various embodiments, e.g., as specifically referred to above, an aspect of the present disclosure can include determining the methylation status of at least one DMR of each of ZNF471, FGF14, PDGFD, and ADAMTS2. In various embodiments, e.g., as specifically referred to above, an aspect of the present disclosure can include determining the methylation status of at least one DMR of each of ZNF471, FGF14, PDGFD, ADAMTS2, ZNF492, ST6GALNAC5. In various embodiments, e.g., as specifically referred to above, an aspect of the present disclosure can include determining the methylation status of at least one DMR of each of ZNF471, FGF14, PDGFD, ADAMTS2, ZNF492, ST6GALNAC5, ZNF542, LONRF2, ZNF132, and CNRIP1, ALK. In various embodiments, e.g., as specifically referred to above, an aspect of the present disclosure can include determining the methylation status of at least one DMR of each of ALK, LONRF2, ADAMTS2, FGF14, DMRT1, ST6GALNAC5, MCIDAS, PDGFD, GSG1L, ZNF568, ZNF542, ZNF471, ZNF132, JAM2, ZNF492, and CNRIP1.

In various embodiments, e.g., as specifically referred to above, an aspect of the present disclosure can expressly and/or particularly exclude use of one or more colorectal cancer methylation loci selected from: (i) one or more genes according to Table 1; and/or (ii) one or more differentially methylated regions (DMRs) according to Table 7. In some embodiments, e.g., as specifically referred to above, an aspect of the present disclosure can expressly and/or particularly exclude use of one or more colorectal cancer methylation loci selected from FGF14, ZNF471, PDGFD, and ALK and combinations thereof. In some embodiments, e.g., as specifically referred to above, an aspect of the present disclosure can expressly and/or particularly exclude use of FGF14 as a methylation locus for screening colorectal cancer, which exclusion can be exclusion of FGF14 alone or exclusion of a plurality of methylation loci including FGF14. In some embodiments, e.g., as specifically referred to above, an aspect of the present disclosure can expressly and/or particularly exclude use of ZNF471 as a methylation locus for screening colorectal cancer, which exclusion can be exclusion of ZNF471 alone or exclusion of a plurality of methylation loci including ZNF471. In some embodiments, e.g., as specifically referred to above, an aspect of the present disclosure can expressly and/or particularly exclude use of PDGFD as a methylation locus for screening colorectal cancer, which exclusion can be exclusion of PDGFD alone or exclusion of a plurality of methylation loci including PDGFD. In some embodiments, e.g., as specifically referred to above, an aspect of the present disclosure can expressly and/or particularly exclude use of ALK as a methylation locus for screening colorectal cancer, which exclusion can be exclusion of ALK alone or exclusion of a plurality of methylation loci including ALK.

In various embodiments, e.g., as specifically referred to above, an aspect of the present disclosure can include determining the methylation status of DMRs ZNF471 '558 and FGF14 '577. In various embodiments, e.g., as specifically referred to above, an aspect of the present disclosure can include determining the methylation status of DMRs ZNF471 '558, FGF14 '577, and PDGFD '388. In various embodiments, e.g., as specifically referred to above, an aspect of the present disclosure can include determining the methylation status of DMRs ZNF471 '558, FGF14 '577, PDGFD '388, ZNF471 '527, and ADAMTS2 '284. In various embodiments, e.g., as specifically referred to above, an aspect of the present disclosure can include determining the methylation status of DMRs ZNF471 '558, FGF14 '577, PDGFD '388, ZNF471 '527, ADAMTS2 '284, ADAMTS2 '254, ZNF492 '069, and ST6GALNAC5 '456. In various embodiments, e.g., as specifically referred to above, an aspect of the present disclosure can include determining the methylation status of DMRs ZNF471 '558, FGF14 '577, PDGFD '388, ZNF471 '527, ADAMTS2 '284, ADAMTS2 '254, ZNF492 '069, ST6GALNAC5 '456, ZNF542 '502, LONRF2 '281, ZNF132 '415, PDGFD '921, ZNF132 '268, CNRIP1 '272, and ALK '434. In various embodiments, e.g., as specifically referred to above, an aspect of the present disclosure can include determining the methylation status of DMRs ALK '434, CNRIP1 '232, CNRIP1 '272, LONRF2 '281, LONRF2 '387, ADAMTS2 '254, ADAMTS2 '284, ADAMTS2 '328, FGF14 '577, DMRT1 '934, ST6GALNAC5 '456, MCIDAS '855, MCIDAS '003, PDGFD '388, PDGFD '921, GSG1L '861, ZNF492 '499, ZNF492 '069, ZNF568 '252, ZNF568 '405, ZNF542 '525, ZNF542 '502, ZNF471 '527, ZNF471 '558, ZNF471 '662, ZNF132 '268, ZNF132 '415, and JAM2 '320.

In various embodiments, e.g., as specifically referred to above, an aspect of the present disclosure can expressly and/or particularly exclude use of one or more colorectal cancer DMRs selected from Table 7. In some embodiments, e.g., as specifically referred to above, an aspect of the present disclosure can expressly and/or particularly exclude use of one or more colorectal cancer DMRs selected from FGF14 '577, ZNF471 '527, ZNF471 '558, ZNF471 '662, PDGFD '388, PDGFD '921, and ALK '434 and combinations thereof. In some embodiments, e.g., as specifically referred to above, an aspect of the present disclosure can expressly and/or particularly exclude use of FGF14 '577 as a DMR for screening colorectal cancer, which exclusion can be exclusion of FGF14 '577 alone or exclusion of a plurality of DMRs including FGF14 '577. In some embodiments, e.g., as specifically referred to above, an aspect of the present disclosure can expressly and/or particularly exclude use of ZNF471 '527, ZNF471 '558, and/or ZNF471 '662 as DMRs for screening colorectal cancer, which exclusion can be exclusion of ZNF471 '527, ZNF471 '558, and/or ZNF471 '662 alone or exclusion of a plurality of DMRs including ZNF471 '527, ZNF471 '558, and/or ZNF471 '662. In some embodiments, e.g., as specifically referred to above, an aspect of the present disclosure can expressly and/or particularly exclude use of PDGFD '388 and/or PDGFD '921 as DMRs for screening colorectal cancer, which exclusion can be exclusion of PDGFD '388 and/or PDGFD '921 alone or exclusion of a plurality of DMRs including PDGFD '388 and/or PDGFD '921. In some embodiments, e.g., as specifically referred to above, an aspect of the present disclosure can expressly and/or particularly exclude use of ALK '434 as a DMR for screening colorectal cancer, which exclusion can be exclusion of ALK '434 alone or exclusion of a plurality of DMRs including ALK '434.

In various embodiments, e.g., as specifically referred to above, an aspect of the present disclosure can include amplification of one or more of the DMRs by an oligonucleotide primer pair or set of oligonucleotide primer pairs provided in Table 13. In various embodiments, e.g., as specifically referred to above, of one or more aspects of the present disclosure, subject DNA is isolated from blood, plasma, urine, saliva, or stool of the human subject. In various embodiments, e.g., as specifically referred to above, of one or more aspects of the present disclosure, DNA is cell-free DNA of the human subject.

In various embodiments, e.g., as specifically referred to above, of one or more aspects of the present disclosure, a screened subject was asymptomatic for colorectal cancer at the time of screening. In various embodiments, e.g., as specifically referred to above, of one or more aspects of the present disclosure, a screened subject had been previously screened for colorectal cancer. In various embodiments, e.g., as specifically referred to above, of one or more aspects of the present disclosure, a screened subject had been screened for colorectal cancer with in the last 10 years, within the last 5 years, within the last 4 years, within the last 3 years, within the last 2 years, or within the last year. In some embodiments, e.g., as specifically referred to above, a previous screen for colorectal cancer in the subject had diagnosed the subject as not having colorectal cancer, e.g., where the previous screen for colorectal cancer that had diagnosed the subject as not having colorectal cancer was within one year and/or where the previous screen for colorectal cancer that had diagnosed the subject as not having colorectal cancer was a colonoscopy.

In various embodiments, e.g., as specifically referred to above, of one or more aspects of the present disclosure, a method of screening achieves or includes diagnosis of early stage colorectal cancer, optionally wherein the colorectal cancer is a stage 0, stage I, stage IIA, stage IIB, or stage IIC colorectal cancer. In various embodiments, e.g., as specifically referred to above, of one or more aspects of the present disclosure, a method of screening achieves or includes diagnosis of early stage colorectal cancer, e.g., where the cancer has not metastasized. In various embodiments, e.g., as specifically referred to above, of one or more aspects of the present disclosure, a method of screening achieves or includes diagnosis of non-early stage colorectal cancer, optionally wherein the colorectal cancer is a stage IIIA, stage IIIB, stage IIIC, stage IVA, stage IVB, or a stage IVC colorectal cancer. In various embodiments, e.g., as specifically referred to above, of one or more aspects of the present disclosure, a method of screening achieves or includes diagnosis of non-early stage colorectal cancer, e.g., where the cancer has metastasized.

In various embodiments, e.g., as specifically referred to above, of one or more aspects of the present disclosure, a method of screening achieves or provides a sensitivity for colorectal cancer of at least 0.6, e.g., at least 0.7. In some embodiments, e.g., as specifically referred to above, a method of screening provided herein achieves or provides a sensitivity for colorectal cancer equal to or greater than 0.5, 0.55, 0.6, 0.65, 0.7, 0.75, 0.8, 0.85, 0.9, or 0.95.

In various embodiments, e.g., as specifically referred to above, of one or more aspects of the present disclosure, a method of screening achieves or provides a specificity for colorectal cancer of at least 0.7, e.g., at least 0.8. In some embodiments, e.g., as specifically referred to above, a method of screening provided herein achieves or provides a specificity for colorectal cancer equal to or greater than 0.5, 0.55, 0.6, 0.65, 0.7, 0.75, 0.8, 0.85, 0.9, or 0.95.

In various embodiments, e.g., as specifically referred to above, one or more aspects of the present invention can include determining whether a subject includes an oncogenic mutation. For instance, in various embodiments, e.g., as specifically referred to above, diagnosis can include determining the presence or absence of an oncogenic mutation in the subject, e.g., by analysis of cfDNA, cell sample DNA, or tissue sample DNA. In some embodiments, e.g., as specifically referred to above, the oncogenic mutation is in Kras, NRAS, PIK3CA, PTEN, TP53, BRAF, and APC. In some embodiments, e.g., as specifically referred to above, a subject may include oncogenic mutations in two or more of Kras, NRAS, PIK3CA, PTEN, TP53, BRAF, and APC.

In some aspects, the present disclosure provides, among other things, a kit for use in colorectal cancer screening, the kit including: (a) at least one oligonucleotide primer pair of Table 13, and optionally further including: (b) at least one methylation specific restriction enzyme and/or (c) a bisulfite reagent. In some aspects, the present disclosure provides, among other things, a diagnostic qPCR reaction for screening of colorectal cancer, the diagnostic qPCR reaction including: (a) human DNA; (b) a polymerase; and (c) at least one oligonucleotide primer pair of Table 13, optionally wherein the human DNA is bisulfite-treated human DNA or methylation specific restriction enzyme-digested human DNA. In various embodiments, e.g., as specifically referred to above, the oligonucleotide primer pairs include oligonucleotide primer pairs for amplification of DMRs ZNF471 '558 and FGF14 '577. In various embodiments, e.g., as specifically referred to above, the oligonucleotide primer pairs include oligonucleotide primer pairs for amplification of DMRs ZNF471 '558, FGF14 '577, and PDGFD '388. In various embodiments, e.g., as specifically referred to above, the oligonucleotide primer pairs include oligonucleotide primer pairs for amplification of DMRs ZNF471 '558, FGF14 '577, PDGFD '388, ZNF471 '527, and ADAMTS2 '284. In various embodiments, e.g., as specifically referred to above, the oligonucleotide primer pairs include oligonucleotide primer pairs for amplification of DMRs ZNF471 '558, FGF14 '577, PDGFD '388, ZNF471 '527, ADAMTS2 '284, ADAMTS2 '254, ZNF492 '069, and ST6GALNAC5 '456. In various embodiments, e.g., as specifically referred to above, the oligonucleotide primer pairs include oligonucleotide primer pairs for amplification of DMRs ZNF471 '558, FGF14 '577, PDGFD '388, ZNF471 '527, ADAMTS2 '284, ADAMTS2 '254, ZNF492 '069, ST6GALNAC5 '456, ZNF542 '502, LONRF2 '281, ZNF132 '415, PDGFD '921, ZNF132 '268, CNRIP1 '272, and ALK '434. In various embodiments, e.g., as specifically referred to above, the oligonucleotide primer pairs include oligonucleotide primer pairs for amplification of DMRs ALK '434, CNRIP1 '232, CNRIP1 '272, LONRF2 '281, LONRF2 '387, ADAMTS2 '254, ADAMTS2 '284, ADAMTS2 '328, FGF14 '577, DMRT1 '934, ST6GALNAC5 '456, MCIDAS '855, MCIDAS '003, PDGFD '388, PDGFD '921, GSG1L '861, ZNF492 '499, ZNF492 '069, ZNF568 '252, ZNF568 '405, ZNF542 '525, ZNF542 '502, ZNF471 '527, ZNF471 '558, ZNF471 '662, ZNF132 '268, ZNF132 '415, and JAM2 '320.

In various embodiments, e.g., as specifically referred to above, an aspect of the present disclosure can expressly and/or particularly exclude use of oligonucleotide primer pairs for amplification of one or more colorectal cancer DMRs selected from Table 7. In some embodiments, e.g., as specifically referred to above, an aspect of the present disclosure can expressly and/or particularly exclude use of oligonucleotide primer pairs for amplification of one or more colorectal cancer DMRs selected from FGF14 '577, ZNF471 '527, ZNF471 '558, ZNF471 '662, PDGFD '388, PDGFD '921, and ALK '434 and combinations thereof. In some embodiments, e.g., as specifically referred to above, an aspect of the present disclosure can expressly and/or particularly exclude use of oligonucleotide primer pairs for amplification of FGF14 '577 as a DMR for screening colorectal cancer, which exclusion can be exclusion of FGF14 '577 alone or exclusion of a plurality of DMRs including FGF14 '577. In some embodiments, e.g., as specifically referred to above, an aspect of the present disclosure can expressly and/or particularly exclude use of oligonucleotide primer pairs for amplification of ZNF471 '527, ZNF471 '558, and/or ZNF471 '662 as DMRs for screening colorectal cancer, which exclusion can be exclusion of ZNF471 '527, ZNF471 '558, and/or ZNF471 '662 alone or exclusion of a plurality of DMRs including ZNF471 '527, ZNF471 '558, and/or ZNF471 '662. In some embodiments, e.g., as specifically referred to above, an aspect of the present disclosure can expressly and/or particularly exclude use of oligonucleotide primer pairs for amplification of PDGFD '388 and/or PDGFD '921 as DMRs for screening colorectal cancer, which exclusion can be exclusion of PDGFD '388 and/or PDGFD '921 alone or exclusion of a plurality of DMRs including PDGFD '388 and/or PDGFD '921. In some embodiments, e.g., as specifically referred to above, an aspect of the present disclosure can expressly and/or particularly exclude use of oligonucleotide primer pairs for amplification of ALK '434 as a DMR for screening colorectal cancer, which exclusion can be exclusion of ALK '434 alone or exclusion of a plurality of DMRs including ALK '434.

In various embodiments, e.g., as specifically referred to above, of various aspects of the present disclosure a method, kit, or other composition of the present disclosure can further include or be useful in using a determined methylation status of the one or more methylation loci to identify at least one of (i) to (iv) as follows: (i) a presence of colorectal cancer in the human subject; (ii) a predisposition for colorectal cancer in the human subject; (iii) an increased risk of colorectal cancer in the human subject, and (iv) a stage of colorectal cancer in the human subject.

In various aspects and embodiments, including without limitation all aspects and embodiments provided above or otherwise provided herein, methods of colorectal cancer diagnosis provided herein are in vitro diagnostic methods, and compositions provided herein for use colorectal cancer diagnosis are compositions for in vitro use.

In various aspects, methods and compositions of the present invention can be used in combination with biomarkers known in the art, e.g., as disclosed in U.S. Pat. No. 10,006,925, which is herein incorporated by reference in its entirety.

Definitions

A or An: The articles "a" and "an" are used herein to refer to one or to more than one (i.e., to at least one) of the grammatical object of the article. By way of example, "an element" refers to one element or more than one element.

About: The term "about", when used herein in reference to a value, refers to a value that is similar, in context, to the referenced value. In general, those skilled in the art, familiar with the context, will appreciate the relevant degree of variance encompassed by "about" in that context. For example, in some embodiments, the term "about" can encompass a range of values that within 25%, 20%, 19%, 18%, 17%, 16%, 15%, 14%, 13%, 12%, 11%, 10%, 9%, 8%, 7%, 6%, 5%, 4%, 3%, 2%, 1%, or with a fraction of a percent, of the referred value.

Administration: As used herein, the term "administration" typically refers to the administration of a composition to a subject or system, for example to achieve delivery of an agent that is, is included in, or is otherwise delivered by, the composition.

Agent: As used herein, the term "agent" refers to an entity (e.g., for example, a small molecule, peptide, polypeptide, nucleic acid, lipid, polysaccharide, complex, combination, mixture, system, or phenomenon such as heat, electric current, electric field, magnetic force, magnetic field, etc.).

Amelioration: As used herein, the term "amelioration" refers to the prevention, reduction, palliation, or improvement of a state of a subject. Amelioration includes, but does not require, complete recovery or complete prevention of a disease, disorder or condition.

Amplicon or amplicon molecule: As used herein, the term "amplicon" or "amplicon molecule" refers to a nucleic acid molecule generated by transcription from a template nucleic acid molecule, or a nucleic acid molecule having a sequence complementary thereto, or a double-stranded nucleic acid including any such nucleic acid molecule. Transcription can be initiated from a primer.

Amplification: As used herein, the term "amplification" refers to the use of a template nucleic acid molecule in combination with various reagents to generate further nucleic acid molecules from the template nucleic acid molecule, which further nucleic acid molecules may be identical to or similar to (e.g., at least 70% identical, e.g., at least 75%, 80%, 85%, 90%, 91%, 92%, 93%, 94%, 95%, 96%, 97%, 98%, 99%, or 100% identical to) a segment of the template nucleic acid molecule and/or a sequence complementary thereto.

Amplification reaction mixture: As used herein, the terms "amplification reaction mixture" or "amplification reaction" refer to a template nucleic acid molecule together with reagents sufficient for amplification of the template nucleic acid molecule.

Biological Sample: As used herein, the term "biological sample" typically refers to a sample obtained or derived from a biological source (e.g., a tissue or organism or cell culture) of interest, as described herein. In some embodiments, a biological source is or includes an organism, such as an animal or human. In some embodiments, a biological sample is or include biological tissue or fluid. In some embodiments, a biological sample can be or include cells, tissue, or bodily fluid. In some embodiments, a biological sample can be or include blood, blood cells, cell-free DNA, free floating nucleic acids, ascites, biopsy samples, surgical specimens, cell-containing body fluids, sputum, saliva, feces, urine, cerebrospinal fluid, peritoneal fluid, pleural fluid, lymph, gynecological fluids, secretions, excretions, skin swabs, vaginal swabs, oral swabs, nasal swabs, washings or lavages such as a ductal lavages or broncheoalveolar lavages, aspirates, scrapings, bone marrow. In some embodiments, a biological sample is or includes cells obtained from a single subject or from a plurality of subjects. A sample can be a "primary sample" obtained directly from a biological source, or can be a "processed sample." A biological sample can also be referred to as a "sample."

Biomarker: As used herein, the term "biomarker," consistent with its use in the art, refers to a to an entity whose presence, level, or form, correlates with a particular biological event or state of interest, so that it is considered to be a "marker" of that event or state. Those of skill in the art will appreciate, for instance, in the context of a DNA biomarker, that a biomarker can be or include a locus (such as one or more methylation loci) and/or the status of a locus (e.g., the status of one or more methylation loci). To give but a few examples of biomarkers, in some embodiments, a biomarker can be or include a marker for a particular disease, disorder or condition, or can be a marker for qualitative of quantitative probability that a particular disease, disorder or condition can develop, occur, or reoccur, e.g., in a subject. In some embodiments, a biomarker can be or include a marker for a particular therapeutic outcome, or qualitative of quantitative probability thereof. Thus, in various embodiments, a biomarker can be predictive, prognostic, and/or diagnostic, of the relevant biological event or state of interest. A biomarker can be an entity of any chemical class. For example, in some embodiments, a biomarker can be or include a nucleic acid, a polypeptide, a lipid, a carbohydrate, a small molecule, an inorganic agent (e.g., a metal or ion), or a combination thereof. In some embodiments, a biomarker is a cell surface marker. In some embodiments, a biomarker is intracellular. In some embodiments, a biomarker is found outside of cells (e.g., is secreted or is otherwise generated or present outside of cells, e.g., in a body fluid such as blood, urine, tears, saliva, cerebrospinal fluid, and the like). In some embodiments a biomarker is methylation status of a methylation locus. In some instances, a biomarker may be referred to as a "marker."

To give but one example of a biomarker, in some embodiments, the term refers to expression of a product encoded by a gene, expression of which is characteristic of a particular tumor, tumor subclass, stage of tumor, etc. Alternatively or additionally, in some embodiments, presence or level of a particular marker can correlate with activity (or activity level) of a particular signaling pathway, for example, of a signaling pathway the activity of which is characteristic of a particular class of tumors.

Those of skill in the art will appreciate that a biomarker may be individually determinative of a particular biological event or state of interest, or may represent or contribute to a determination of the statistical probability of a particular biological event or state of interest. Those of skill in the art will appreciate that markers may differ in their specificity and/or sensitivity as related to a particular biological event or state of interest.

Blood component: As used herein, the term "blood component" refers to any component of whole blood, including red blood cells, white blood cells, plasma, platelets, endothelial cells, mesothelial cells, epithelial cells, and cell-free DNA. Blood components also include the components of plasma, including proteins, metabolites, lipids, nucleic acids, and carbohydrates, and any other cells that can be present in blood, e.g., due to pregnancy, organ transplant, infection, injury, or disease.

Cancer: As used herein, the terms "cancer," "malignancy," "neoplasm," "tumor," and "carcinoma," are used interchangeably to refer to a disease, disorder, or condition in which cells exhibit or exhibited relatively abnormal, uncontrolled, and/or autonomous growth, so that they display or displayed an abnormally elevated proliferation rate and/or aberrant growth phenotype. In some embodiments, a cancer can include one or more tumors. In some embodiments, a cancer can be or include cells that are precancerous (e.g., benign), malignant, pre-metastatic, metastatic, and/or non-metastatic. In some embodiments, a cancer can be or include a solid tumor. In some embodiments, a cancer can be or include a hematologic tumor. In general, examples of different types of cancers known in the art include, for example, colorectal cancer, hematopoietic cancers including leukemias, lymphomas (Hodgkin's and non-Hodgkin's), myelomas and myeloproliferative disorders; sarcomas, melanomas, adenomas, carcinomas of solid tissue, squamous cell carcinomas of the mouth, throat, larynx, and lung, liver cancer, genitourinary cancers such as prostate, cervical, bladder, uterine, and endometrial cancer and renal cell carcinomas, bone cancer, pancreatic cancer, skin cancer, cutaneous or intraocular melanoma, cancer of the endocrine system, cancer of the thyroid gland, cancer of the parathyroid gland, head and neck cancers, breast cancer, gastrointestinal cancers and nervous system cancers, benign lesions such as papillomas, and the like.

Chemotherapeutic agent: As used herein, the term "chemotherapeutic agent," consistent with its use in the art, refers to one or more agents known, or having characteristics known to, treat or contribute to the treatment of cancer. In particular, chemotherapeutic agents include pro-apoptotic, cytostatic, and/or cytotoxic agents. In some embodiments, a chemotherapeutic agent can be or include alkylating agents, anthracyclines, cytoskeletal disruptors (e.g. microtubule targeting moieties such as taxanes, maytansine, and analogs thereof, of), epothilones, histone deacetylase inhibitors HDACs), topoisomerase inhibitors (e.g., inhibitors of topoisomerase I and/or topoisomerase II), kinase inhibitors, nucleotide analogs or nucleotide precursor analogs, peptide antibiotics, platinum-based agents, retinoids, *vinca* alkaloids, and/or analogs that share a relevant anti-proliferative activity. In some particular embodiments, a chemotherapeutic agent can be or include of Actinomycin, All-trans retinoic acid, an Auiristatin, Azacitidine, Azathioprine, Bleomycin, Bortezomib, Carboplatin, Capecitabine, Cisplatin, Chlorambucil, Cyclophosphamide, Curcumin, Cytarabine, Daunorubicin, Docetaxel, Doxifluridine, Doxorubicin, Epirubicin, Epothilone, Etoposide, Fluorouracil, Gemcitabine, Hydroxyurea, Idarubicin, Imatinib, Irinotecan, Maytansine and/or analogs thereof (e.g. DM1) Mechlorethamine, Mercaptopurine, Methotrexate, Mitoxantrone, a Maytansinoid, Oxaliplatin, Paclitaxel, Pemetrexed, Teniposide, Tioguanine, Topotecan, Valrubicin, Vinblastine, Vincristine, Vindesine, Vinorelbine, or a combination thereof. In some embodiments, a chemotherapeutic agent can be utilized in the context of an antibody-drug conjugate. In some embodiments, a chemotherapeutic agent is one found in an antibody-drug conjugate selected from the group consisting of: hLL1-doxorubicin, hRS7-SN-38, hMN-14-SN-38, hLL2-SN-38, hA20-SN-38, hPAM4-SN-38, hLL1-SN-38, hRS7-Pro-2-P-Dox, hMN-14-Pro-2-P-Dox, hLL2-Pro-2-P-Dox, hA20-Pro-2-P-Dox, hPAM4-Pro-2-P-Dox, hLL1-Pro-2-P-Dox, P4/D10-doxorubicin, gemtuzumab ozogamicin, brentuximab vedotin, trastuzumab emtansine, inotuzumab ozogamicin, glembatumomab vedotin, SAR3419, SAR566658, BIIB015, BT062, SGN-75, SGN-CD19A, AMG-172, AMG-595, BAY-94-9343, ASG-SME, ASG-22ME, ASG-16M8F, MDX-1203, MLN-0264, anti-PSMA ADC, RG-7450, RG-7458, RG-7593, RG-7596, RG-7598, RG-7599, RG-7600, RG-7636, ABT-414, IMGN-853, IMGN-529, vorsetuzumab mafodotin, and lorvotuzumab mertansine. In some embodiments, a chemotherapeutic agent can be or comprise of farnesyl-thiosalicylic acid (FTS), 4-(4-Chloro-2-methylphenoxy)-N-hydroxybutanamide (CMH), estradiol (E2), tetramethoxystilbene (TMS), δ-tocatrienol, salinomycin, or curcumin.

Combination therapy: As used herein, the term "combination therapy" refers to administration to a subject of to two or more agents or regimens such that the two or more agents or regimens together treat a disease, condition, or disorder of the subject. In some embodiments, the two or more therapeutic agents or regimens can be administered simultaneously, sequentially, or in overlapping dosing regimens. Those of skill in the art will appreciate that combination therapy includes but does not require that the two agents or regimens be administered together in a single composition, nor at the same time.

Comparable: As used herein, the term "comparable" refers to members within sets of two or more conditions, circumstances, agents, entities, populations, etc., that may not be identical to one another but that are sufficiently similar to permit comparison there between, such that one of skill in the art will appreciate that conclusions can reasonably be drawn based on differences or similarities observed. In some embodiments, comparable sets of conditions, circumstances, agents, entities, populations, etc. are typically characterized by a plurality of substantially identical features and zero, one, or a plurality of differing features. Those of ordinary skill in the art will understand, in context, what degree of identity is required to render members of a set comparable. For example, those of ordinary skill in the art will appreciate that members of sets of conditions, circumstances, agents, entities, populations, etc., are comparable to one another when characterized by a sufficient number and type of substantially identical features to warrant a reasonable conclusion that differences observed can be attributed in whole or part to non-identical features thereof.

Detectable moiety: The term "detectable moiety" as used herein refers to any element, molecule, functional group, compound, fragment, or other moiety that is detectable. In some embodiments, a detectable moiety is provided or utilized alone. In some embodiments, a detectable moiety is provided and/or utilized in association with (e.g., joined to) another agent. Examples of detectable moieties include, but are not limited to, various ligands, radionuclides (e.g., $^{3}$H, $^{14}$C, $^{18}$F, $^{19}$F, $^{32}$F, $^{35}$S, $^{135}$I, $^{125}$I, $^{123}$I, $^{64}$Cu, $^{187}$Re, $^{111}$In, $^{90}$Y, $^{99m}$Tc, $^{177}$Lu, $^{89}$Zr etc.), fluorescent dyes, chemiluminescent agents, bioluminescent agents, spectrally resolvable inorganic fluorescent semiconductors nanocrystals (i.e., quantum dots), metal nanoparticles, nanoclusters, paramagnetic metal ions, enzymes, colorimetric labels, biotin, dioxigenin, haptens, and proteins for which antisera or monoclonal antibodies are available.

Diagnosis: As used herein, the term "Diagnosis" refers to determining whether, and/or the qualitative of quantitative probability that, a subject has or will develop a disease, disorder, condition, or state. For example, in diagnosis of cancer, diagnosis can include a determination regarding the risk, type, stage, malignancy, or other classification of a cancer. In some instances, a diagnosis can be or include a determination relating to prognosis and/or likely response to one or more general or particular therapeutic agents or regimens.

Diagnostic information: As used herein, the term "diagnostic information" refers to information useful in providing a diagnosis. Diagnostic information can include, without limitation, biomarker status information.

Differentially methylated: As used herein, the term "differentially methylated" describes a methylation site for which the methylation status differs between a first condition and a second condition. A methylation site that is differentially methylated can be referred to as a differentially methylated site. In some instances, a DMR is defined by the amplicon produced by amplification using oligonucleotide primers, e.g., a pair of oligonucleotide primers selected for amplification of the DMR or for amplification of a DNA region of interest present in the amplicon. In some instances, a DMR is defined as a DNA region amplified by a pair of oligonucleotide primers, including the region having the sequence of, or a sequence complementary to, the oligonucleotide primers. In some instances, a DMR is defined as a DNA region amplified by a pair of oligonucleotide primers, excluding the region having the sequence of, or a sequence complementary to, the oligonucleotide primers. As used herein, a specifically provided DMR can be unambiguously identified by the name of an associated gene followed by three digits of a starting position, such that, for example, a DMR starting at position 29921434 of ALK can be identified as ALK '434.

Differentially methylated region: As used herein, the term "differentially methylated region" (DMR) refers to a DNA region that includes one or more differentially methylated sites. A DMR that includes a greater number or frequency of methylated sites under a selected condition of interest, such as a cancerous state, can be referred to as a hypermethylation DMR. A DMR that includes a smaller number or frequency of methylated sites under a selected condition of interest, such as a cancerous state, can be referred to as a hypomethylation DMR. A DMR that is a methylation biomarker for colorectal cancer can be referred to as a colorectal cancer DMR. In some instances, a DMR can be a single nucleotide, which single nucleotide is a methylation site.

DNA region: As used herein, "DNA region" refers to any contiguous portion of a larger DNA molecule. Those of skill in the art will be familiar with techniques for determining whether a first DNA region and a second DNA region correspond, based, e.g., on sequence similarity (e.g, sequence identity or homology) of the first and second DNA regions and/or context (e.g., the sequence identity or homology of nucleic acids upstream and/or downstream of the first and second DNA regions).

Except as otherwise specified herein, sequences found in or relating to humans (e.g., that hybridize to human DNA) are found in, based on, and/or derived from the example representative human genome sequence commonly referred to, and known to those of skill in the art, as Homo sapiens (human) genome assembly GRCh38, hg38, and/or Genome Reference Consortium Human Build 38. Those of skill in the art will further appreciate that DNA regions of hg38 can be referred to by a known system including identification of particular nucleotide positions or ranges thereof in accordance with assigned numbering.

Dosing regimen: As used herein, the term "dosing regimen" can refer to a set of one or more same or different unit doses administered to a subject, typically including a plurality of unit doses administration of each of which is separated from administration of the others by a period of time. In various embodiments, one or more or all unit doses of a dosing regimen may be the same or can vary (e.g., increase over time, decrease over time, or be adjusted in accordance with the subject and/or with a medical practitioner's determination). In various embodiments, one or more or all of the periods of time between each dose may be the same or can vary (e.g., increase over time, decrease over time, or be adjusted in accordance with the subject and/or with a medical practitioner's determination). In some embodiments, a given therapeutic agent has a recommended dosing regimen, which can involve one or more doses. Typically, at least one recommended dosing regimen of a marketed drug is known to those of skill in the art. In some embodiments, a dosing regimen is correlated with a desired or beneficial outcome when administered across a relevant population (i.e., is a therapeutic dosing regimen).

Downstream: As used herein, the term "downstream" means that a first DNA region is closer, relative to a second DNA region, to the C-terminus of a nucleic acid that includes the first DNA region and the second DNA region.

Gene: As used herein, the term "gene" refers to a single DNA region, e.g., in a chromosome, that includes a coding sequence that encodes a product (e.g., an RNA product and/or a polypeptide product), together with all, some, or none of the DNA sequences that contribute to regulation of the expression of coding sequence. In some embodiments, a gene includes one or more non-coding sequences. In some particular embodiments, a gene includes exonic and intronic sequences. In some embodiments, a gene includes one or more regulatory elements that, for example, can control or impact one or more aspects of gene expression (e.g., cell-type-specific expression, inducible expression, etc.). In some embodiments a gene includes a promoter. In some embodiments, a gene includes one or both of a (i) DNA nucleotides extending a predetermined number of nucleotides upstream of the coding sequence and (ii) DNA nucleotides extending a predetermined number of nucleotides downstream of the coding sequence. In various embodiments, the predetermined number of nucleotides can be 500 bp, 1 kb, 2 kb, 3 kb, 4 kb, 5 kb, 10 kb, 20 kb, 30 kb, 40 kb, 50 kb, 75 kb, or 100 kb.

Homology: As used herein, the term "homology" refers to the overall relatedness between polymeric molecules, e.g., between nucleic acid molecules (e.g., DNA molecules and/or RNA molecules) and/or between polypeptide molecules. Those of skill in the art will appreciate that homology can be defined, e.g., by a percent identity or by a percent homology (sequence similarity). In some embodiments, polymeric molecules are considered to be "homologous" to one another if their sequences are at least 25%, 30%, 35%, 40%, 45%, 50%, 55%, 60%, 65%, 70%, 75%, 80%, 85%, 90%, 95%, or 99% identical. In some embodiments, polymeric molecules are considered to be "homologous" to one another if their sequences are at least 25%, 30%, 35%, 40%, 45%, 50%, 55%, 60%, 65%, 70%, 75%, 80%, 85%, 90%, 95%, or 99% similar.

Hybridize: As used herein, "hybridize" refers to the association of a first nucleic acid with a second nucleic acid to form a double-stranded structure, which association occurs through complementary pairing of nucleotides. Those of skill in the art will recognize that complementary sequences, among others, can hybridize. In various embodiments, hybridization can occur, for example, between nucleotide sequences having at least 70% complementarity, e.g., at least 75%, 80%, 85%, 90%, 91%, 92%, 93%, 94%, 95%, 96%, 97%, 98%, 99%, or 100% complementarity. Those of skill in the art will further appreciate that whether hybridization of a first nucleic acid and a second nucleic acid does or does not occur can dependence upon various reaction conditions. Conditions under which hybridization can occur are known in the art.

Hypomethylation: As used herein, the term "hypomethylation" refers to the state of a methylation locus having at least one fewer methylated nucleotides in a state of interest as compared to a reference state (e.g., at least one fewer methylated nucleotides in colorectal cancer than in healthy control).

Hypermethylation: As used herein, the term "hypermethylation" refers to the state of a methylation locus having at least one more methylated nucleotide in a state of interest as compared to a reference state (e.g., at least one more methylated nucleotide in colorectal cancer than in healthy control).

Identity: As used herein, the term "identity" refers to the overall relatedness between polymeric molecules, e.g., between nucleic acid molecules (e.g., DNA molecules and/or RNA molecules) and/or between polypeptide molecules. Methods for the calculation of a percent identity as between two provided sequences are known in the art. Calculation of the percent identity of two nucleic acid or polypeptide sequences, for example, can be performed by aligning the two sequences (or the complement of one or both sequences) for optimal comparison purposes (e.g., gaps can be introduced in one or both of a first and a second sequences for optimal alignment and non-identical sequences can be disregarded for comparison purposes). The nucleotides or amino acids at corresponding positions are then compared. When a position in the first sequence is occupied by the same residue (e.g., nucleotide or amino acid) as the corresponding position in the second sequence, then the molecules are identical at that position. The percent identity between the two sequences is a function of the number of identical positions shared by the sequences, optionally taking into account the number of gaps, and the length of each gap, which may need to be introduced for optimal alignment of the two sequences. The comparison of sequences and determination of percent identity between two sequences can be accomplished using a computational algorithm, such as BLAST (basic local alignment search tool).

"Improved," "increased," or "reduced": As used herein, these terms, or grammatically comparable comparative terms, indicate values that are relative to a comparable reference measurement. For example, in some embodiments, an assessed value achieved with an agent of interest may be "improved" relative to that obtained with a comparable reference agent or with no agent. Alternatively or additionally, in some embodiments, an assessed value in a subject or system of interest may be "improved" relative to that obtained in the same subject or system under different conditions or at a different point in time (e.g., prior to or after an event such as administration of an agent of interest), or in a different, comparable subject (e.g., in a comparable subject or system that differs from the subject or system of interest in presence of one or more indicators of a particular disease, disorder or condition of interest, or in prior exposure to a condition or agent, etc.). In some embodiments, comparative terms refer to statistically relevant differences (e.g., differences of a prevalence and/or magnitude sufficient to achieve statistical relevance). Those of skill in the art will be aware, or will readily be able to determine, in a given context, a degree and/or prevalence of difference that is required or sufficient to achieve such statistical significance.

Methylation: As used herein, the term "methylation" includes methylation at any of (i) C5 position of cytosine; (ii) N4 position of cytosine; and (iii) the N6 position of adenine. Methylation also includes (iv) other types of nucleotide methylation. A nucleotide that is methylated can be referred to as a "methylated nucleotide" or "methylated nucleotide base." In certain embodiments, methylation specifically refers to methylation of cytosine residues. In some instances, methylation specifically refers to methylation of cytosine residues present in CpG sites.

Methylation assay: As used herein, the term "methylation assay" refers to any technique that can be used to determine the methylation status of a methylation locus.

Methylation biomarker: As used herein, the term "methylation biomarker" refers to a biomarker that is or includes at least one methylation locus and/or the methylation status of at least one methylation locus, e.g., a hypermethylation locus. In particular, a methylation biomarker is a biomarker characterized by a change between a first state and a second state (e.g., between a cancerous state and a non-cancerous state) in methylation status of one or more nucleic acid loci.

Methylation locus: As used herein, the term "methylation locus" refers to a DNA region that includes at least one differentially methylated region. A methylation locus that includes a greater number or frequency of methylated sites under a selected condition of interest, such as a cancerous state, can be referred to as a hypermethylation locus. A methylation locus that includes a smaller number or frequency of methylated sites under a selected condition of interest, such as a cancerous state, can be referred to as a hypomethylation locus.

Methylation site: As used herein, a methylation site refers to a nucleotide or nucleotide position that is methylated in at least one condition. In its methylated state, a methylation site can be referred to as a methylated site.

Methylation status: As used herein, "methylation status," "methylation state," or "methylation profile" refer to the number, frequency, or pattern of methylation at methylation sites within a methylation locus. Accordingly, a change in methylation status between a first state and a second state can be or include an increase in the number, frequency, or pattern of methylated sites, or can be or include a decrease in the number, frequency, or pattern of methylated sites. In various instances, a change in methylation status in a change in methylation value.

Methylation value: As used herein, the term "methylation value" refers to a numerical representation of a methylation status, e.g., in the form of number that represents the frequency or ratio of methylation of a methylation locus. In some instances, a methylation value can be generated by a method that includes quantifying the amount of intact nucleic acid present in a sample following restriction digestion of the sample with a methylation dependent restriction enzyme. In some instances, a methylation value can be generated by a method that includes comparing amplification profiles after bisulfite reaction of a sample. In some instances, a methylation value can be generated by comparing sequences of bisulfite-treated and untreated nucleic acids. In some instances a methylation value is, includes, or is based on a quantitative PCR result.

Nucleic acid: As used herein, in its broadest sense, the term "nucleic acid" refers to any compound and/or substance that is or can be incorporated into an oligonucleotide chain. In some embodiments, a nucleic acid is a compound and/or substance that is or can be incorporated into an oligonucleotide chain via a phosphodiester linkage. As will be clear from context, in some embodiments, the term nucleic acid refers to an individual nucleic acid residue (e.g., a nucleotide and/or nucleoside), and in some embodiments refers to an polynucleotide chain comprising a plurality of individual nucleic acid residues. A nucleic acid can be or include DNA, RNA, or a combinations thereof. A nucleic acid can include natural nucleic acid residues, nucleic acid analogs, and/or synthetic residues. In some embodiments, a nucleic acid includes natural nucleotides (e.g., adenosine, thymidine, guanosine, cytidine, uridine, deoxyadenosine, deoxythymidine, deoxy guanosine, and deoxycytidine). In some embodiments, a nucleic acid is or includes of one or more nucleotide analogs (e.g., 2-aminoadenosine, 2-thiothymidine, inosine, pyrrolo-pyrimidine, 3-methyl adenosine, 5-methylcytidine, C-5 propynyl-cytidine, C-5 propynyl-uridine, 2-aminoadenosine, C5-bromouridine, C5-fluorouridine, C5-iodouridine, C5-propynyl-uridine, C5-propynyl-cytidine, C5-methylcytidine, 2-aminoadenosine, 7-deazaadenosine, 7-deazaguanosine, 8-oxoadenosine, 8-oxoguanosine, 0(6)-methylguanine, 2-thiocytidine, methylated bases, intercalated bases, and combinations thereof).

In some embodiments, a nucleic acid has a nucleotide sequence that encodes a functional gene product such as an RNA or protein. In some embodiments, a nucleic acid includes one or more introns. In some embodiments, a nucleic acid includes one or more genes. In some embodiments, nucleic acids are prepared by one or more of isolation from a natural source, enzymatic synthesis by polymerization based on a complementary template (in vivo or in vitro), reproduction in a recombinant cell or system, and chemical synthesis.

In some embodiments, a nucleic acid analog differs from a nucleic acid in that it does not utilize a phosphodiester backbone. For example, in some embodiments, a nucleic acid can include one or more peptide nucleic acids, which are known in the art and have peptide bonds instead of phosphodiester bonds in the backbone. Alternatively or additionally, in some embodiments, a nucleic acid has one or more phosphorothioate and/or 5'-N-phosphoramidite linkages rather than phosphodiester bonds. In some embodiments, a nucleic acid comprises one or more modified sugars (e.g., 2'-fluororibose, ribose, 2'-deoxyribose, arabinose, and hexose) as compared with those in natural nucleic acids.

In some embodiments, a nucleic acid is or includes at least 3, 4, 5, 6, 7, 8, 9, 10, 15, 20, 25, 30, 35, 40, 45, 50, 55, 60, 65, 70, 75, 80, 85, 90, 95, 100, 110, 120, 130, 140, 150, 160, 170, 180, 190, 20, 225, 250, 275, 300, 325, 350, 375, 400, 425, 450, 475, 500, 600, 700, 800, 900, 1000, 1500, 2000, 2500, 3000, 3500, 4000, 4500, 5000 or more residues. In some embodiments, a nucleic acid is partly or wholly single stranded, or partly or wholly double stranded.

Nucleic acid detection assay: As used herein, the term "nucleic acid detection assay" refers to any method of determining the nucleotide composition of a nucleic acid of interest. Nucleic acid detection assays include but are not limited to, DNA sequencing methods, polymerase chain reaction-based methods, probe hybridization methods, ligase chain reaction, etc.

Nucleotide: As used herein, the term "nucleotide" refers to a structural component, or building block, of polynucleotides, e.g., of DNA and/or RNA polymers. A nucleotide includes of a base (e.g., adenine, thymine, uracil, guanine, or cytosine) and a molecule of sugar and at least one phosphate group. As used herein, a nucleotide can be a methylated nucleotide or an un-methylated nucleotide. Those of skill in the art will appreciate that nucleic acid terminology, such as, as examples, "locus" or "nucleotide" can refer to both a locus or nucleotide of a single nucleic acid molecule and/or to the cumulative population of loci or nucleotides within a plurality of nucleic acids (e.g., a plurality of nucleic acids in a sample and/or representative of a subject) that are representative of the locus or nucleotide (e.g., having the same identical nucleic acid sequence and/or nucleic acid sequence context, or having a substantially identical nucleic acid sequence and/or nucleic acid context).

Oligonucleotide primer: As used herein, the term oligonucleotide primer, or primer, refers to a nucleic acid molecule used, capable of being used, or for use in, generating amplicons from a template nucleic acid molecule. Under transcription-permissive conditions (e.g., in the presence of nucleotides and a DNA polymerase, and at a suitable temperature and pH), an oligonucleotide primer can provide a point of initiation of transcription from a template to which the oligonucleotide primer hybridizes. Typically, an oligonucleotide primer is a single-stranded nucleic acid between 5 and 200 nucleotides in length. Those of skill in the art will appreciate that optimal primer length for generating amplicons from a template nucleic acid molecule can vary with conditions including temperature parameters, primer composition, and transcription or amplification method. A pair of oligonucleotide primers, as used herein, refers to a set of two oligonucleotide primers that are respectively complementary to a first strand and a second strand of a template double-stranded nucleic acid molecule. First and second members of a pair of oligonucleotide primers may be referred to as a "forward" oligonucleotide primer and a "reverse" oligonucleotide primer, respectively, with respect to a template nucleic acid strand, in that the forward oligonucleotide primer is capable of hybridizing with a nucleic acid strand complementary to the template nucleic acid strand, the reverse oligonucleotide primer is capable of hybridizing with the template nucleic acid strand, and the position of the forward oligonucleotide primer with respect to the template nucleic acid strand is 5' of the position of the reverse oligonucleotide primer sequence with respect to the template nucleic acid strand. It will be understood by those of skill in the art that the identification of a first and second oligonucleotide primer as forward and reverse oligonucleotide primers, respectively, is arbitrary inasmuch as these identifiers depend upon whether a given nucleic acid strand or its complement is utilized as a template nucleic acid molecule.

Pharmaceutical composition: As used herein, the term "pharmaceutical composition" refers to a composition in which an active agent is formulated together with one or more pharmaceutically acceptable carriers. In some embodiments, the active agent is present in a unit dose amount appropriate for administration to a subject, e.g., in a therapeutic regimen that shows a statistically significant probability of achieving a predetermined therapeutic effect when administered to a relevant population. In some embodiments, a pharmaceutical composition can be formulated for administration in a particular form (e.g., in a solid form or a liquid form), and/or can be specifically adapted for, for example: oral administration (for example, as a drenche (aqueous or non-aqueous solutions or suspensions), tablet, capsule, bolus, powder, granule, paste, etc., which can be formulated specifically for example for buccal, sublingual, or systemic absorption); parenteral administration (for example, by subcutaneous, intramuscular, intravenous or epidural injection as, for example, a sterile solution or suspension, or sustained-release formulation, etc.); topical application (for example, as a cream, ointment, patch or spray applied for example to skin, lungs, or oral cavity); intravaginal or intrarectal administration (for example, as a pessary, suppository, cream, or foam); ocular administration; nasal or pulmonary administration, etc.

Pharmaceutically acceptable: As used herein, the term "pharmaceutically acceptable," as applied to one or more, or all, component(s) for formulation of a composition as disclosed herein, means that each component must be compatible with the other ingredients of the composition and not deleterious to the recipient thereof.

Pharmaceutically acceptable carrier: As used herein, the term "pharmaceutically acceptable carrier" refers to a pharmaceutically-acceptable material, composition, or vehicle, such as a liquid or solid filler, diluent, excipient, or solvent encapsulating material, that facilitates formulation and/or modifies bioavailability of an agent, e.g., a pharmaceutical agent. Some examples of materials which can serve as pharmaceutically-acceptable carriers include: sugars, such as lactose, glucose and sucrose; starches, such as corn starch and potato starch; cellulose, and its derivatives, such as sodium carboxymethyl cellulose, ethyl cellulose and cellulose acetate; powdered tragacanth; malt; gelatin; talc; excipients, such as cocoa butter and suppository waxes; oils, such as peanut oil, cottonseed oil, safflower oil, sesame oil, olive oil, corn oil and soybean oil; glycols, such as propylene glycol; polyols, such as glycerin, sorbitol, mannitol and polyethylene glycol; esters, such as ethyl oleate and ethyl laurate; agar; buffering agents, such as magnesium hydroxide and aluminum hydroxide; alginic acid; pyrogen-free water; isotonic saline; Ringer's solution; ethyl alcohol; pH buffered solutions; polyesters, polycarbonates and/or polyanhydrides; and other non-toxic compatible substances employed in pharmaceutical formulations.

Prevent or prevention: The terms "prevent" and "prevention," as used herein in connection with the occurrence of a disease, disorder, or condition, refers to reducing the risk of developing the disease, disorder, or condition; delaying onset of the disease, disorder, or condition; delaying onset of one or more characteristics or symptoms of the disease, disorder, or condition; and/or to reducing the frequency and/or severity of one or more characteristics or symptoms of the disease, disorder, or condition. Prevention can refer to prevention in a particular subject or to a statistical impact on a population of subjects. Prevention can be considered complete when onset of a disease, disorder, or condition has been delayed for a predefined period of time.

Probe: As used herein, the term "probe" refers to a single- or double-stranded nucleic acid molecule that is capable of hybridizing with a complementary target and includes a detectable moiety. In certain embodiments, a probe is a restriction digest product or is a synthetically produced nucleic acid, e.g., a nucleic acid produced by recombination or amplification. In some instances a probe is a capture probe useful in detection, identification, and/or isolation of a target sequence, such as a gene sequence. In various instances, a detectable moiety of probe can be, e.g., an enzyme (e.g., ELISA, as well as enzyme-based histochemical assays), fluorescent moiety, radioactive moiety, or moiety associated with a luminescence signal.

Prognosis: As used herein, the term "prognosis" refers to determining the qualitative of quantitative probability of at least one possible future outcome or event. As used herein, a prognosis can be a determination of the likely course of a disease, disorder, or condition such as cancer in a subject, a determination regarding the life expectancy of a subject, or a determination regarding response to therapy, e.g., to a particular therapy.

Prognostic information: As used herein, the term "prognostic information" refers to information useful in providing a prognosis. Prognostic information can include, without limitation, biomarker status information.

Promoter: As used herein, a "promoter" can refer to a DNA regulatory region that directly or indirectly (e.g., through promoter-bound proteins or substances) associates with an RNA polymerase and participates in initiation of transcription of a coding sequence.

Reference: As used herein describes a standard or control relative to which a comparison is performed. For example, in some embodiments, an agent, subject, animal, individual, population, sample, sequence, or value of interest is compared with a reference or control agent, subject, animal, individual, population, sample, sequence, or value. In some embodiments, a reference or characteristic thereof is tested and/or determined substantially simultaneously with the testing or determination of the characteristic in a sample of interest. In some embodiments, a reference is a historical reference, optionally embodied in a tangible medium. Typically, as would be understood by those of skill in the art, a reference is determined or characterized under comparable conditions or circumstances to those under assessment, e.g., with regard to a sample. Those skilled in the art will appreciate when sufficient similarities are present to justify reliance on and/or comparison to a particular possible reference or control.

Risk: As used herein with respect to a disease, disorder, or condition, the term "risk" refers to the qualitative of quantitative probability (whether expressed as a percentage or otherwise) that a particular individual will develop the disease, disorder, or condition. In some embodiments, risk is expressed as a percentage. In some embodiments, a risk is a qualitative of quantitative probability that is equal to or greater than 0, 1, 2, 3, 4, 5, 6, 7, 8, 9, 10, 20, 30, 40, 50, 60, 70, 80, 90, or 100%. In some embodiments risk is expressed as a qualitative of quantitative level of risk relative to a reference risk or level or the risk of the same outcome attributed to a reference. In some embodiments, relative risk is increased or decreased in comparison to the reference sample by a factor of 1.1, 1.2, 1.3, 1.4, 1.5, 1.6, 1.7, 1.8, 1.9, 2, 3, 4, 5, 6, 7, 8, 9, 10, or more.

Sample: As used herein, the term "sample" typically refers to an aliquot of material obtained or derived from a source of interest. In some embodiments, a source of interest is a biological or environmental source. In some embodiments, a sample is a "primary sample" obtained directly from a source of interest. In some embodiments, as will be clear from context, the term "sample" refers to a preparation that is obtained by processing of a primary sample (e.g., by removing one or more components of and/or by adding one or more agents to a primary sample). Such a "processed sample" can include, for example cells, nucleic acids, or proteins extracted from a sample or obtained by subjecting a primary sample to techniques such as amplification or reverse transcription of nucleic acids, isolation and/or purification of certain components, etc.

In certain instances, a processed sample can be a DNA sample that has been amplified (e.g., pre-amplified). Thus, in various instances, an identified sample can refer to a primary form of the sample or to a processed form of the sample. In some instances, a sample that is enzyme-digested DNA can refer to primary enzyme-digested DNA (the immediate product of enzyme digestion) or a further processed sample such as enzyme-digested DNA that has been subject to an amplification step (e.g., an intermediate amplification step, e.g., pre-amplification) and/or to a filtering step, purification step, or step that modifies the sample to facilitate a further step, e.g., in a process of determining methylation status (e.g., methylation status of a primary sample of DNA and/or of DNA as it existed in its original source context).

Screening: As used herein, the term "screening" refers to any method, technique, process, or undertaking intended to generate diagnostic information and/or prognostic information. Accordingly, those of skill in the art will appreciate that the term screening encompasses method, technique, process, or undertaking that determines whether an individual has, is likely to have or develop, or is at risk of having or developing a disease, disorder, or condition, e.g., colorectal cancer.

Specificity: As used herein, the "specificity" of a biomarker refers to the percentage of samples that are characterized by absence of the event or state of interest for which measurement of the biomarker accurately indicates absence of the event or state of interest (true negative rate). In various embodiments, characterization of the negative samples is independent of the biomarker, and can be achieved by any relevant measure, e.g., any relevant measure known to those of skill in the art. Thus, specificity reflects the probability that the biomarker would detect the absence of the event or state of interest when measured in a sample not characterized that event or state of interest. In particular embodiments in which the event or state of interest is colorectal cancer, specificity refers to the probability that a biomarker would detect the absence of colorectal cancer in a subject lacking colorectal cancer. Lack of colorectal cancer can be determined, e.g., by histology.

Sensitivity: As used herein, the "sensitivity" of a biomarker refers to the percentage of samples that are characterized by the presence of the event or state of interest for which measurement of the biomarker accurately indicates presence of the event or state of interest (true positive rate). In various embodiments, characterization of the positive samples is independent of the biomarker, and can be achieved by any relevant measure, e.g., any relevant measure known to those of skill in the art. Thus, sensitivity reflects the probability that a biomarker would detect the presence of the event or state of interest when measured in a sample characterized by presence of that event or state of interest. In particular embodiments in which the event or state of interest is colorectal cancer, sensitivity refers to the probability that a biomarker would detect the presence of colorectal cancer in a subject that has colorectal cancer. Presence of colorectal cancer can be determined, e.g., by histology.

Solid Tumor: As used herein, the term "solid tumor" refers to an abnormal mass of tissue including cancer cells. In various embodiments, a solid tumor is or includes an abnormal mass of tissue that does not contain cysts or liquid areas. In some embodiments, a solid tumor can be benign; in some embodiments, a solid tumor can be malignant. Examples of solid tumors include carcinomas, lymphomas, and sarcomas. In some embodiments, solid tumors can be or include adrenal, bile duct, bladder, bone, brain, breast, cervix, colon, endometrium, esophagum, eye, gall bladder, gastrointestinal tract, kidney, larynx, liver, lung, nasal cavity, nasopharynx, oral cavity, ovary, penis, pituitary, prostate, retina, salivary gland, skin, small intestine, stomach, testis, thymus, thyroid, uterine, vaginal, and/or vulval tumors.

Stage of cancer: As used herein, the term "stage of cancer" refers to a qualitative or quantitative assessment of the level of advancement of a cancer. In some embodiments, criteria used to determine the stage of a cancer can include, but are not limited to, one or more of where the cancer is located in a body, tumor size, whether the cancer has spread to lymph nodes, whether the cancer has spread to one or more different parts of the body, etc. In some embodiments, cancer can be staged using the so-called TNM System, according to which T refers to the size and extent of the main tumor, usually called the primary tumor; N refers to the number of nearby lymph nodes that have cancer; and M refers to whether the cancer has metastasized. In some embodiments, a cancer can be referred to as Stage 0 (abnormal cells are present but have not spread to nearby tissue, also called carcinoma in situ, or CIS; CIS is not cancer, but it can become cancer), Stage I-III (cancer is present; the higher the number, the larger the tumor and the more it has spread into nearby tissues), or Stage IV (the cancer has spread to distant parts of the body). In some embodiments, a cancer can be assigned to a stage selected from the group consisting of: in situ (abnormal cells are present but have not spread to nearby tissue); localized (cancer is limited to the place where it started, with no sign that it has spread); regional (cancer has spread to nearby lymph nodes, tissues, or organs): distant (cancer has spread to distant parts of the body); and unknown (there is not enough information to identify cancer stage).

Susceptible to: An individual who is "susceptible to" a disease, disorder, or condition is at risk for developing the disease, disorder, or condition. In some embodiments, an individual who is susceptible to a disease, disorder, or condition does not display any symptoms of the disease, disorder, or condition. In some embodiments, an individual who is susceptible to a disease, disorder, or condition has not been diagnosed with the disease, disorder, and/or condition. In some embodiments, an individual who is susceptible to a disease, disorder, or condition is an individual who has been exposed to conditions associated with, or presents a biomarker status (e.g., a methylation status) associated with, development of the disease, disorder, or condition. In some embodiments, a risk of developing a disease, disorder, and/or condition is a population-based risk (e.g., family members of individuals suffering from the disease, disorder, or condition).

Subject: As used herein, the term "subject" refers to an organism, typically a mammal (e.g., a human). In some embodiments, a subject is suffering from a disease, disorder or condition. In some embodiments, a subject is susceptible to a disease, disorder, or condition. In some embodiments, a subject displays one or more symptoms or characteristics of a disease, disorder or condition. In some embodiments, a subject is not suffering from a disease, disorder or condition. In some embodiments, a subject does not display any symptom or characteristic of a disease, disorder, or condition. In some embodiments, a subject is someone with one or more features characteristic of susceptibility to or risk of a disease, disorder, or condition. In some embodiments, a subject is a patient. In some embodiments, a subject is an individual to whom diagnosis has been performed and/or to whom therapy has been administered. In some instances, a human subject can be interchangeably referred to as an "individual."

Therapeutic agent: As used herein, the term "therapeutic agent" refers to any agent that elicits a desired pharmacological effect when administered to a subject. In some embodiments, an agent is considered to be a therapeutic agent if it demonstrates a statistically significant effect across an appropriate population. In some embodiments, the appropriate population can be a population of model organisms or a human population. In some embodiments, an appropriate population can be defined by various criteria, such as a certain age group, gender, genetic background, preexisting clinical conditions, etc. In some embodiments, a therapeutic agent is a substance that can be used for treatment of a disease, disorder, or condition. In some embodiments, a therapeutic agent is an agent that has been or is required to be approved by a government agency before it can be marketed for administration to humans. In some embodiments, a therapeutic agent is an agent for which a medical prescription is required for administration to humans.

Therapeutically effective amount: As used herein, the term "therapeutically effective amount" refers to an amount that produces a desired effect for which it is administered. In some embodiments, the term refers to an amount that is sufficient, when administered to a population suffering from or susceptible to a disease, disorder, or condition, in accordance with a therapeutic dosing regimen, to treat the disease, disorder, or condition. Those of ordinary skill in the art will appreciate that the term therapeutically effective amount does not in fact require successful treatment be achieved in a particular individual. Rather, a therapeutically effective amount can be an amount that provides a particular desired pharmacological response in a significant number of subjects when administered to individuals in need of such treatment. In some embodiments, reference to a therapeutically effective amount can be a reference to an amount as measured in one or more specific tissues (e.g., a tissue affected by the disease, disorder or condition) or fluids (e.g., blood, saliva, serum, sweat, tears, urine, etc.). Those of ordinary skill in the art will appreciate that, in some embodiments, a therapeutically effective amount of a particular agent can be formulated and/or administered in a single dose. In some embodiments, a therapeutically effective agent can be formulated and/or administered in a plurality of doses, for example, as part of a multi-dose dosing regimen.

Treatment: As used herein, the term "treatment" (also "treat" or "treating") refers to administration of a therapy that partially or completely alleviates, ameliorates, relieves, inhibits, delays onset of, reduces severity of, and/or reduces incidence of one or more symptoms, features, and/or causes of a particular disease, disorder, or condition, or is administered for the purpose of achieving any such result. In some embodiments, such treatment can be of a subject who does not exhibit signs of the relevant disease, disorder, or condition and/or of a subject who exhibits only early signs of the disease, disorder, or condition. Alternatively or additionally, such treatment can be of a subject who exhibits one or more established signs of the relevant disease, disorder and/or condition. In some embodiments, treatment can be of a subject who has been diagnosed as suffering from the relevant disease, disorder, and/or condition. In some embodiments, treatment can be of a subject known to have one or more susceptibility factors that are statistically correlated with increased risk of development of the relevant disease, disorder, or condition. In various examples, treatment is of a cancer.

Upstream: As used herein, the term "upstream" means a first DNA region is closer, relative to a second DNA region, to the N-terminus of a nucleic acid that includes the first DNA region and the second DNA region.

Unit dose: As used herein, the term "unit dose" refers to an amount administered as a single dose and/or in a physically discrete unit of a pharmaceutical composition. In many embodiments, a unit dose contains a predetermined quantity of an active agent. In some embodiments, a unit dose contains an entire single dose of the agent. In some embodiments, more than one unit dose is administered to achieve a total single dose. In some embodiments, administration of multiple unit doses is required, or expected to be required, in order to achieve an intended effect. A unit dose can be, for example, a volume of liquid (e.g., an acceptable carrier) containing a predetermined quantity of one or more therapeutic moieties, a predetermined amount of one or more therapeutic moieties in solid form, a sustained release formulation or drug delivery device containing a predetermined amount of one or more therapeutic moieties, etc. It will be appreciated that a unit dose can be present in a formulation that includes any of a variety of components in addition to the therapeutic agent(s). For example, acceptable carriers (e.g., pharmaceutically acceptable carriers), diluents, stabilizers, buffers, preservatives, etc., can be included. It will be appreciated by those skilled in the art, in many embodiments, a total appropriate daily dosage of a particular therapeutic agent can comprise a portion, or a plurality, of unit doses, and can be decided, for example, by a medical practitioner within the scope of sound medical judgment. In some embodiments, the specific effective dose level for any particular subject or organism can depend upon a variety of factors including the disorder being treated and the severity of the disorder; activity of specific active compound employed; specific composition employed; age, body weight, general health, sex and diet of the subject; time of administration, and rate of excretion of the specific active compound employed; duration of the treatment; drugs and/or additional therapies used in combination or coincidental with specific compound(s) employed, and like factors well known in the medical arts Unmethylated: As used herein, the terms "unmethylated" and "non-methylated" are used interchangeable and mean that an identified DNA region includes no methylated nucleotides.

Variant: As used herein, the term "variant" refers to an entity that shows significant structural identity with a reference entity but differs structurally from the reference entity in the presence, absence, or level of one or more chemical moieties as compared with the reference entity. In some embodiments, a variant also differs functionally from its reference entity. In general, whether a particular entity is properly considered to be a "variant" of a reference entity is based on its degree of structural identity with the reference entity. A variant can be a molecule comparable, but not identical to, a reference. For example, a variant nucleic acid can differ from a reference nucleic acid at one or more differences in nucleotide sequence. In some embodiments, a variant nucleic acid shows an overall sequence identity with a reference nucleic acid that is at least 85%, 86%, 87%, 88%, 89%, 90%, 91%, 92%, 93%, 94%, 95%, 96%, 97%, or 99%. In many embodiments, a nucleic acid of interest is considered to be a "variant" of a reference nucleic acid if the nucleic acid of interest has a sequence that is identical to that of the reference but for a small number of sequence alterations at particular positions. In some embodiments, a variant has 10, 9, 8, 7, 6, 5, 4, 3, 2, or 1 substituted residues as compared with a reference. In some embodiments, a variant has not more than 5, 4, 3, 2, or 1 residue additions, substitutions, or deletions as compared with the reference. In various embodiments, the number of additions, substitutions, or deletions is fewer than about 25, about 20, about 19, about 18, about 17, about 16, about 15, about 14, about 13, about 10, about 9, about 8, about 7, about 6, and commonly are fewer than about 5, about 4, about 3, or about 2 residues.

BRIEF DESCRIPTION OF THE DRAWING

FIG. 2 is a table showing characteristics of a first subject group of 70 human subjects. FIG. 2 provides the percent female, percent male, age range, and BMI of subjects.

FIG. 2 further distinguishes the types of colorectal cancer identified in the first subject group as localized or advanced based on histological evaluation, and as a proximal or distal based on colonoscopy evaluation of colon.

FIG. 3 is a table showing characteristics of a second subject group of 63 human subjects. FIG. 3 provides the percent female, percent male, age range, and BMI of subjects. FIG. 3 further distinguishes the types of colorectal cancer identified in the second subject group as localized or advanced based on histological evaluation, and as a proximal or distal based on colonoscopy evaluation of colon.

FIG. 10 is a table showing characteristics of a third subject group of 82 human subjects. FIG. 10 provides the percent female, percent male, age range, and BMI of subjects diagnosed by screening using 28 colorectal cancer DMRs of the present disclosure. FIG. 10 further distinguishes the types of colorectal cancer identified in the third subject group as localized or advanced based on histological evaluation, and as a proximal or distal based on colonoscopy evaluation of colon.

DETAILED DESCRIPTION

Screening for Colorectal Cancer

There is a need for improved methods of screening for colorectal cancer, including screening for diagnosis of early-stage colorectal cancer. Despite recommendations for screening of individuals, e.g., over age 50, colorectal cancer screening programs are often ineffective or unsatisfactory. Improved colorectal cancer screening improves diagnosis and reduces colorectal cancer mortality.

Figure 20:
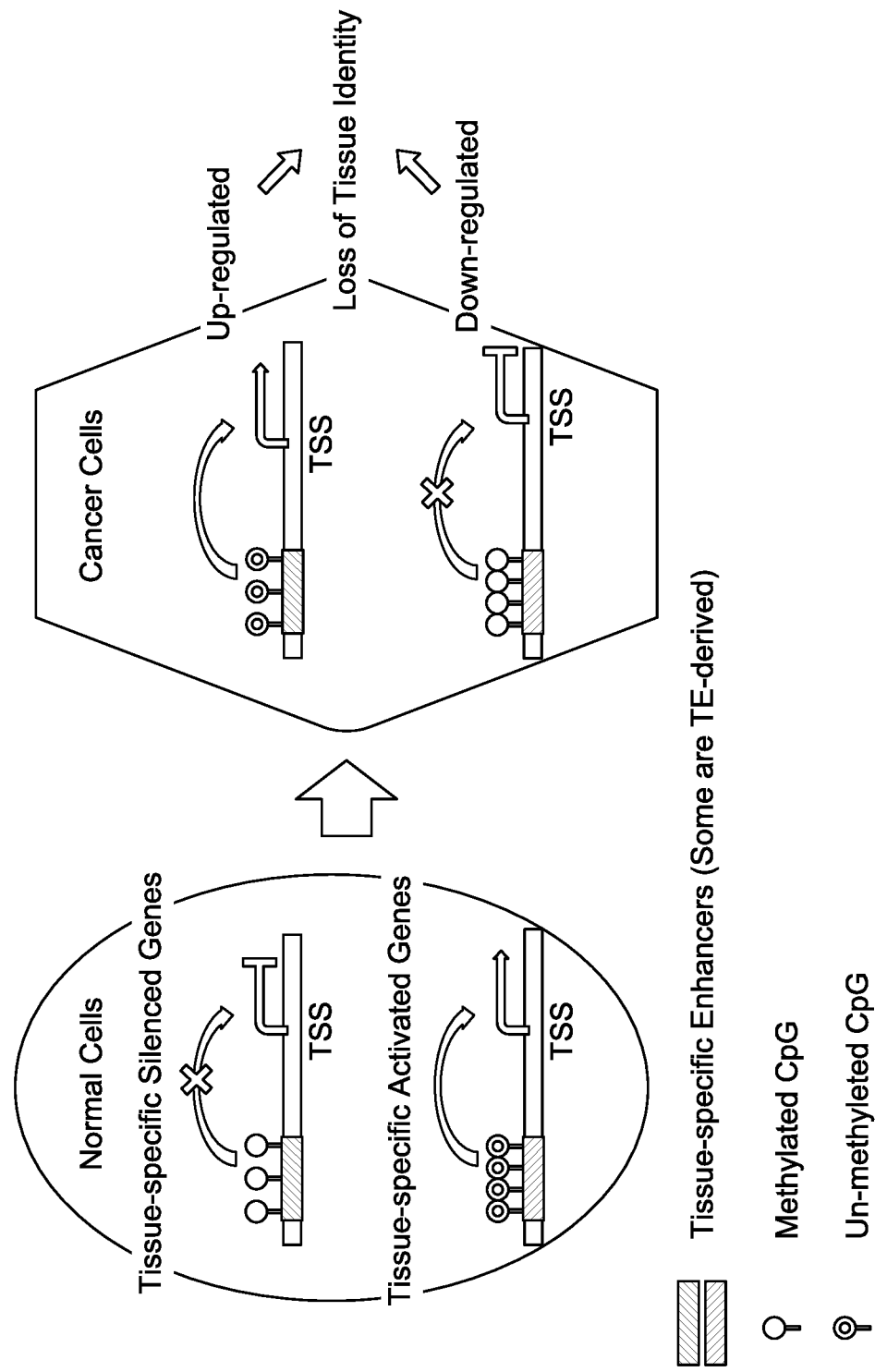
FIG. 20 is a schematic showing example methylation changes in methylation status between normal and cancer cells, and further indicates how changes in methylation status can impact gene expression differences between normal and cancer cells.

DNA methylation (e.g., hypermethylation or hypomethylation) can activate or inactivate genes, including genes that impact cancer development (see, e.g., FIG. 20). Thus, for example, hypermethylation can inactivate one or more genes that typically act to suppress cancer, causing or contributing to development of cancer in a sample or subject.

The present disclosure includes the discovery that determination of the methylation status of one or more methylation loci provided herein, and/or the methylation status of one or more DMRs provided herein, and/or the methylation status of one or more methylation sites provided herein, provides screening for colorectal cancer, e.g., with a high degree of sensitivity and/or specificity. The present disclosure provides compositions and methods including or relating to colorectal cancer methylation biomarkers that, individually or in various panels comprising two or more colorectal cancer methylation biomarkers, provide for screening of colorectal cancer, e.g., with a high degree of specificity and/or sensitivity.

In various embodiments, a colorectal cancer methylation biomarker of the present disclosure is selected from a methylation locus that is or includes ALK, LONRF2, ADAMTS2, FGF14, DMRT1, ST6GALNAC5, MCIDAS, PDGFD, GSG1L, ZNF492, ZNF568, ZNF542, ZNF471, ZNF132, JAM2, and CNRIP1 (see, e.g., Table 1). In various embodiments, a colorectal cancer DMR is selected from ALK '434, CNRIP1 '232, CNRIP1 '272, LONRF2 '281, LONRF2 '387, ADAMTS2 '254, ADAMTS2 '284, ADAMTS2 '328, FGF14 '577, DMRT1 '934, ST6GALNAC5 '456, MCIDAS '855, MCIDAS '003, PDGFD '388, PDGFD '921, GSG1L '861, ZNF492 '499, ZNF492 '069, ZNF568 '252, ZNF568 '405, ZNF542 '525, ZNF542 '502, ZNF471 '527, ZNF471 '558, ZNF471 '662, ZNF132 '268, ZNF132 '415, and JAM2 '320 (see, e.g., Table 7)

For the avoidance of any doubt, any methylation biomarker provided herein can be, or be included in, among other things, a colorectal cancer methylation biomarker.

In some embodiments, a colorectal cancer methylation biomarker can be or include a single methylation locus. In some embodiments, a colorectal cancer methylation biomarker can be or include two or more methylation loci. In some embodiments, a colorectal cancer methylation biomarker can be or include a single differentially methylated region (DMR). In some embodiments, a methylation locus can be or include two or more DMRs. In some embodiments, a methylation biomarker can be or include a single methylation site. In other embodiments, a methylation biomarker can be or include two or more methylation sites. In some embodiments, a methylation locus can include two or more DMRs and further include DNA regions adjacent to one or more of the included DMRs.

In some instances, a methylation locus is or includes a gene, such as a gene provided in Table 1. In some instances a methylation locus is or includes a portion of a gene, e.g., a portion of a gene provided in Table 1. In some instances, a methylation locus includes but is not limited to identified nucleic acid boundaries of a gene.

In some instances, a methylation locus is or includes a coding region of a gene, such as a coding region of a gene provided in Table 1. In some instances a methylation locus is or includes a portion of the coding region of gene, e.g., a portion of the coding region a gene provided in Table 1. In some instances, a methylation locus includes but is not limited to identified nucleic acid boundaries of a coding region of gene.

In some instances, a methylation locus is or includes a promoter and/or other regulatory region of a gene, such as a promoter and/or other regulatory region of a gene provided in Table 1. In some instances a methylation locus is or includes a portion of the promoter and/or regulatory region of gene, e.g., a portion of promoter and/or regulatory region a gene provided in Table 1. In some instances, a methylation locus includes but is not limited to identified nucleic acid boundaries of a promoter and/or other regulatory region of gene. In some embodiments a methylation locus is or includes a high CpG density promoter, or a portion thereof.

In some embodiments, a methylation locus is or includes non-coding sequence. In some embodiments, a methylation locus is or includes one or more exons, and/or one or more introns.

In some embodiments, a methylation locus includes a DNA region extending a predetermined number of nucleotides upstream of a coding sequence, and/or a DNA region extending a predetermined number of nucleotides downstream of a coding sequence. In various instances, a predetermined number of nucleotides upstream and/or downstream and be or include, e.g., 500 bp, 1 kb, 2 kb, 3 kb, 4 kb, 5 kb, 10 kb, 20 kb, 30 kb, 40 kb, 50 kb, 75 kb, or 100 kb. Those of skill in the art will appreciate that methylation biomarkers capable of impacting expression of a coding sequence may typically be within any of these distances of the coding sequence, upstream and/or downstream.

Those of skill in the art will appreciate that a methylation locus identified as a methylation biomarker need not necessarily be assayed in a single experiment, reaction, or amplicon. A single methylation locus identified as a colorectal cancer methylation biomarker can be assayed, e.g., in a method including separate amplification (or providing oligonucleotide primers and conditions sufficient for amplification of) of one or more distinct or overlapping DNA regions within a methylation locus, e.g., one or more distinct or overlapping DMRs. Those of skill in the art will further appreciate that a methylation locus identified as a methylation biomarker need not be analyzed for methylation status of each nucleotide, nor each CpG, present within the methylation locus. Rather, a methylation locus that is a methylation biomarker may be analyzed, e.g., by analysis of a single DNA region within the methylation locus, e.g., by analysis of a single DMR within the methylation locus.

DMRs of the present disclosure can be a methylation locus or include a portion of a methylation locus. In some instances, a DMR is a DNA region with a methylation locus that is, e.g., 1 to 5,000 bp in length. In various embodiments, a DMR is a DNA region with a methylation locus that is equal to or less than 5000 bp, 4,000 bp, 3,000 bp, 2,000 bp, 1,000 bp, 950 bp, 900 bp, 850 bp, 800 bp, 750 bp, 700 bp, 650 bp, 600 bp, 550 bp, 500 bp, 450 bp, 400 bp, 350 bp, 300 bp, 250 bp, 200 bp, 150 bp, 100 bp, 50 bp, 40 bp, 30 bp, 20 bp, or 10 bp in length. In some embodiments, a DMR is 1, 2, 3, 4, 5, 6, 7, 8 or 9 bp in length.

Methylation biomarkers, including without limitation methylation loci and DMRs provided herein, can include at least one methylation site that is a colorectal cancer methylation biomarker.

For clarity, those of skill in the art will appreciate that term methylation biomarker is used broadly, such that a methylation locus can be a methylation biomarker that includes one or more DMRs, each of which DRMs is also itself a methylation biomarker, and each of which DMRs can include one or more methylation sites, each of which methylation sites is also itself a methylation biomarker. Moreover, a methylation biomarker can include two or more methylation loci. Accordingly, status as a methylation biomarker does not turn on the contiguousness of nucleic acids included in a biomarker, but rather on the existence of a change in methylation status for included DNA region(s) between a first state and a second state, such as between colorectal cancer and controls.

As provided herein, a methylation locus can be any of one or more methylation loci each of which methylation loci is or includes a gene identified in Table 1. In some particular embodiments, a colorectal cancer methylation biomarker includes a single methylation locus that is or includes a gene identified in Table 1. For example, in various embodiments, a colorectal cancer methylation biomarker can include a single methylation locus that is or includes a gene selected from LONRF2, ADAMTS2, FGF14, ST6GALNAC5, PDGFD, ZNF492, ZNF542, ZNF471, JAM2, GSG1L, DMRT1, and MCIDAS.

In some particular embodiments, a colorectal cancer methylation biomarker includes two or more methylation loci, each of which is or includes a gene identified in Table 1. In some embodiments, a colorectal cancer methylation biomarker includes 2, 3, 4, 5, 6, 7, 8, 9, 10, 11, 12, 13, 14, 15, or 16, methylation loci, each of which is or includes a gene identified in Table 1.

In some particular embodiments, a colorectal cancer methylation biomarker includes two or more methylation loci, each of which two or more methylation loci is or includes a gene identified in any one of tables Table 1 to 6, including without limitation and combinations of two or more methylation loci that respectively are or include genes identified in a one of Tables 2 to 6. In some particular embodiments, a colorectal cancer methylation biomarker includes two methylation loci, which two methylation loci include methylation loci that are or include the genes identified in Table 2. In some particular embodiments, a colorectal cancer methylation biomarker includes three methylation loci, which three methylation loci include methylation loci that are or include the genes identified in Table 3. In some particular embodiments, a colorectal cancer methylation biomarker includes four methylation loci, which four methylation loci include methylation loci that are or include the genes identified in Table 4. In some particular embodiments, a colorectal cancer methylation biomarker includes six methylation loci, which six methylation loci include methylation loci that are or include the genes identified in Table 5. In some particular embodiments, a colorectal cancer methylation biomarker includes eleven methylation loci, which eleven methylation loci include methylation loci that are or include the genes identified in Table 6. In various particular embodiments, a colorectal cancer methylation biomarker or colorectal cancer methylation biomarker panel includes one or more methylation loci of the present disclosure, but does not include a methylation locus that is or includes all or a portion of one or more of FGF14, ZNF471, PDGFD, and ALK.

TABLE 1

| Methylation loci identified by gene name | | |
|---|---|---|
| Gene | Example DNA Region of Homo sapiens (human) genome assembly GRCh38 (hg38) | SEQ ID NO |
| ZNF132 | ZNF132 chr19, bp 58439728 to 58440994 | SEQ ID NO: 1 |
| DMRT1 | DMRT1 chr9, bp 841340 to 968090 | SEQ ID NO: 2 |
| ALK | ALK chr2, bp 29193215 to 29922286 | SEQ ID NO: 3 |
| JAM2 | JAM2 chr21, bp 25637848 to 25714704 | SEQ ID NO: 4 |
| FGF14 | FGF14 chr13, bp 101919879 to 102403137 | SEQ ID NO: 5 |
| MCIDAS | MCIDAS chr5, bp 55220951 to 55221051 | SEQ ID NO: 6 |
| ST6GALNAC5 | ST6GALNAC5 chr1, bp 76866255 to 77063388 | SEQ ID NO: 7 |
| LONRF2 | LONRF2 chr2, bp 100285667 to 100323015 | SEQ ID NO: 8 |
| PDGFD | PDGFD chr11, bp 104163499 to 104164026 | SEQ ID NO: 9 |
| GSG1L | GSG1L chr16, bp 27920615 to 28064275 | SEQ ID NO: 10 |
| ZNF492 | ZNF492 chr19, bp 22633051 to 22666433 | SEQ ID NO: 11 |
| ZNF568 | ZNF568 chr19, bp 36916312 to 36943940 | SEQ ID NO: 12 |
| ADAMTS2 | ADAMTS2 chr5, bp 179118114 to 179344392 | SEQ ID NO: 13 |
| ZNF542 | ZNF542 chr19, bp 56367838 to 56370986 | SEQ ID NO: 14 |
| ZNF471 | ZNF471 chr19, bp 56507245 to 56508589 | SEQ ID NO: 15 |
| CNRIP1 | CNRIP1 chr2, bp 68293114 to 68320928 | SEQ ID NO: 16 |

TABLE 2

Combination of
2 methylation loci

ZNF471
FGF14

TABLE 3

Combination of
3 methylation loci

ZNF471
FGF14
PDGFD

TABLE 4

Combination of
4 methylation loci

ZNF471
FGF14
PDGFD
ADAMTS2

TABLE 5

Combination of
6 methylation loci

ZNF471
FGF14
PDGFD
ADAMTS2
ZNF492
ST6GALNAC5

TABLE 6

Combination of
11 methylation loci

ZNF471
FGF14
PDGFD
ADAMTS2
ZNF492
ST6GALNAC5
ZNF542
LONRF2
ZNF132
CNRIP1
ALK

As provided herein, a DMR can be any of one or more DMRs each of which DMRs is present in a methylation locus that is or includes a gene identified in Table 1. In some particular embodiments, a colorectal cancer methylation biomarker is or includes a single DMR that is, includes all or a portion of, or is present in a gene identified in Table 1. For example, in various embodiments, a colorectal cancer methylation biomarker can include a single DMR that is, includes all or a portion of, or is present in a gene selected from ALK, LONRF2, ADAMTS2, FGF14, DMRT1, ST6GALNAC5, MCIDAS, PDGFD, GSG1L, ZNF568, ZNF542, ZNF471, ZNF132, JAM2, ZNF492, and CNRIP1 In some particular embodiments, a colorectal cancer methylation biomarker includes two or more DMRs, each of which is, includes all or a portion of, or is present in a gene identified in Table 1. In some embodiments, a colorectal cancer methylation biomarker includes 2, 3, 4, 5, 6, 7, 8, 9, 10, 11, 12, 13, 14, 15, or 16, DMRs, each of which is, includes all or a portion of, or is present in a gene identified in Table 1.

In some particular embodiments, a colorectal cancer methylation biomarker includes two or more DMRs, each of which two or more DMRs is, includes all or a portion of, or is present in a gene identified in any one of Tables 1-6. In some particular embodiments, a colorectal cancer methylation biomarker includes two DMRs, which two DMRs include DMRs that are, include all or a portion of, or are present in the genes identified in Table 2. In some particular embodiments, a colorectal cancer methylation biomarker includes three DMRs, which three DMRs include DMRs that are, include all or a portion of, or are present in the genes identified in Table 3. In some particular embodiments, a colorectal cancer methylation biomarker includes four DMRs, which four DMRs include DMRs that are, include all or a portion of, or are present in the genes identified in Table 4. In some particular embodiments, a colorectal cancer methylation biomarker includes six DMRs, which six DMRs include DMRs that are, include all or a portion of, or are present in the genes identified in Table 5. In some particular embodiments, a colorectal cancer methylation biomarker includes eleven DMRs, which eleven DMRs include DMRs that are, include all or a portion of, or are present in the genes identified in Table 6. In various particular embodiments, a colorectal cancer methylation biomarker or colorectal cancer methylation biomarker panel includes one or more DMRs, but the one or more DMRs do not include a DMR that is, includes all or a portion of, or is present in one or more of FGF14, ZNF471, PDGFD, and ALK.

As provided herein, a DMR can be any of one or more DMRs, each of which DMRs is, includes all of, or includes a portion of a DMR identified in Table 7, including without limitation DMRs specifically as identified in Table 7. In some particular embodiments, a colorectal cancer methylation biomarker is or includes a single DMR that is, includes all of, or includes a portion of a DMR identified in Table 7, including without limitation a DMR specifically as identified in Table 7, e.g., a DMR of Table Q selected from the group of DMRs including, without limitation, ALK '434, CNRIP1 '232, CNRIP1 '272, LONRF2 '281, LONRF2 '387, ADAMTS2 '254, ADAMTS2 '284, ADAMTS2 '328, FGF14 '577, DMRT1 '934, ST6GALNAC5 '456, MCIDAS '855, MCIDAS '003, PDGFD '388, PDGFD '921, GSG1L '861, ZNF492 '499, ZNF492 '069, ZNF568 '252, ZNF568 '405, ZNF542 '525, ZNF542 '502, ZNF471 '527, ZNF471 '558, ZNF471 '662, ZNF132 '268, ZNF132 '415, and JAM2 '320. For example, in various embodiments, a colorectal cancer methylation biomarker can include a single DMR that is, includes all of, or includes a portion of a DMR selected from LONRF2 '281, LONRF2 '387, ADAMTS2 '254, ADAMTS2 '284, ADAMTS2 '328, FGF14 '577, ST6GALNAC5 '456, PDGFD '388, PDGFD '921, ZNF492 '499, ZNF492 '069, ZNF542 '525, ZNF542 '502, ZNF471 '527, ZNF471 '558, and ZNF471 '662.

In some particular embodiments, a colorectal cancer methylation biomarker includes two or more DMRs, each of which DMRs is, includes all of, or includes a portion of a DMR identified in Table 7, including without limitation DMRs specifically as identified in Table 7. In some embodiments, a colorectal cancer methylation biomarker includes 2, 3, 4, 5, 6, 7, 8, 9, 10, 11, 12, 13, 14, 15, 16, 17, 18, 19, 20, 21, 22, 23, 24, 25, 26, 27, or 28 DMRs, each of which DMRs is, includes all of, or includes a portion of a DMR identified in Table 7, including without limitation DMRs specifically as identified in Table 7.

In some particular embodiments, a colorectal cancer methylation biomarker includes two or more DMRs, each of which two or more DMRs is, includes all of, or includes a portion of a DMR identified in any one of Tables 7 to 12, including without limitation DMRs and combinations thereof specifically as identified in Tables 8 to 12. In some particular embodiments, a colorectal cancer methylation biomarker includes two DMRs, which two DMRs are the DMRs identified in Table 8. In some particular embodiments, a colorectal cancer methylation biomarker includes three DMRs, which three DMRs are the DMRs identified in Table 9. In some particular embodiments, a colorectal cancer methylation biomarker includes five DMRs, which five DMRs are the DMRs identified in Table 10. In some particular embodiments, a colorectal cancer methylation biomarker includes eight DMRs, which eight DMRs are the DMRs identified in Table 11. In some particular embodiments, a colorectal cancer methylation biomarker includes fifteen DMRs, which fifteen DMRs are the DMRs identified in Table 12. In various particular embodiments, a colorectal cancer methylation biomarker or colorectal cancer methylation biomarker panel includes one or more DMRs of Table 7, but the one or more DMRs do not include one or more, or all, DMRs of FGF14, ZNF471, PDGFD, and ALK, e.g., do not include one or more, or all, DMRs of FGF14, ZNF471, PDGFD, and ALK as provided in Table 7.

TABLE 7

Colorectal cancer DMRs

| gene name | chr | start site | end site | width | SEQ ID NO |
|---|---|---|---|---|---|
| ALK | 2 | 29921434 | 29921541 | 108 | SEQ ID NO: 17 |
| CNRIP1 | 2 | 68319232 | 68319342 | 111 | SEQ ID NO: 18 |
| LONRF2 | 2 | 100321281 | 100321395 | 115 | SEQ ID NO: 19 |
| LONRF2 | 2 | 100322387 | 100322463 | 77 | SEQ ID NO: 20 |
| ADAMTS2 | 5 | 179344254 | 179344348 | 95 | SEQ ID NO: 21 |
| ADAMTS2 | 5 | 179344284 | 179344383 | 100 | SEQ ID NO: 22 |
| FGF14 | 13 | 102394577 | 102394651 | 75 | SEQ ID NO: 23 |
| DMRT1 | 9 | 841934 | 842046 | 113 | SEQ ID NO: 24 |
| ST6GALNAC5 | 1 | 76868456 | 76868525 | 70 | SEQ ID NO: 25 |
| MCIDAS | 5 | 55220855 | 55220971 | 117 | SEQ ID NO: 26 |
| MCIDAS | 5 | 55221003 | 55221122 | 120 | SEQ ID NO: 27 |
| PDGFD | 11 | 104163388 | 104163503 | 116 | SEQ ID NO: 28 |
| PDGFD | 11 | 104163921 | 104164058 | 138 | SEQ ID NO: 29 |
| GSG1L | 16 | 28063861 | 28063964 | 104 | SEQ ID NO: 30 |
| ZNF492 | 19 | 22634499 | 22634596 | 98 | SEQ ID NO: 31 |
| ZNF568 | 19 | 36916252 | 36916371 | 120 | SEQ ID NO: 32 |
| ZNF568 | 19 | 36916405 | 36916476 | 72 | SEQ ID NO: 33 |
| ZNF542 | 19 | 56368525 | 56368610 | 86 | SEQ ID NO: 34 |
| ZNF542 | 19 | 56368502 | 56368591 | 90 | SEQ ID NO: 35 |
| ZNF471 | 19 | 56507527 | 56507675 | 149 | SEQ ID NO: 36 |
| ZNF471 | 19 | 56507558 | 56507675 | 118 | SEQ ID NO: 37 |
| ZNF471 | 19 | 56507662 | 56507750 | 89 | SEQ ID NO: 38 |
| ZNF132 | 19 | 58440268 | 58440435 | 168 | SEQ ID NO: 39 |
| ZNF132 | 19 | 58440415 | 58440523 | 109 | SEQ ID NO: 40 |
| JAM2 | 21 | 25640320 | 25640399 | 80 | SEQ ID NO: 41 |
| ZNF492 | 19 | 22634069 | 22634174 | 106 | SEQ ID NO: 42 |
| CNRIP1 | 2 | 68319272 | 68319342 | 71 | SEQ ID NO: 43 |
| ADAMTS2 | 5 | 179344328 | 179344412 | 85 | SEQ ID NO: 44 |

TABLE 8

Combination of 2 DMRs

| gene name | chr | start site | end site |
|---|---|---|---|
| ZNF471 | 19 | 56507558 | 56507675 |
| FGF14 | 13 | 102394577 | 102394651 |

TABLE 9

Combination of 3 DMRs

| gene name | chr | start site | end site |
|---|---|---|---|
| ZNF471 | 19 | 56507558 | 56507675 |
| FGF14 | 13 | 102394577 | 102394651 |
| PDGFD | 11 | 104163388 | 104163503 |

TABLE 10

Combination of 5 DMRs

| gene name | chr | start site | end site |
|---|---|---|---|
| ZNF471 | 19 | 56507558 | 56507675 |
| FGF14 | 13 | 102394577 | 102394651 |
| PDGFD | 11 | 104163388 | 104163503 |
| ZNF471 | 19 | 56507527 | 56507675 |
| ADAMTS2 | 5 | 179344284 | 179344383 |

TABLE 11

Combination of 8 DMRs

| gene name | chr | start site | end site |
|---|---|---|---|
| ZNF471 | 19 | 56507558 | 56507675 |
| FGF14 | 13 | 102394577 | 102394651 |
| PDGFD | 11 | 104163388 | 104163503 |
| ZNF471 | 19 | 56507527 | 56507675 |

TABLE 11-continued

Combination of 8 DMRs

| gene name | chr | start site | end site |
|---|---|---|---|
| ADAMTS2 | 5 | 179344284 | 179344383 |
| ADAMTS2 | 5 | 179344254 | 179344348 |
| ZNF492 | 19 | 22634069 | 22634174 |
| ST6GALNAC5 | 1 | 76868456 | 76868525 |

TABLE 12

Combination of 15 DMRs

| gene name | chr | start site | end site |
|---|---|---|---|
| ZNF471 | 19 | 56507558 | 56507675 |
| FGF14 | 13 | 102394577 | 102394651 |
| PDGFD | 11 | 104163388 | 104163503 |
| ZNF471 | 19 | 56507527 | 56507675 |
| ADAMTS2 | 5 | 179344284 | 179344383 |
| ADAMTS2 | 5 | 179344254 | 179344348 |
| ZNF492 | 19 | 22634069 | 22634174 |
| ST6GALNAC5 | 1 | 76868456 | 76868525 |
| ZNF542 | 19 | 56368502 | 56368591 |
| LONRF2 | 2 | 100321281 | 100321395 |
| ZNF132 | 19 | 58440415 | 58440523 |
| PDGFD | 11 | 104163921 | 104164058 |
| ZNF132 | 19 | 58440268 | 58440435 |
| CNRIP1 | 2 | 68319272 | 68319342 |
| ALK | 2 | 29921434 | 29921541 |

In various embodiments, a methylation biomarker can be or include one or more individual nucleotides (e.g., a single individual cysteine residue in the context of CpG) or a plurality of individual cysteine residues (e.g., of a plurality of CpGs) present within one or more methylation loci (e.g, one or more DMRs) provided herein. Thus, in certain embodiments a methylation biomarker is or includes methylation status of a plurality of individual methylation sites.

In various embodiments, a methylation biomarker is, includes, or is characterized by change in methylation status that is a change in the methylation of one or more methylation sites within one or more methylation loci (e.g., one or more DMRs). In various embodiments, a methylation biomarker is or includes a change in methylation status that is a change in the number of methylated sites within a one or more methylation loci (e.g., one or more DMRs). In various embodiments, a methylation biomarker is or includes a change in methylation status that is a change in the frequency of methylation sites within one or more methylation loci (e.g., one or more DMRs). In various embodiments, a methylation biomarker is or includes a change in methylation status that is a change in the pattern of methylation sites within one or more methylation loci (e.g., one or more DMRs).

In various embodiments, methylation status of one or more methylation loci (e.g., one or more DMRs) is expressed as a fraction or percentage of the one or more methylation loci (e.g., the one or more DMRs) present in a sample that are methylated, e.g., as a fraction of the number of individual DNA strands of DNA in a sample that are methylated at a one or more particular methylation loci (e.g., one or more particular DMRs). Those of skill in the art will appreciate that, in some instances, the fraction or percentage of methylation can be calculated from the ratio of methylated DMRs to unmethylated DMRs for one or more analyzed DMRs, e.g., within a sample.

In various embodiments, methylation status of one or more methylation loci (e.g., one or more DMRs) is compared to a reference methylation status value and/or to methylation status of the one or more methylation loci (e.g., one or more DMRs) in a reference sample. In certain instances, a reference is a non-contemporaneous sample from the same source, e.g., a prior sample from the same source, e.g., from the same subject. In certain instances, a reference for the methylation status of one or more methylation loci (e.g., one or more DMRs) is the methylation status of the one or more methylation loci (e.g., one or more DMRs) in a sample (e.g., a sample from a subject), or a plurality of samples, known to represent a particular state (e.g., a cancer state or a non-cancer state). Thus, a reference can be or include one or more predetermined thresholds, which thresholds can be quantitative (e.g., a methylation value) or qualitative. In certain instances, a reference for methylation status of a DMR is the methylation status of a nucleotide or plurality of nucleotides (e.g., a plurality of contiguous oligonucleotides) present in the same sample that does not include nucleotides of the DMR. Those of skill in the art will appreciate that a reference measurement is typically produced by measurement using a methodology identical to, similar to, or comparable to that by which the non-reference measurement was taken.

Without wishing to be bound by any particular scientific theory, FIG. 20 provides a schematic of one possible mechanism by which hypermethylation or hypomethylation of a regulatory sequence of gene can impact expression. As shown in FIG. 20, hypomethylation can result in increased expression and/or hypermethylation can result in suppression of expression. In various instances, increased methylation of express-regulatory regions, such as promoter regions and enhancer regions, as compared to a reference can reduce or silence expression of an operably linked gene, e.g., of an operably linked gene that typically acts to suppress cancer. In various embodiments, decreased methylation of expression-regulatory regions, such as promoter regions and enhancer regions, as compared to a reference can increase expression of an operably linked gene, e.g., of an operably linked gene having an activity that contributes to oncogenesis. Without wishing to be bound by any particular scientific theory, DNA methylation may provide a more chemically and biologically stable indicator of cancer status than RNA expression or protein expression per se.

Methylation is typically thought to be highly tissue-specific, providing a dimension of information not necessarily present in DNA sequence analysis.

Methylation events that substantially contribute to oncogenesis can occur, e.g., in expression-regulatory regions of DNA (e.g., at a promoter region, enhancer region, transcription factor binding site, CTCF-binding site, CpG island, or other sequence) operably linked with cancer-associated genes such as genes that typically act to suppress cancer. Accordingly, inactivation of genes that typically act to suppress cancer results in or contribute to oncogenesis. Moreover, hyper methylation is typically found at CpG islands.

Cancers

Methods and compositions of the present disclosure are useful for screening for cancer, particularly colorectal cancer. Colorectal cancers include, without limitation, colon cancer, rectal cancer, and combinations thereof. Colorectal cancers include metastatic colorectal cancers and non-metastatic colorectal cancers. Colorectal cancers include cancer located in the proximal part of the colon cancer and cancer located the distal part of the colon.

Colorectal cancers include colorectal cancers at any of the various possible stages known in the art, including, e.g., Stage I, Stage II, Stage III, and Stage IV colorectal cancers (e.g., stages 0, I, IIA, IIB, IIC, IIIA, IIIB, IIIC, IVA, IVB, and IVC). Colorectal cancers include all stages of the Tumor/Node/Metastasis (TNM) staging system. With respect to colorectal cancer, T can refer to whether the tumor grown into the wall of the colon or rectum, and if so by how many layers; N can refer to whether the tumor has spread to lymph nodes, and if so how many lymph nodes and where they are located; and M can refer to whether the cancer has spread to other parts of the body, and if so which parts and to what extent. Particular stages of T, N, and M are known in the art. T stages can include TX, T0, Tis, T1, T2, T3, T4a, and T4b; N stages can include NX, N0,N1a, N1b, N1c, N2a, and N2b; M stages can include M0, M1a, and M1b. Moreover, grades of colorectal cancer can include GX, G1, G2, G3, and G4. Various means of staging cancer, and colorectal cancer in particular, are well known in the art summarized, e.g., on the world wide web at cancer.net/cancer-types/colorectal-cancer/stages.

In certain instances, the present disclosure includes screening of early stage colorectal cancer. Early stage colorectal cancers can include, e.g., colorectal cancers localized within a subject, e.g., in that they have not yet spread to lymph nodes of the subject, e.g., lymph nodes near to the cancer (stage NO), and have not spread to distant sites (stage M0). Early stage cancers include colorectal cancers corresponding to, e.g., Stages 0 to II C.

Thus, colorectal cancer s of the present disclosure include, among other things, pre-malignant colorectal cancer and malignant colorectal cancer. Methods and compositions of the present disclosure are useful for screening of colorectal cancer in all of its forms and stages, including without limitation those named herein or otherwise known in the art, as well as all subsets thereof. Accordingly, the person of skill in art will appreciate that all references to colorectal cancer provided here include, without limitation, colorectal cancer in all of its forms and stages, including without limitation those named herein or otherwise known in the art, as well as all subsets thereof.

Subjects and Samples

A sample analyzed using methods and compositions provided herein can be any biological sample and/or any sample including nucleic acid. In various particular embodiments, a sample analyzed using methods and compositions provided herein can be a sample from a mammal. In various particular embodiments, a sample analyzed using methods and compositions provided herein can be a sample from a human subject. In various particular embodiments, a sample analyzed using methods and compositions provided herein can be a sample form a mouse, rat, pig, horse, chicken, or cow.

In various instances, a human subject is a subject diagnosed or seeking diagnosis as having, diagnosed as or seeking diagnosis as at risk of having, and/or diagnosed as or seeking diagnosis as at immediate risk of having, a cancer such as a colorectal cancer. In various instances, a human subject is a subjected identified as a subject in need of colorectal cancer screening. In certain instances, a human subject is a subjected identified as in need of colorectal cancer screening by a medical practitioner. In various instances, a human subject is identified as in need of colorectal cancer screening due to age, e.g., due to an age equal to or greater than 50 years, e.g., an age equal to or greater than 50, 55, 60, 65, 70, 75, 80, 85, or 90 years. In various instances, a human subject is a subject not diagnosed as having, not at risk of having, not at immediate risk of having, not diagnosed as having, and/or not seeking diagnosis for a cancer such as a colorectal cancer, or any combination thereof.

A sample from a subject, e.g., a human or other mammalian subject, can be a sample of, e.g., blood, blood component, cfDNA, ctDNA, stool, or colorectal tissue. In some particular embodiments, a sample is an excretion or bodily fluid of a subject (e.g., stool, blood, lymph, or urine of a subject) or a colorectal cancer tissue sample. A sample from a subject can be a cell or tissue sample, e.g., a cell or tissue sample that is of a cancer or includes cancer cells, e.g., of a tumor or of a metastatic tissue. In various embodiments, a sample from a subject, e.g., a human or other mammalian subject, can be obtained by biopsy (e.g., fine needle aspiration or tissue biopsy) or surgery.

In various particular embodiments, a sample is a sample of cell-free DNA (cfDNA). cfDNA is typically found in human biofluids (e.g., plasma, serum, or urine) in short, double-stranded fragments. The concentration of cfDNA is typically low, but can significantly increase under particular conditions, including without limitation pregnancy, autoimmune disorder, myocardial infraction, and cancer. Circulating tumor DNA (ctDNA) is the component of circulating DNA specifically derived from cancer cells. ctDNA can be present in human biofluids bound to leukocytes and erythrocytes or not bound to leukocytes and erythrocytes. Various tests for detection of tumor-derived cfDNA are based on detection of genetic or epigenetic modifications that are characteristic of cancer (e.g., of a relevant cancer). Genetic or epigenetic modifications characteristic of cancer can include, without limitation, oncogenic or cancer-associated mutations in tumor-suppressor genes, activated oncogenes, hypermethylation, and/or chromosomal disorders. Detection of genetic or epigenetic modifications characteristic of cancer can confirm that detected cfDNA is ctDNA.

cfDNA and ctDNA provide a real-time or nearly real time metric of the methylation status of a source tissue. cfDNA and ctDNA demonstrate a half-life in blood of about 2 hours, such that a sample taken at a given time provides a relatively timely reflection of the status of a source tissue.

Various methods of isolating nucleic acids from a sample (e.g., of isolating cfDNA from blood or plasma) are known in the art. Nucleic acids can be isolated, e.g., without limitation, standard DNA purification techniques, by direct gene capture (e.g., by clarification of a sample to remove assay-inhibiting agents and capturing a target nucleic acid, if present, from the clarified sample with a capture agent to produce a capture complex, and isolating the capture complex to recover the target nucleic acid).

Methods of Measuring Methylation Status

Methylation status can be measured by a variety of methods known in the art and/or by methods provided herein. Those of skill in the art will appreciate that a method for measuring methylation status can generally be applied to samples from any source and of any kind, and will further be aware of processing steps available to modify a sample into a form suitable for measurement by a given methodology. Methods of measuring methylation status include, without limitation, methods including methylation-status-specific polymerase chain reaction (PCR), methods including nucleic acid sequencing, methods including mass spectrometry, methods including methylation-specific nucleases, methods including mass-based separation, methods including target-specific capture, and methods including methylation-specific oligonucleotide primers. Certain particular assays for methylation utilize a bisulfite reagent (e.g., hydrogen sulfite ions).

Bisulfite reagents can include, among other things, bisulfite, disulfite, hydrogen sulfite, or combinations thereof, which reagents can be useful in distinguishing methylated and unmethylated nucleic acids. Bisulfite interacts differently with cytosine and 5-methylcytosine. In typical bisulfite-based methods, contacting of DNA with bisulfite deaminates unmethylated cytosine to uracil, while methylated cytosine remains unaffected; methylated cytosines, but not unmethylated cytosines, are selectively retained. Thus, in a bisulfite processed sample, uracil residues stand in place of, and thus provide an identifying signal for, unmethylated cytosine residues, while remaining (methylated) cytosine residues thus provide an identifying signal for methylated cytosine residues. Bisulfite processed samples can be analyzed, e.g., by PCR.

Various methylation assay procedures can be used in conjunction with bisulfite treatment to determine methylation status of a target sequence such as a DMR. Such assays can include, among others, Methylation-Specific Restriction Enzyme qPCR, sequencing of bisulfite-treated nucleic acid, PCR (e.g., with sequence-specific amplification), Methylation Specific Nuclease-assisted Minor-allele Enrichment PCR, and Methylation-Sensitive High Resolution Melting. In some embodiments, DMRs are amplified from a bisulfite-treated DNA sample and a DNA sequencing library is prepared for sequencing according to, e.g., an Illumina protocol or transpose-based Nextera XT protocol. In certain embodiments, high-throughput and/or next-generation sequencing techniques are used to achieve base-pair level resolution of DNA sequence, permitting analysis of methylation status.

In various embodiments, methylation status is detected by a method including PCR amplification with methylation-specific oligonucleotide primers (MSP methods), e.g., as applied to bisulfite-treated sample (see, e.g., Herman 1992 Proc. Natl. Acad. Sci. USA 93: 9821-9826, which is herein incorporated by reference with respect to methods of determining methylation status). Use of methylation-status-specific oligonucleotide primers for amplification of bisulfite-treated DNA allows differentiation between methylated and unmethylated nucleic acids. Oligonucleotide primer pairs for use in MSP methods include at least one oligonucleotide primer capable of hybridizing with sequence that includes a methylation cite, e.g., a CpG. An oligonucleotide primer that includes a T residue at a position complementary to a cytosine residue will selectively hybridize to templates in which the cytosine was unmethylated prior to bisulfite treatment, while an oligonucleotide primer that includes a G residue at a position complementary to a cytosine residue will selectively hybridize to templates in which the cytosine was methylated cytosine prior to bisulfite treatment. MSP results can be obtained with or without sequencing amplicons, e.g., using gel electrophoresis. MSP (methylation-specific PCR) allows for highly sensitive detection (detection level of 0.1% of the alleles, with full specificity) of locus-specific DNA methylation, using PCR amplification of bisulfite-converted DNA.

Another method that can be used to determine methylation status after bisulfite treatment of a sample is Methylation-Sensitive High Resolution Melting (MS-HRM) PCR (see, e.g., Hussmann 2018 Methods Mol Biol. 1708:551-571, which is herein incorporated by reference with respect to methods of determining methylation status). MS-HRM is an in-tube, PCR-based method to detect methylation levels at specific loci of interest based on hybridization melting. Bisulfite treatment of the DNA prior to performing MS-HRM ensures a different base composition between methylated and unmethylated DNA, which is used to separate the resulting amplicons by high resolution melting. A unique primer design facilitates a high sensitivity of the assays enabling detection of down to 0.1-1% methylated alleles in an unmethylated background. Oligonucleotide primers for MS-HRM assays are designed to be complementary to the methylated allele, and a specific annealing temperature enables these primers to anneal both to the methylated and the unmethylated alleles thereby increasing the sensitivity of the assays.

Another method that can be used to determine methylation status after bisulfite treatment of a sample is Quantitative Multiplex Methylation-Specific PCR (QM-MSP). QM-MSP uses methylation specific primers for sensitive quantification of DNA methylation (see, e.g., Fackler 2018 Methods Mol Biol. 1708:473-496, which is herein incorporated by reference with respect to methods of determining methylation status). QM-MSP is a two-step PCR approach, where in the first step, one pair of gene-specific primers (forward and reverse) amplifies the methylated and unmethylated copies of the same gene simultaneously and in multiplex, in one PCR reaction. This methylation-independent amplification step produces amplicons of up to $10^9$ copies per µL after 36 cycles of PCR. In the second step, the amplicons of the first reaction are quantified with a standard curve using real-time PCR and two independent fluorophores to detect methylated/unmethylated DNA of each gene in the same well (e.g., 6FAM and VIC). One methylated copy is detectable in 100,000 reference gene copies.

Another method that can be used to determine methylation status after bisulfite treatment of a sample is Methylation Specific Nuclease-assisted Minor-allele Enrichment (MS-NaME) (see, e.g., Liu 2017 Nucleic Acids Res. 45(6): e39, which is herein incorporated by reference with respect to methods of determining methylation status). Ms-NaME is based on selective hybridization of probes to target sequences in the presence of DNA nuclease specific to double-stranded (ds) DNA (DSN), such that hybridization results in regions of double-stranded DNA that are subsequently digested by the DSN. Thus, oligonucleotide probes targeting unmethylated sequences generate local double stranded regions resulting to digestion of unmethylated targets; oligonucleotide probes capable of hybridizing to methylated sequences generate local double-stranded regions that result in digestion of methylated targets, leaving methylated targets intact. Moreover, oligonucleotide probes can direct DSN activity to multiple targets in bisulfite-treated DNA, simultaneously. Subsequent amplification can enrich non-digested sequences. Ms-NaME can be used, either independently or in combination with other techniques provided herein.

Another method that can be used to determine methylation status after bisulfite treatment of a sample is Methylation-sensitive Single Nucleotide Primer Extension (Ms-SNuPE™) (see, e.g., Gonzalgo 2007 Nat Protoc. 2(8):1931-6, which is herein incorporated by reference with respect to methods of determining methylation status). In Ms-SNuPE, strand-specific PCR is performed to generate a DNA template for quantitative methylation analysis using Ms-SNuPE. SNuPE is then performed with oligonucleotide(s) designed to hybridize immediately upstream of the CpG site(s) being interrogated. Reaction products can be electrophoresed on polyacrylamide gels for visualization and quantitation by phosphor-image analysis. Amplicons can also carry a directly or indirectly detectable labels such as a fluorescent label, radionuclide, or a detachable molecule fragment or other entity having a mass that can be distinguished by mass spectrometry. Detection may be carried out and/or visualized by means of, e.g., matrix assisted laser desorption/ionization mass spectrometry (MALDI) or using electron spray mass spectrometry (ESI).

Certain methods that can be used to determine methylation status after bisulfite treatment of a sample utilize a first oligonucleotide primer, a second oligonucleotide primer, and an oligonucleotide probe in an amplification-based method. For instance, the oligonucleotide primers and probe can be used in a method of real-time polymerase chain reaction (PCR) or droplet digital PCR (ddPCR). In various instances, the first oligonucleotide primer, the second oligonucleotide primer, and/or the oligonucleotide probe selectively hybridize methylated DNA and/or unmethylated DNA, such that amplification or probe signal indicate methylation status of a sample.

Other bisulfite-based methods for detecting methylation status (e.g., the presence of level of 5-methylcytosine) are disclosed, e.g., in Frommer (1992 Proc Natl Acad Sci USA. 1; 89(5):1827-31, which is herein incorporated by reference with respect to methods of determining methylation status).

Certain methods that can be used to determine methylation status do not include bisulfite treatment of a sample. For instance, changes in methylation status can be detected by a PCR-based process in which DNA is digested with one or more methylation-sensitive restriction enzymes (MSREs) prior to PCR amplification (e.g., by MSRE-qPCR). Typically, MSREs have recognition sites that include at least one CpG motif, such that activity of the MSRE is blocked from cleaving a possible recognition site if the site includes 5-methylcytosine. (see, e.g., Beikircher 2018 Methods Mol Biol. 1708:407-424, which is herein incorporated by reference with respect to methods of determining methylation status). Thus, MSREs selectively digest nucleic acids based upon methylation status of the recognition site of the MSRE; they can digest DNA at MSRE recognition sites that are unmethylated, but not digest DNA in MSRE recognition sites that are methylated. In certain embodiments, an aliquot of sample can be digested with MSREs, generating a processed sample in which unmethylated DNA has been cleaved by the MSREs, such that, the proportion of uncleaved and/or amplifiable DNA with at least one methylated site within MSRE recognition sites (e.g., at least one methylated site within each MSRE recognition site of the DNA molecule) is increased relative to uncleaved and/or amplifiable DNA that did not include at least one methylated site within MSRE recognition sites (e.g., did not include at least one methylated site within each MSRE recognition site of the DNA molecule). Uncleaved sequences of a restriction-enzyme-digested sample can then be preamplified, e.g, in PCR, and quantified e.g. by qPCR, real-time PCR, or digital PCR. Oligonucleotide primers for MSRE-qPCR amplify regions that include one or more MSRE cleavage sites, and/or a plurality of MSRE cleavage sites. Amplicons including a plurality of MSRE cleavage sites are typically more likely to yield robust results. The number of cleavage sites within a DMR amplicon, and in some instances the resulting robustness of methylation status determination for the DMR, can be increased by design of DMRs that include a plurality of MSRE recognition sites (as opposed to a single recognition site) in a DMR amplicon. In various instances, a plurality of MSREs can be applied to the same sample, including, e.g., two or more of AciI, Hin6I, HpyCH4IV, and HpaII (e.g., including AciI, Hin6I, and HpyCH4IV). A plurality of MSREs (e.g., the combination of AciI, Hin6I, HpyCH4IV, and HpaII, or the combination of AciI, Hin6I, and HpyCH4IV) can provide improved frequency of MSRE recognition sites within DMR amplicons.

MSRE-qPCR can also include a pre-amplification step following sample digestion by MSREs but before qPCR in order to improve the amount of available sample, given the low prevalence of cfDNA in blood.

In certain MSRE-qPCR embodiments, the amount of total DNA is measured in an aliquot of sample in native (e.g., undigested) form using, e.g., real-time PCR or digital PCR.

Various amplification technologies can be used alone or in conjunction with other techniques described herein for detection of methylation status. Those of skill in the art, having reviewed the present specification, will understand how to combine various amplification technologies known in the art and/or described herein together with various other technologies for methylation status determination known in the art and/or provided herein. Amplification technologies include, without limitation, PCR, e.g., quantitative PCR (qPCR), real-time PCR, and/or digital PCR. Those of skill in the art will appreciate that polymerase amplification can multiplex amplification of multiple targets in a single reaction. PCR amplicons are typically 100 to 2000 base pairs in length. In various instances, an amplification technology is sufficient to determine methylations status.

Digital PCR (dPCR) based methods involve dividing and distributing a sample across wells of a plate with 96-, 384-, or more wells, or in individual emulsion droplets (ddPCR) e.g., using a microfluidic device, such that some wells include one or more copies of template and others include no copies of template. Thus, the average number of template molecules per well is less than one prior to amplification. The number of wells in which amplification of template occurs provides a measure of template concentration. If the sample has been contacted with MSRE, the number of wells in which amplification of template occurs provides a measure of the concentration of methylated template.

In various embodiments a fluorescence-based real-time PCR assay, such as MethyLight™, can be used to measure methylation status (see, e.g., Campan 2018 Methods Mol Biol. 1708:497-513, which is herein incorporated by reference with respect to methods of determining methylation status) MethyLight is a quantitative, fluorescence-based, real-time PCR method to sensitively detect and quantify DNA methylation of candidate regions of the genome. MethyLight is uniquely suited for detecting low-frequency methylated DNA regions against a high background of unmethylated DNA, as it combines methylation-specific priming with methylation-specific fluorescent probing. Additionally, MethyLight can be combined with Digital PCR, for the highly sensitive detection of individual methylated molecules, with use in disease detection and screening.

Real-time PCR-based methods for use in determining methylation status typically include a step of generating a standard curve for unmethylated DNA based on analysis of external standards. A standard curve can be constructed from at least two points and can permit comparison of a real-time Ct value for digested DNA and/or a real-time Ct value for undigested DNA to known quantitative standards. In particular instances, sample Ct values can be determined for MSRE-digested and/or undigested samples or sample aliquots, and the genomic equivalents of DNA can be calculated from the standard curve. Ct values of MSRE-digested and undigested DNA can be evaluated to identify amplicons digested (e.g., efficiently digested; e.g., yielding a Ct value of 45). Amplicons not amplified under either digested or undigested conditions can also be identified. Corrected Ct values for amplicons of interest can then be directly compared across conditions to establish relative differences in methylation status between conditions. Alternatively or additionally, delta-difference between the Ct values of digested and undigested DNA can be used to establish relative differences in methylation status between conditions.

Methods of measuring methylation status can include, without limitation, massively parallel sequencing (e.g., next-generation sequencing) to determine methylation state, e.g., sequencing by—synthesis, real-time (e.g., single-molecule) sequencing, bead emulsion sequencing, nanopore sequencing, or other sequencing techniques known in the art. In some embodiments, a method of measuring methylation status can include whole-genome sequencing, e.g., with base-pair resolution.

In certain particular embodiments, MSRE-qPCR, among other techniques, can be used to determine the methylation status of a colorectal cancer methylation biomarker that is or includes a single methylation locus. In certain particular embodiments, MSRE-qPCR, among other techniques, can be used to determine the methylation status of a colorectal cancer methylation biomarker that is or includes two or more methylation loci. In certain particular embodiments, MSRE-qPCR, among other techniques, can be used to determine the methylation status of a colorectal cancer methylation biomarker that is or includes a single differentially methylated region (DMR). In certain particular embodiments, MSRE-qPCR, among other techniques, can be used to determine the methylation status of a colorectal cancer methylation biomarker that is or includes two or more DMRs. In certain particular embodiments, MSRE-qPCR, among other techniques, can be used to determine the methylation status of a colorectal cancer methylation biomarker that is or includes a single methylation site. In certain particular embodiments, MSRE-qPCR, among other techniques, can be used to determine the methylation status of a colorectal cancer methylation biomarker that is or includes two or more methylation sites. In various embodiments, a colorectal cancer methylation biomarker can be any colorectal cancer methylation biomarker provided herein. The present disclosure includes, among other things, oligonucleotide primer pairs for amplification of DMRs, e.g., for amplification of DMRs identified in Table 7.

In certain particular embodiments, a cfDNA sample is derived from subject plasma and contacted with MSREs that are or include one or more of AciI, Hin6I, HpyCH4IV, and HpaII (e.g., AciI, Hin6I, and HpyCH4IV). The digested sample can be preamplified with oligonucleotide primer pairs of one or more DMRs, e.g., with one or more oligonucleotide primer pairs provided in Table 13. Digested DNA, e.g., preamplified digested DNA, can be quantified with qPCR with oligonucleotide primer pairs of one or more DMRs, e.g., with one or more oligonucleotide primer pairs provided in Table 13. qPCR ct values can then be determined and used to determine methylation status of each DMR amplicon.

It will be appreciated by those of skill in the art that oligonucleotide primer pairs provided in Table 13 can be used in accordance with any combination of colorectal cancer methylation biomarkers identified herein. The skilled artisan will be aware that the oligonucleotide primer pairs of Table 2 may be individual included or not included in a given analysis in order to analyze a particular desire combination of DRMs.

The person of skill in the art will further appreciate that while other oligonucleotide primer pairs may be used, selection and pairing of oligonucleotide primers to produce useful DMR amplicons is non-trivial and represents a substantial contribution.

Those of skill in the art will further appreciate that methods, reagents, and protocols for qPCR are well-known in the art. Unlike traditional PCR, qPCR is able to detect the production of amplicons over time in amplification (e.g., at the end of each amplification cycle), often by use of an amplification-responsive fluorescence system, e.g., in combination with a thermocycler with fluorescence-detection capability. Two common types of fluorescent reporters used in qPCR include (i) double-stranded DNA binding dyes that fluoresce substantially more brightly when bound than when unbound; and (ii) labeled oligonucleotides (e.g., labeled oligonucleotide primers or labeled oligonucleotide probes).

Those of skill in the art will appreciate that in embodiments in which a plurality of methylation loci (e.g., a plurality of DMRs) are analyzed for methylation status in a method of screening for colorectal cancer provided herein, methylation status of each methylation locus can be measured or represented in any of a variety of forms, and the methylation statuses of a plurality of methylation loci (preferably each measured and/or represented in a same, similar, or comparable manner) be together or cumulatively analyzed or represented in any of a variety of forms. In various embodiments, methylation status of each methylation locus can be measured as a ct value. In various embodiments, methylation status of each methylation locus can be represented as the difference in ct value between a measured sample and a reference. In various embodiments, methylation status of each methylation locus can be represented as a qualitative comparison to a reference, e.g., by identification of each methylation locus as hypermethylated or not hypermethyated.

In some embodiments in which a single methylation locus is analyzed, hypermethylation of the single methylation locus constitutes a diagnosis that a subject is suffering from or possibly suffering from colorectal cancer, while absence of hypermethylation of the single methylation locus constitutes a diagnosis that the subject is likely not suffering from colorectal cancer. In some embodiments, hypermethylation of a single methylation locus (e.g., a single DMR) of a plurality of analyzed methylation loci constitutes a diagnosis that a subject is suffering from or possibly suffering from colorectal cancer, while the absence of hypermethylation at any methylation locus of a plurality of analyzed methylation loci constitutes a diagnosis that a subject is likely not suffering from colorectal cancer. In some embodiments, hypermethylation of a determined percentage (e.g., a predetermined percentage) of methylation loci (e.g., at least 10% (e.g., at least 10%, at least 20%, at least 30%, at least 40%, at least 50%, at least 60%, at least 70%, at least 80%, at least 90%, or 100%)) of a plurality of analyzed methylation loci constitutes a diagnosis that a subject is suffering from or possibly suffering from colorectal cancer, while the absence of hypermethylation of a determined percentage (e.g., a predetermined percentage) of methylation loci (e.g., at least 10% (e.g., at least 10%, at least 20%, at least 30%, at least 40%, at least 50%, at least 60%, at least 70%, at least 80%, at least 90%, or 100%)) of a plurality of analyzed methylation loci constitutes a diagnosis that a subject is not likely suffering from colorectal cancer. In some embodiments, hypermethylation of a determined number (e.g., a predetermined number) of methylation loci (e.g., at least 1, 2, 3, 4, 5, 6, 7, 8, 9, 10, 11, 12, 13, 14, 15, 16, 17, 18, 19, 20, 21, 22, 23, 24, 25, 26, 27, or 28 DMRs) of a plurality of analyzed methylation loci (e.g., 2, 3, 4, 5, 6, 7, 8, 9, 10, 11, 12, 13, 14, 15, 16, 17, 18, 19, 20, 21, 22, 23, 24, 25, 26, 27, or 28 DMRs) constitutes a diagnosis that a subject is suffering from or possibly suffering from colorectal cancer, while the absence of hypermethylation of a determined number (e.g., a predetermined number) of methylation loci (e.g., at least 1, 2, 3, 4, 5, 6, 7, 8, 9, 10, 11, 12, 13, 14, 15, 16, 17, 18, 19, 20, 21, 22, 23, 24, 25, 26, 27, or 28 DMRs) of a plurality of analyzed methylation loci (e.g., 2, 3, 4, 5, 6, 7, 8, 9, 10, 11, 12, 13, 14, 15, 16, 17, 18, 19, 20, 21, 22, 23, 24, 25, 26, 27, or 28 DMRs) constitutes a diagnosis that a subject is not likely suffering from colorectal cancer.

In some embodiments, methylation status of a plurality of methylation loci (e.g., a plurality of DMRs) is measured qualitatively or quantitatively and the measurement for each of the plurality of methylation loci are combined to provide a diagnosis. In some embodiments, the qualitative of quantitatively measured methylation status of each of a plurality of methylation loci is individually weighted, and weighted values are combined to provide a single value that can be comparative to a reference in order to provide a diagnosis. To provide but one example of such an approach, support vector machine (SVM) algorithm can be used to analyze the methylation statuses of a plurality of methylation loci of the present disclosure to produce a diagnosis. At least one objective of the support vector machine algorithm is to identify a hyperplane in an N-dimensional space (N the number of features) that distinctly classifies the data points with the objective to find a plane that has the maximum margin, i.e the maximum distance between data points of both classes. As discussed in the present Examples, an SVM model is built on marker values (e.g., ct values) derived from a training sample set (e.g., the first subject group and/or the second subject group) that are transformed to support vector values upon which a prediction is made. In application of the SVM model to new samples, samples will be mapped onto vectoral space the model and categorized as having a probability of belonging to the first condition or the second condition, e.g., based on each new sample's location relative to the gap between the two conditions. Those of skill in the art will appreciate that, once relevant compositions and methods have been identified, vector values can be used in conjunction with an SVM algorithm defined by predict () function of R-package (see cran.r-project.org, the SVM of which is hereby incorporated by reference) to easily generate a prediction on a new sample. Accordingly, with compositions and methods for colorectal cancer diagnosis disclosed herein in hand (and only then), generation of a predictive model utilizing algorithm input information in combination to predict () function of R-package (see cran.r-project.org, the SVM of which is hereby incorporated by reference) to provide colorectal cancer diagnosis would be straightforward. By way of example, one non-limiting example of SVM vectors for use in diagnosis of colorectal cancer by analysis of methylation status of a plurality of DMRs provided herein is provided in Table 17. Those of skill in the art will appreciate that, with the present disclosure in hand, generation of SVM vectors can be accomplished according to methods provided herein and otherwise known in the art.

TABLE 13

Colorectal cancer DMR oligonucleotide primer pairs, e.g., for MSRE-qPCR

| gene name | Fp_Seq | Rp_Seq | Fp SEQ ID | Rp SEQ ID |
|---|---|---|---|---|
| ALK | CCTCCTCACCCATCATCAGCGCCC | GGTACCTCCCGCCGCCTCTGTTC | 45 | 46 |
| CNRIP1 | GCGTGCTGGGTTTAATCTTCACCTCAA | ACGGCCCGGTCTTTTACAAGGTGG | 47 | 48 |
| LONRF2 | AGGAAGCAAAGTGACCCCTAAGCCT | GGTCCGCCTCCCCTACACCT | 49 | 50 |
| LONRF2 | CTCTCAGTCCCGCCGGCTTAGGTA | GCAAGAGACGCGGACCTGGAGC | 51 | 52 |
| ADAMTS2 | CCACTGCGAAGGGAAGGGGCA | CCCTGTTAACGCCCCTTCCCGGTT | 53 | 54 |
| ADAMTS2 | GCGACCCCAGAAGCCAGCCT | AACGGCTGGGGAGTGGCGGA | 55 | 56 |
| FGF14 | CAACGGAAACTTCCCGCGCTAC | CTCGCCGGGGCTTCGCTAC | 57 | 58 |
| DMRT1 | CAAAGCGTCTGGGGCGCTAGT | ACTTCTTGCTCCCGGCACCCAGGTC | 59 | 60 |
| ST6GALNAC5 | CGCTCAGCCGCTCTCCTCTTCTCT | AGCGCTAAACACACTGCCAGACCA | 61 | 62 |
| MCIDAS | GGGTTCGGAGCGTGCAAAAGGTGA | GAACAGTTCAGTGCATCCCCGCCC | 63 | 64 |
| MCIDAS | GCGCCCCACTTACATCCAGCACC | ACGTGACATTGACCCAGAAACAGGAGGA | 65 | 66 |
| PDGFD | AACGTCTATCACCCAGGGAAAGCT | TCCCGGAGTTGGCGAAAGTTGCAA | 67 | 68 |
| PDGFD | GGTGCATTTGGGATCAGCGACTAGAGAC | GATTAGCACAGCGACCCGGGCCAG | 69 | 70 |
| GSG1L | CCGAAAGAAATCCGAGCCAGGGTGA | GGTTTTGTTGCCCCACGTCC | 71 | 72 |
| ZNF492 | CGAGAGAGGGGAAGGGGCTGGTTG | CGAACTTGGGGCGCAGATTGTGG | 73 | 74 |
| ZNF568 | GCCCAAGCCTCACCCTCACACAG | CGAACCATCCCTCCGCGCCA | 75 | 76 |
| ZNF568 | GGTCGCCTTCACCCAGCATCTCAG | CAGCGTCACCTGCCGGAAACACC | 77 | 78 |
| ZNF542 | CCAGAGGCCCAGGGATCCGTTCAG | ACGCGAGCATTCTTGTAAGGCACCC | 79 | 80 |
| ZNF542 | GGGAGGAGTGGGCGGCTGAATGG | GCACCCGCCACCTCCAAACTCAG | 81 | 82 |

TABLE 13-continued

Colorectal cancer DMR oligonucleotide primer pairs, e.g., for MSRE-qPCR

| gene name | Fp_Seq | Rp_Seq | Fp SEQ ID | Rp SEQ ID |
|---|---|---|---|---|
| ZNF471 | CCCCACGCGTACTCACACCGAAG | GCGGGTAAGAGCAGGAGTGTG | 83 | 84 |
| ZNF471 | GTCGCGCGTTTCCCTCCCAG | GCGGGTAAGAGCAGGAGTGTG | 85 | 86 |
| ZNF471 | CTGCTCTTACCCGCCGGAACCCTG | GAGGGACCTTAGAGCAGAGCGGGC | 87 | 88 |
| ZNF132 | CTACTGCTAGGTCGTTGCCAAGG | TGATTGGCCAGCGTCTTACACTCCG | 89 | 90 |
| ZNF132 | GTGTAAGACGCTGGCCAATCACA | ACAACGCGGTCCCTTCAGAAGCAG | 91 | 92 |
| JAM2 | CCGCGTGGTCTGGGCTCTGTAG | GAATTCCCTCCACCTCCGCCCCAC | 93 | 94 |
| ZNF492 | CAACGTTAAAGGCAAACACCTTCTGC | GGCCGAATGAGGACAGAGTGACAG | 95 | 96 |
| CNRIP1 | GCCGGTGAGCAGCTTGATGGT | ACGGCCCGGTCTTTTACAAGG | 97 | 98 |
| ADAMTS2 | CGGGAAGGGGCGTTAACAGGGC | TCTTGGCAGGCAAGGTCTCCGGAG | 99 | 100 |

Applications

Methods and compositions of the present disclosure can be used in any of a variety of applications. For example, methods and compositions of the present disclosure can be used to screen, or aid in screening for, colorectal cancer. In various instances, screening using methods and compositions of the present disclosure can detect any stage of colorectal cancer, including without limitation early-stage colorectal cancer. In some embodiments, colorectal cancer screening using methods and compositions of the present disclosure is applied to individuals 50 years of age or older, e.g., 50, 55, 60, 65, 70, 75, 80, 85, or 90 years or older. In some embodiments, colorectal cancer screening using methods and compositions of the present disclosure is applied to individuals 20 years of age or older, e.g., 20, 25, 30, 35, 40, 45, 50, 55, 60, 65, 70, 75, 80, 85, or 90 years or older. In some embodiments, colorectal cancer screening using methods and compositions of the present disclosure is applied to individuals 20 to 50 years of age, e.g., 20 to 30 years of age, 20 to 40 years of age, 20 to 50 years of age, 30 to 40 years of age, 30 to 50 years of age, or 40 to 50 years of age. In various embodiments, colorectal cancer screening using methods and compositions of the present disclosure is applied to individuals experiencing abdominal pain or discomfort, e.g., experiencing undiagnosed or incompletely diagnosed abdominal pain or discomfort. In various embodiments, colorectal cancer screening using methods and compositions of the present disclosure is applied to individuals experiencing no symptoms likely to be associated with colorectal cancer. Thus, in certain embodiments, colorectal cancer screening using methods and compositions of the present disclosure is fully or partially preventative or prophylactic, at least with respect to later or non-early stages of colorectal cancer.

In various embodiments, colorectal cancer screening using methods and compositions of the present disclosure can be applied to an asymptomatic human subject. As used herein, a subject can be referred to as "asymptomatic" if the subject does not report, and/or demonstrate by non-invasively observable indicia (e.g., without one, several, or all of device-based probing, tissue sample analysis, bodily fluid analysis, surgery, or colorectal cancer screening), sufficient characteristics of colorectal cancer to support a medically reasonable suspicion that the subject is likely suffering from colorectal cancer, and/or from cancer. Detection of early stage colorectal cancer is particularly likely in asymptomatic individuals screened in accordance with methods and compositions of the present disclosure.

In various embodiments, colorectal cancer screening using methods and compositions of the present disclosure can be applied to a symptomatic human subject. As used herein, a subject can be referred to as "symptomatic" if the subject report, and/or demonstrates by non-invasively observable indicia (e.g., without one, several, or all of device-based probing, tissue sample analysis, bodily fluid analysis, surgery, or colorectal cancer screening), sufficient characteristics of colorectal cancer to support a medically reasonable suspicion that the subject is likely suffering from colorectal cancer, and/or from cancer. Symptoms of colorectal cancer can include, without limitation, change in bowel habits (diarrhea, constipation, or narrowing of the stool) that are persistent (e.g., lasting more than 3 days), feeling of a need to have a bowel movement which feeling is not relieved upon bowel movement, rectal bleeding (e.g., with bright red blood), blood in stool (which can cause stool to appear dark), abdominal cramping, abdominal pain, weakness, fatigue, unintended weight loss, anemia, and combinations thereof. Those of skill in the art will appreciate that individual symptoms that would not alone indicate or raise a suspicion of colorectal cancer may do so when presented in combination, e.g., a combination of abdominal cramping and blood in stool, to provide but one non-limiting example.

Those of skill in the art will appreciate that regular, preventative, and/or prophylactic screening for colorectal cancer improves diagnosis of colorectal cancer, including and/or particularly early stage cancer. As noted above, early stage cancers include, according to at least one system of cancer staging, Stages 0 to II C of colorectal cancer. Thus, the present disclosure provides, among other things, methods and compositions particularly useful for the diagnosis and treatment of early stage colorectal cancer. Generally, and particularly in embodiments in which colorectal cancer screening in accordance with the present disclosure is carried out annually, and/or in which a subject is asymptomatic at time of screening, methods and compositions of the present invention are especially likely to detect early stage colorectal cancer.

In various embodiments colorectal cancer screening in accordance with the present disclosure is performed once for a given subject or multiple times for a given subject. In various embodiments, colorectal cancer screening in accordance with the present disclosure is performed on a regular basis, e.g., every six months, annually, every two years, every three years, every four years, every five years, or every ten years.

In various embodiments, screening for colorectal cancer using methods and compositions disclosed herein will be provide a diagnosis of colorectal cancer. In other instances, screening for colorectal cancer using methods and compositions disclosed herein will be indicative of colorectal cancer diagnosis but not definitive for colorectal cancer diagnosis. In various instances in which methods and compositions of the present disclosure are used to screen for colorectal cancer, screening using methods and compositions of the present disclosure can be followed by a further diagnosis-confirmatory assay, which further assay can confirm, support, undermine, or reject a diagnosis resulting from prior screening, e.g., screening in accordance with the present disclosure. As used herein, a diagnosis-confirmatory assay can be a colorectal cancer assay that provides a diagnosis recognized as definitive by medical practitioners, e.g., a colonoscopy-based diagnosed, or a colorectal cancer assay that substantially increases or decreases the likelihood that a prior diagnosis was correct, e.g., a diagnosis resulting from screening in accordance with the present disclosure. Diagnosis-confirmatory assays could include existing screening technologies, which are generally in need of improvement with respect to one or more of sensitivity, specificity, and non-invasiveness, particularly in the detection of early stage colorectal cancers.

In some instances, a diagnosis-confirmatory assay is a test that is or includes a visual or structural inspection of subject tissues, e.g., by colonoscopy. In some embodiments, colonoscopy includes or is followed by histological analysis. Visual and/or structural assays for colorectal cancer can include inspection of the structure of the colon and/or rectum for any abnormal tissues and/or structures. Visual and/or structural inspection can be conducted, for example, by use of a scope via the rectum or by CT-scan. In some instances, a diagnosis-confirmatory assay is a colonoscopy, e.g., including or followed by histological analysis. According to some reports, colonoscopy is currently the predominant and/or most relied upon diagnosis-confirmatory assay.

Another visual and/or structural diagnosis confirmatory assay based on computer tomography (CT) is CT colonography, sometimes referred to as virtual colonoscopy. A CT scan utilizes numerous x-ray images of the colon and/or rectum to produce dimensional representations of the colon. Although useful as a diagnosis-confirmatory assay, some reports suggest that CT colonography is not sufficient for replacement of colonoscopy, at least in part because a medical practitioner has not physically accessed the subject's colon to obtain tissue for histological analysis.

Another diagnosis-confirmatory assay can be a sigmoidoscopy. In sigmoidoscopy, a sigmoidoscope is used via the rectum to image portions of the colon and/or rectum. According to some reports, sigmoidoscopy is not widely used.

In some instances, a diagnosis-confirmatory assay is a stool-based assay. Typically, stool-based assays, when used in place of visual or structural inspection, are recommended to be utilized at a greater frequency than would be required if using visual or structural inspection. In some instances, a diagnosis-confirmatory assay is a guiac-based fecal occult blood test or a fecal immunochemical test (gFOBTs/FITs) (see, e.g., Navarro 2017 World J Gastroenterol. 23(20): 3632-3642, which is herein incorporated by reference with respect to colorectal cancer assays). FOBTs and FITs are sometimes used for diagnosis of colorectal cancer (see, e.g., Nakamura 2010 J Diabetes Investig. October 19; 1(5):208-11, which is herein incorporated by reference with respect to colorectal cancer assays). FIT is based on detection of occult blood in stool, the presence of which is often indicative of colorectal cancer but is often not in sufficient volume to permit identification by the unaided eye. For example, in a typical FIT, the test utilizes hemoglobin-specific reagent to test for occult blood in a stool sample. In various instances, FIT kits are suitable for use by individuals in their own homes. When used in the absence of other diagnosis-confirmatory assays, FIT may be recommended for use on an annual basis. FIT is generally not relied upon to provide sufficient diagnostic information for conclusive diagnosis of colorectal cancer.

Diagnosis-confirmatory assays also include gFOBT, which is designed to detect occult blood in stool by chemical reaction. Like FIT, when used in the absence of other diagnosis-confirmatory assays, gFOBT may be recommended for use on an annual basis. gFOBT is generally not relied upon to provide sufficient diagnostic information for conclusive diagnosis of colorectal cancer.

Diagnosis-confirmatory assays can also include stool DNA testing. Stool DNA testing for colorectal cancer can be designed to identify DNA sequences characteristic of cancer in stool samples. When used in the absence of other diagnosis-confirmatory assays, stool DNA testing may be recommended for use every three years. Stool DNA testing is generally not relied upon to provide sufficient diagnostic information for conclusive diagnosis of colorectal cancer.

One particular screening technology is a stool-based screening test (Cologuard® (Exact Sciences Corporation, Madison, Wis., United States), which combines an FIT assay with analysis of DNA for abnormal modifications, such as mutation and methylation. The Cologuard® test demonstrates improved sensitivity as compared to FIT assay alone, but can be clinically impracticable or ineffective due to low compliance rates, which low compliance rates are at least in part due to subject dislike of using stool-based assays (see, e.g., doi: 10.1056/NEJMc1405215 (e.g., 2014 N Engl J Med. 371(2):184-188)). The Cologuard® test appears to leave almost half of the eligible population out of the screening programs (see, e.g., van der Vlugt 2017 Br J Cancer. 116(1):44-49). Use of screening as provided herein, e.g., by a blood-based analysis, would increase the number of individuals electing to screen for colorectal cancer (see, e.g., Adler 2014 BMC Gastroenterol. 14:183; Liles 2017 Cancer Treatment and Research Communications 10: 27-31). To present knowledge, only one existing screening technology for colorectal cancer, Epiprocolon, is FDA-approved and CE-IVD marked and is blood-based. Epiprocolon is based on hypermethylation of SEPT9 gene. The Epiprocolon test suffers from low accuracy for colorectal cancer detection with sensitivity of 68% and advanced adenoma sensitivity of only 22% (see, e.g., Potter 2014 Clin Chem. 60(9):1183-91). There is need in the art for, among other things, a non-invasive colorectal cancer screen that will likely achieve high subject adherence with high and/or improved specificity and/or sensitivity.

In various embodiments, screening in accordance with methods and compositions of the present disclosure reduces colorectal cancer mortality, e.g., by early colorectal cancer diagnosis. Data supports that colorectal cancer screening reduces colorectal cancer mortality, which effect persisted for over 30 years (see, e.g., Shaukat 2013 N Engl J Med. 369(12):1106-14). Moreover, colorectal cancer is particularly difficult to treat at least in part because colorectal cancer, absent timely screening, may not be detected until cancer is past early stages. For at least this reason, treatment of colorectal cancer is often unsuccessful. To maximize population-wide improvement of colorectal cancer outcomes, utilization of screening in accordance with the present disclosure can be paired with, e.g., recruitment of eligible subjects to ensure widespread screening.

In various embodiments, screening of colorectal cancer including one or more methods and/or composition s disclosed herein is followed by treatment of colorectal cancer, e.g., treatment of early stage colorectal cancer. In various embodiments, treatment of colorectal cancer, e.g., early stage colorectal cancer, includes administration of a therapeutic regimen including one or more of surgery, radiation therapy, and chemotherapy. In various embodiments, treatment of colorectal cancer, e.g., early stage colorectal cancer, includes administration of a therapeutic regimen including one or more of treatments provided herein for treatment of stage 0 colorectal cancer, stage I colorectal cancer, and/or stage II colorectal cancer.

In various embodiments, treatment of colorectal cancer includes treatment of early stage colorectal cancer, e.g., stage 0 colorectal cancer or stage I colorectal cancer, by one or more of surgical removal of cancerous tissue e.g., by local excision (e.g., by colonoscope), partial colectomy, or complete colectomy.

In various embodiments, treatment of colorectal cancer includes treatment of early stage colorectal cancer, e.g., stage II colorectal cancer, by one or more of surgical removal of cancerous tissue (e.g., by local excision (e.g., by colonoscope), partial colectomy, or complete colectomy), surgery to remove lymph nodes near to identified colorectal cancer tissue, and chemotherapy (e.g., administration of one or more of 5-FU and leucovorin, oxaliplatin, or capecitabine).

In various embodiments, treatment of colorectal cancer includes treatment of stage III colorectal cancer, by one or more of surgical removal of cancerous tissue (e.g., by local excision (e.g., by colonoscopy-based excision), partial colectomy, or complete colectomy), surgical removal of lymph nodes near to identified colorectal cancer tissue, chemotherapy (e.g., administration of one or more of 5-FU, leucovorin, oxaliplatin, capecitabine, e.g., in a combination of (i) 5-FU and leucovorin, (ii) 5-FU, leucovorin, and oxaliplatin (e.g., FOLFOX), or (iii) capecitabine and oxaliplatin (e.g., CAPEOX)), and radiation therapy.

In various embodiments, treatment of colorectal cancer includes treatment of stage IV colorectal cancer, by one or more of surgical removal of cancerous tissue (e.g., by local excision (e.g., by colonoscope), partial colectomy, or complete colectomy), surgical removal of lymph nodes near to identified colorectal cancer tissue, surgical removal of metastases, chemotherapy (e.g., administration of one or more of 5-FU, leucovorin, oxaliplatin, capecitabine, irinotecan, VEGF-targeted therapeutic agent (e.g., bevacizumab, ziv-aflibercept, or ramucirumab), EGFR-targeted therapeutic agent (e.g., cetuximab or panitumumab), Regorafenib, trifluridine, and tipiracil, e.g., in a combination of or including (i) 5-FU and leucovorin, (ii) 5-FU, leucovorin, and oxaliplatin (e.g., FOLFOX), (iii) capecitabine and oxaliplatin (e.g., CAPEOX), (iv) leucovorin, 5-FU, oxaliplatin, and irinotecan (FOLFOXIRI), and (v) trifluridine and tipiracil (Lonsurf)), radiation therapy, hepatic artery infusion (e.g., if cancer has metastasized to liver), ablation of tumors, embolization of tumors, colon stent, colorectomy, colostomy (e.g., diverting colostomy), and immunotherapy (e.g., pembrolizumab).

Those of skill in the art that treatments of colorectal cancer provided herein can be utilized, e.g., as determined by a medical practitioner, alone or in any combination, in any order, regimen, and/or therapeutic program. Those of skill in the art will further appreciate that advanced treatment options may be appropriate for earlier stage cancers in subjects previously having suffered a cancer or colorectal cancer, e.g., subjects diagnosed as having a recurrent colorectal cancer.

In some embodiments, methods and compositions for colorectal cancer screening provided herein can inform treatment and/or payment (e.g., reimbursement for or reduction of cost of medical care, such as screening or treatment) decisions and/or actions, e.g., by individuals, healthcare facilities, healthcare practitioners, health insurance providers, governmental bodies, or other parties interested in healthcare cost.

In some embodiments, methods and compositions for colorectal cancer screening provided herein can inform decision making relating to whether health insurance providers reimburse a healthcare cost payer or recipient (or not), e.g., for (1) screening itself (e.g., reimbursement for screening otherwise unavailable, available only for periodic/regular screening, or available only for temporally- and/or incidentally-motivated screening); and/or for (2) treatment, including initiating, maintaining, and/or altering therapy, e.g., based on screening results. For example, in some embodiments, methods and compositions for colorectal cancer screening provided herein are used as the basis for, to contribute to, or support a determination as to whether a reimbursement or cost reduction will be provided to a healthcare cost payer or recipient. In some instances, a party seeking reimbursement or cost reduction can provide results of a screen conducted in accordance with the present specification together with a request for such reimbursement or cost reduction of a healthcare cost. In some instances, a party making a determination as to whether or not to provide a reimbursement or cost reduction of a healthcare cost will reach a determination based in whole or in part upon receipt and/or review of results of a screen conducted in accordance with the present specification.

For the avoidance of any doubt, those of skill in the art will appreciate from the present disclosure that methods and compositions for colorectal cancer diagnosis of the present specification are at least for in vitro use. Accordingly, all aspects and embodiments of the present disclosure can be performed and/or used at least in vitro.

Kits

The present disclosure includes, among other things, kits including one or more compositions for use in colorectal cancer screening as provided herein, optionally in combination with instructions for use thereof in colorectal cancer screening. In various embodiments, a kit for screening of colorectal cancer can include one or more of: one or more oligonucleotide primers (e.g., one or more oligonucleotide primer pairs, e.g., as found in Table 13), one or more MSREs, one or more reagents for qPCR (e.g., reagents sufficient for a complete qPCR reaction mixture, including without limitation dNTP and polymerase), and instructions for use of one or more components of the kit for colorectal cancer screening. In various embodiments, a kit for screening of colorectal cancer can include one or more of: one or more oligonucleotide primers (e.g., one or more oligonucleotide primer pairs, e.g., as found in Table 13), one or more bisulfite reagents, one or more reagents for qPCR (e.g., reagents sufficient for a complete qPCR reaction mixture, including without limitation dNTP and polymerase), and instructions for use of one or more components of the kit for colorectal cancer screening.

In certain embodiments, a kit of the present disclosure includes at least one oligonucleotide primer pair for amplification of a methylation locus and/or DMR as disclosed herein.

In some instances, a kit of the present disclosure includes one or more oligonucleotide primer pairs for amplification of one or more methylation loci of the present disclosure. In some instances, kit of the present disclosure includes one or more oligonucleotide primer pairs for amplification of one or more methylation loci that are or include all or a portion of one or more genes provided in Table 1. In some particular instances, a kit of the present disclosure includes oligonucleotide primer pairs for a plurality of methylation loci that each are or include all or a portion of a gene identified in Table 1, the plurality of methylation loci including, e.g., 3, 4, 5, 6, 7, 8, 9, 10, 11, 12, 13, 14, 15, or 16 methylation loci, e.g., as provided in any of Tables 1 to 6.

In some instances, a kit of the present disclosure includes one or more oligonucleotide primer pairs for amplification of one or more DMRs of the present disclosure. In some instances, kit of the present disclosure includes one or more oligonucleotide primer pairs for amplification of one or more DMRs that are, include all or a portion of, or are within a gene identified in Table 1. In some particular embodiments, a kit of the present disclosure includes oligonucleotide primer pairs for a plurality of DMRs each of which is, includes all or a portion of, or is within a gene identified in Table 1, e.g., 2, 3, 4, 5, 6, 7, 8, 9, 10, 11, 12, 13, 14, 15, or 16 DMRs, e.g., in accordance with any one of Tables 1 to 6.

In some instances, kit of the present disclosure includes one or more oligonucleotide primer pairs for amplification of one or more DMRs of Table 7. In some particular instances, a kit of the present disclosure includes oligonucleotide primer pairs for a plurality of DMRs of Table 7, the plurality of DMRs including, e.g., 2, 3, 4, 5, 6, 7, 8, 9, 10, 11, 12, 13, 14, 15, 16, 17, 18, 19, 20, 21, 22, 23, 24, 25, 26, 27, or 28 DMRs of Table 7, e.g., as provided in any of Tables 8 to 12.

In various embodiments, a kit of the present disclosure includes one or more oligonucleotide primer pairs provided in Table 13. Those of skill in the art will appreciate that oligonucleotide primer pairs provided in Table 13 can be provided in any combination of one or more oligonucleotide primer pairs, e.g., in a combination as provided in any one of Tables 1-12.

In various particular embodiments, kit of the present disclosure does not include oligonucleotide primer pairs that amplify all or a portion of one or more of FGF14, ZNF471, PDGFD, and ALK.

A kit of the present disclosure can further include one or more MSREs individually or in a single solution. In various embodiments, one or more MSREs are selected from the set of MSREs including AciI, Hin6I, HpyCH4IV, and HpaII (e.g., such that the kit includes AciI, Hin6I, and HpyCH4IV, either individually or in a single solution). In certain embodiments, a kit of the present disclosure includes one or more reagents for qPCR (e.g., reagents sufficient for a complete qPCR reaction mixture, including without limitation dNTP and polymerase).

EXAMPLES

The present Examples confirm that the present disclosure provides methods and compositions for, among other things, screening for and treatment of colorectal cancer. The present Examples further demonstrate that compositions and methods provided herein provide a remarkably high degree of sensitivity and specificity in screening and/or treatment of colorectal cancer. Also provided are clinical studies comparing methylation of biomarkers in samples from subjects diagnosed as having colorectal cancer and methylation of biomarkers in samples from control subjects, further demonstrating screening for colorectal cancer including methods and/or compositions of the present disclosure. Except as specifically stated otherwise, samples of the present Examples are humans or of human origin. With the exception of Example 1, all experiments were performed using plasma samples.

Example 1. Identification of Methylation Biomarkers Associated with Colorectal Cancer The present Example includes identification of CpG loci that are hypermethylated in one or more of colon cancer and rectal cancer as compared to healthy controls. In particular, experiments of the present Example examined CpG methylation in samples from (i) colon cancers of 341 subjects previously diagnosed as suffering from colon cancer, which subjects had not been previously treated by chemotherapy or radiotherapy; (ii) rectal cancers of 118 subjects previously diagnosed as suffering from rectal cancer, which subjects had not been previously treated by chemotherapy or radiotherapy; (iii) colons of 40 healthy control subjects not diagnosed as suffering from colorectal cancer; and (iv) leukocytes of 10 healthy control subjects not diagnosed as suffering from a colorectal cancer. Tissue samples were of fresh frozen tissue.

Samples were analyzed for DNA methylation by a global methylomics analysis platform (Infinium HumanMethylation450 (HM450) beadarray). The Infinium HumanMethylation450 array assesses methylation status of >450 000 CpGs located throughout the genome. DNA methylation profiles were obtained from all the tissue samples.

CpG methylation sites for which methylation status did not substantially differ between a colorectal cancer and healthy controls were identified and removed from consideration (mean b-value <0.25 and b-value >0.3 in no more than five samples across the entire set). This filtering produced a list of CpG methylation sites for which methylation status substantially differed between a colorectal cancer and healthy controls. The resulting set of CpG methylation sites was then further filtered by excluding CpG methylation sites with a mean b-value difference equal to or less than 0.1, yielding 253 CpG methylation sites. Each of the 253 CpG methylation sites was associated with a hypermethylated status in colorectal cancer status as compared to controls.

Thus, the present Example generated a set of 253 individual CpG methylation sites that are methylation biomarkers for colorectal cancer. The 253 methylation biomarkers represent a plurality of DMRs together found within 36 genes, i.e., within 36 methylation loci. Each of the 36 DMRs is hypermethylated in colorectal cancer as compared to healthy controls.

Example 2: Development of Cell-Free DNA Assay for Methylation Biomarkers by MSRE-qPCR The present Example develops an assay for determining the methylation status of colorectal cancer methylation biomarkers based on circulating cell free DNA (cfDNA. cfDNA is incomplete and fragmented, and the mechanism by which the cfDNA is transmitted from cancer cells to blood (as a portion called circulating tumor DNA) is unknown. At least because the 253 methylation biomarkers of Example 1 were identified from tissue samples, it was not known prior to the experiments of the present Example whether identified colorectal cancer methylation biomarkers could be sufficiently analyzed from cfDNA to successfully capture the ctDNA portion that allows for identifying subjects or samples for colorectal cancer.

As a critical step toward determining whether colorectal cancer methylation biomarkers identified in Example 1 could be sufficiently analyzed from cfDNA to successfully capture the ctDNA portion that allows for identification of subjects or samples for colorectal cancer, a sensitive assay was developed for screening of these biomarkers. In particular, a Methylation-Sensitive Restriction Enzyme (MSRE)-qPCR methodology was developed. The MSRE-qPCR methodology was developed to measure methylation of DMRs covering identified CpG sites in blood samples, in particular in cell-free DNA (cfDNA) of tumors present in blood.

Development of the MSRE-qPCR methodology was significant at least in part because analyzing CpG methylation biomarkers derived from tumor tissue by analysis of cfDNA is challenging due to the low concentration of tumor-derived DNA circulating in blood (0.1-1%) as compared to the non-tumor DNA background of the sample. Thus, while it is generally preferred to develop biomarker analyses that rely on readily obtainable samples such as blood, urine, or stool, use of blood for analysis of tumor derived methylation biomarkers is challenging. Thus, even after identification of methylation biomarkers characteristic of colorectal cancer in tissue, as discussed above, it cannot be predicted whether the fragmented and poorly understood nature of ctDNA will permit successful screening using methylation biomarkers identified in tissue.

MSRE-qPCR requires design of oligonucleotide primers (MSRE-qPCR oligonucleotide primer pairs) that amplify loci that each include at least one colorectal cancer MSRE cleavage site (i.e., an MSRE cleavage site that covers at least one colorectal cancer methylation biomarker site, such that cleavage of the MSRE cleavage site is permitted in nucleic acid molecules where all of the at least one colorectal cancer methylation biomarker sites are unmethylated and blocked in nucleic acid molecules where at least one of the at least one colorectal cancer methylation biomarker sites is methylated). MSRE-qPCR assays can utilize multiple restriction enzymes to enhance the range of colorectal cancer methylation biomarker sites that can be assayed by a single MSRE-qPCR reaction, as a single MSRE is unlikely to cleavage sites that together include all methylation biomarker sites of interest. MSRE-qPCR assays of the present Examples utilize the MSREs AciI, Hin6I, and HpyCH4IV, which together were found to provide sufficient coverage.

Figure 1:
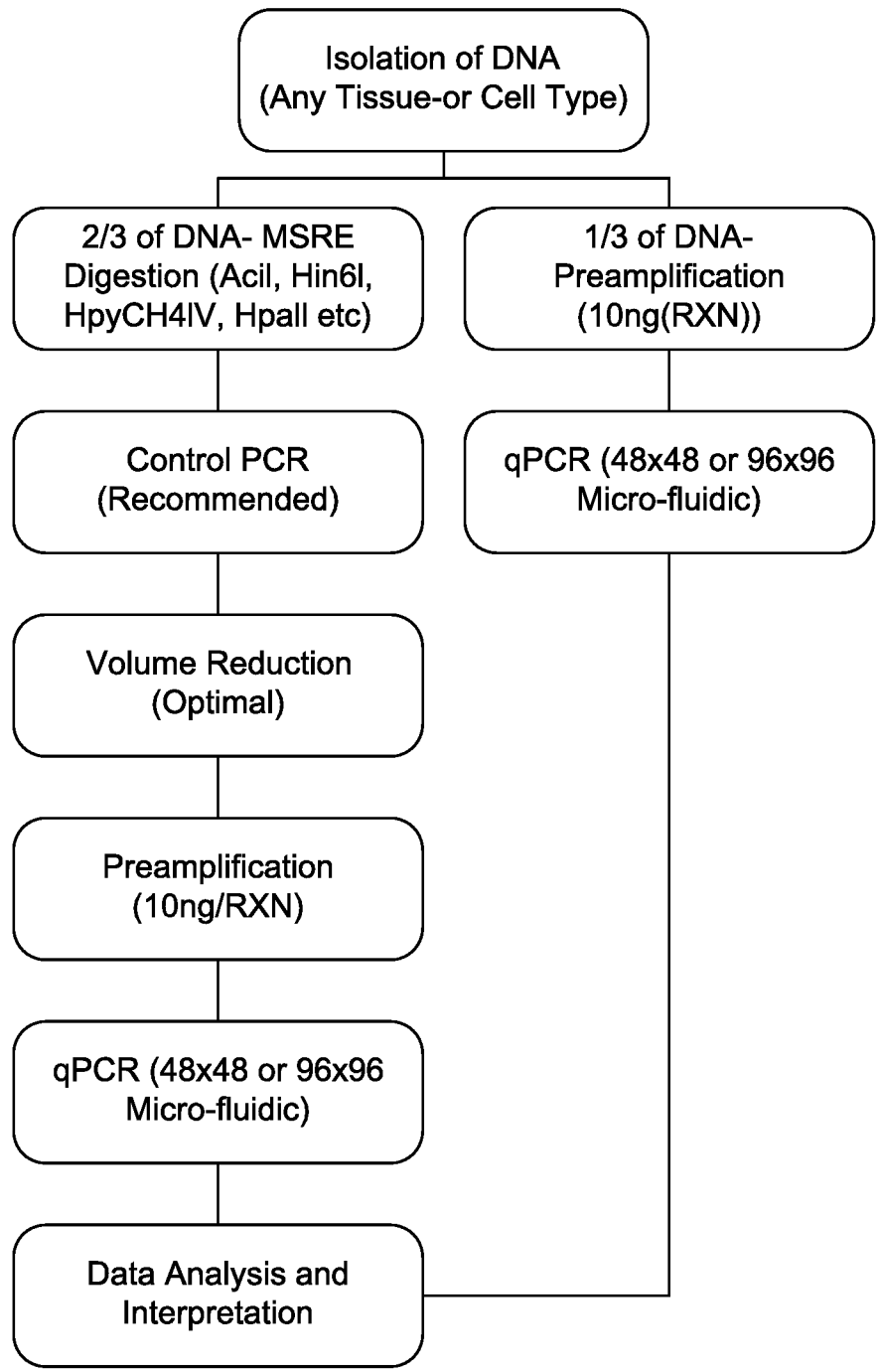
FIG. 1 is a schematic showing an example MSRE-qPCR approach.

An exemplary schematic work flow for MSRE-qPCR is provided in FIG. 1. As performed in the present Examples, circulating cell-free tumor DNA was extracted from subject blood (typically a plasma sample of approximately 4 mL) by QIAamp MinElute ccfDNA Kit in accordance with manufacturer protocol (QIAamp MinElute ccfDNA Handbook 08/2018, Qiagene). As shown in FIG. 1, isolated cfDNA was divided into two aliquots, a first of which aliquots is utilized in a qPCR quality control analysis, and a second of which aliquots is used in MSRE-qPCR For MSRE-qPCR, ⅔ of eluted cfDNA by volume was digested with MSREs. Because non-methylated DNA is selectively cleaved, contacting the cfDNA with the MSREs enriches the sample for methylation-derived signal; methylated DNA remains intact and quantifiable. The remaining ⅓ of eluted cfDNA by volume was used for qPCR using the MSRE-qPCR oligonucleotide primers to confirm that amplicons were successfully amplified from cfDNA, which amplification confirms that template is present, hence providing technical quality control.

As applied herein, MSRE-qPCR oligonucleotide primer pairs were successfully developed for amplification of DMRs together including 180 of the 253 CpG methylation biomarker sites identified in Example 1. DMRs typically included 1 to 15 MSRE cleavage sites, which MSRE cleavage sites together covered each of the 180 methylation biomarker sites. As applied herein, methylation status of six genes (JUB, H19, TBP, TCEB2, SNRPN, IRF4) provided a methylation control, which control permitted monitoring of assay robustness and reproducibility.

Figure 4:
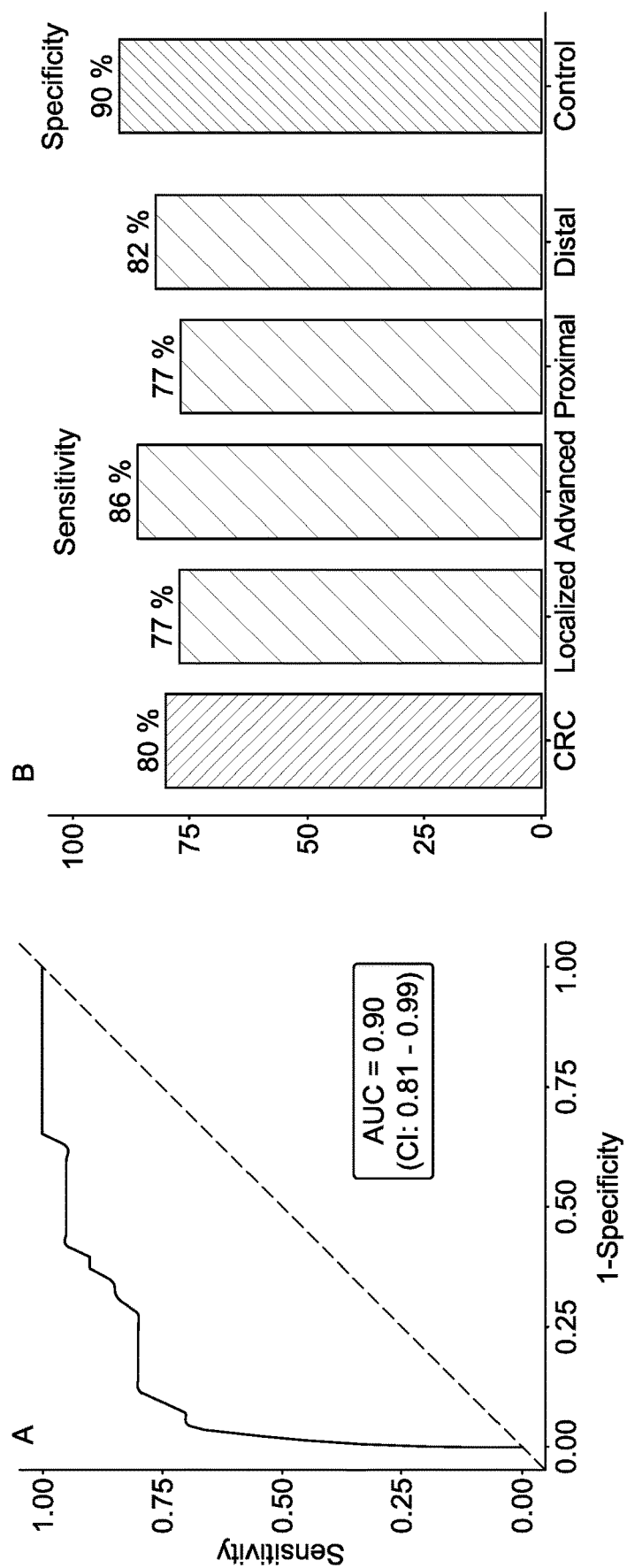
FIG. 4 includes panels A and B. Panel A of FIG. 4 is a graph showing performance of colorectal cancer screening using a representative proof-of-principle panel of DMRs on the second subject group. ROC curve and AUC for all subjects of the second subject group are shown. Panel B of FIG. 4 is a chart showing accuracy values, including, from left to right, overall sensitivity of colorectal screening for colorectal cancer, sensitivity of colorectal screening for localized colorectal cancer, sensitivity of colorectal screening for advanced colorectal cancer, sensitivity of colorectal screening for proximal colorectal cancer, sensitivity of colorectal screening for distal colorectal cancer, and specificity of colorectal screening for control subjects (healthy subjects and subjects with non-advanced adenoma).
Figure 5:
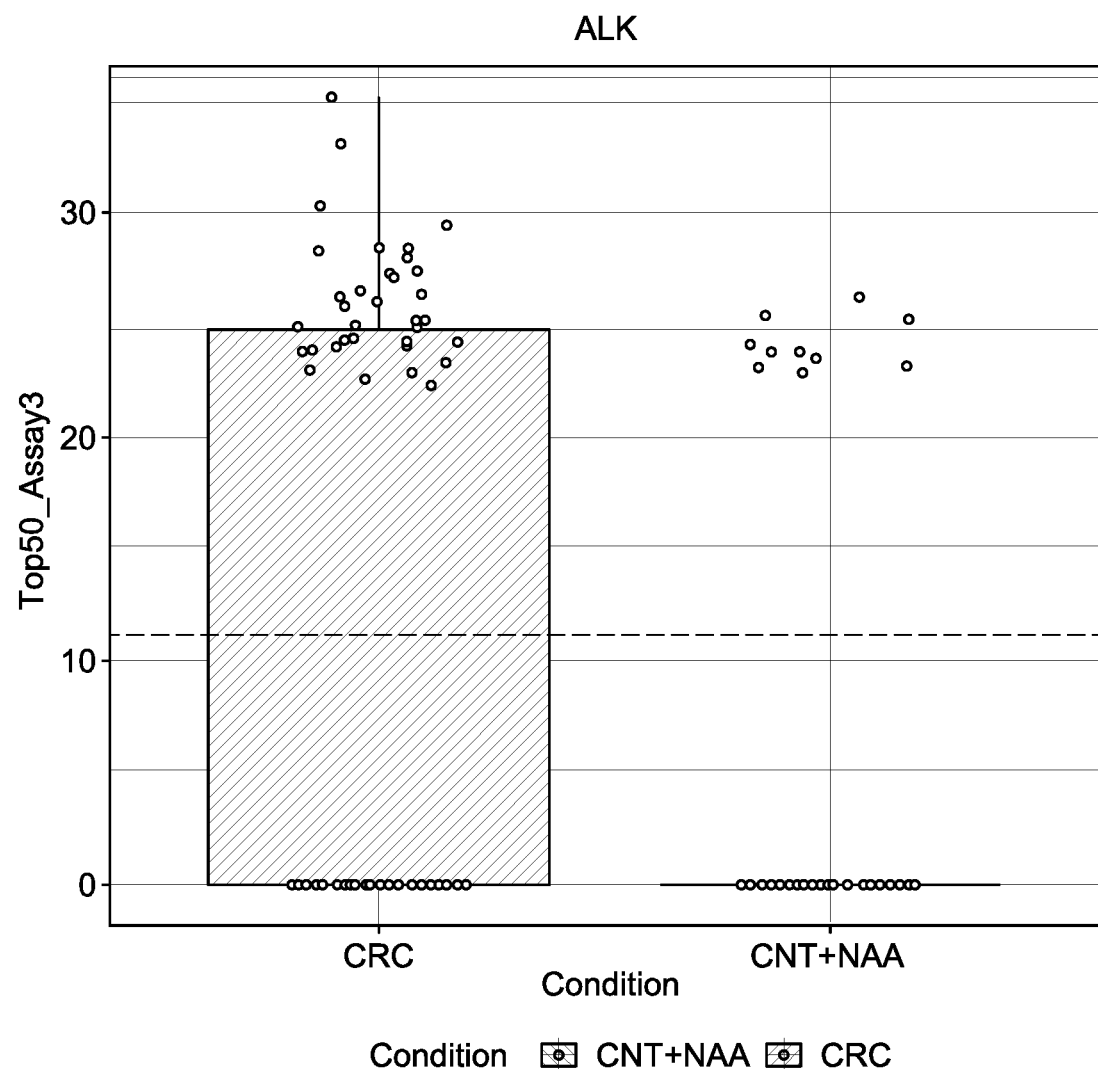
FIG. 5 is a graph representing Ct values from MSRE-qPCR of ALK '434 for subjects with colorectal cancer and control subjects (healthy subjects and subjects with non-advanced adenoma). Data represent the second subject group (63 subjects) used for testing. For display purposes, Ct values are subtracted from 45 (45-dCt). Higher 45-dCt values correspond to higher methylation status, demonstrating hypermethylation in subjects with colorectal cancer.
Figure 6:
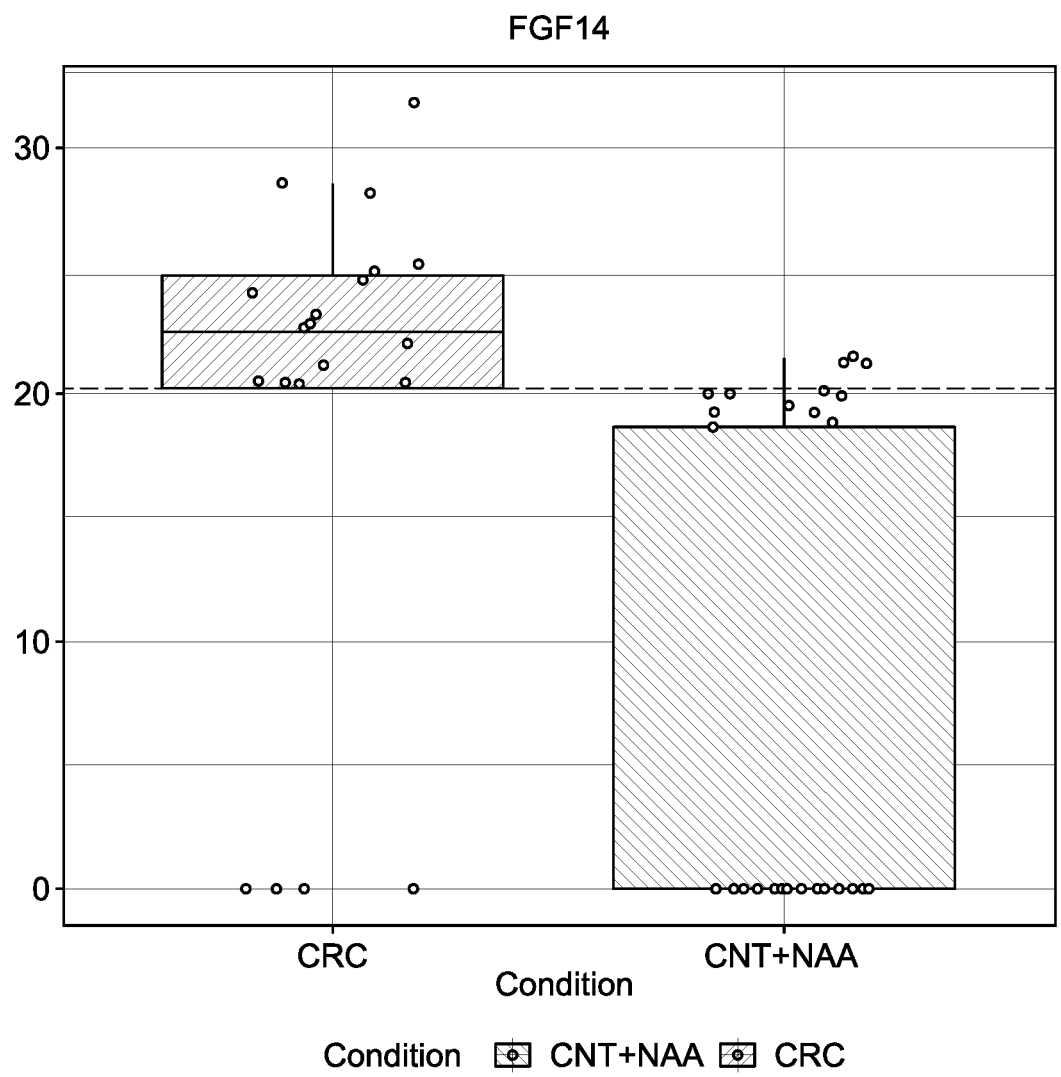
FIG. 6 is a graph representing Ct values from MSRE-qPCR of FGF14 '577 DMR for subjects with colorectal cancer and control subjects (healthy subjects and subjects with non-advanced adenoma). Data represent the second subject group (63 subjects) used for testing. For display purposes, Ct values are subtracted from 45 (45-dCt). Higher 45-dCt values correspond to higher methylation status, demonstrating hypermethylation in subjects with colorectal cancer.
Figure 7:
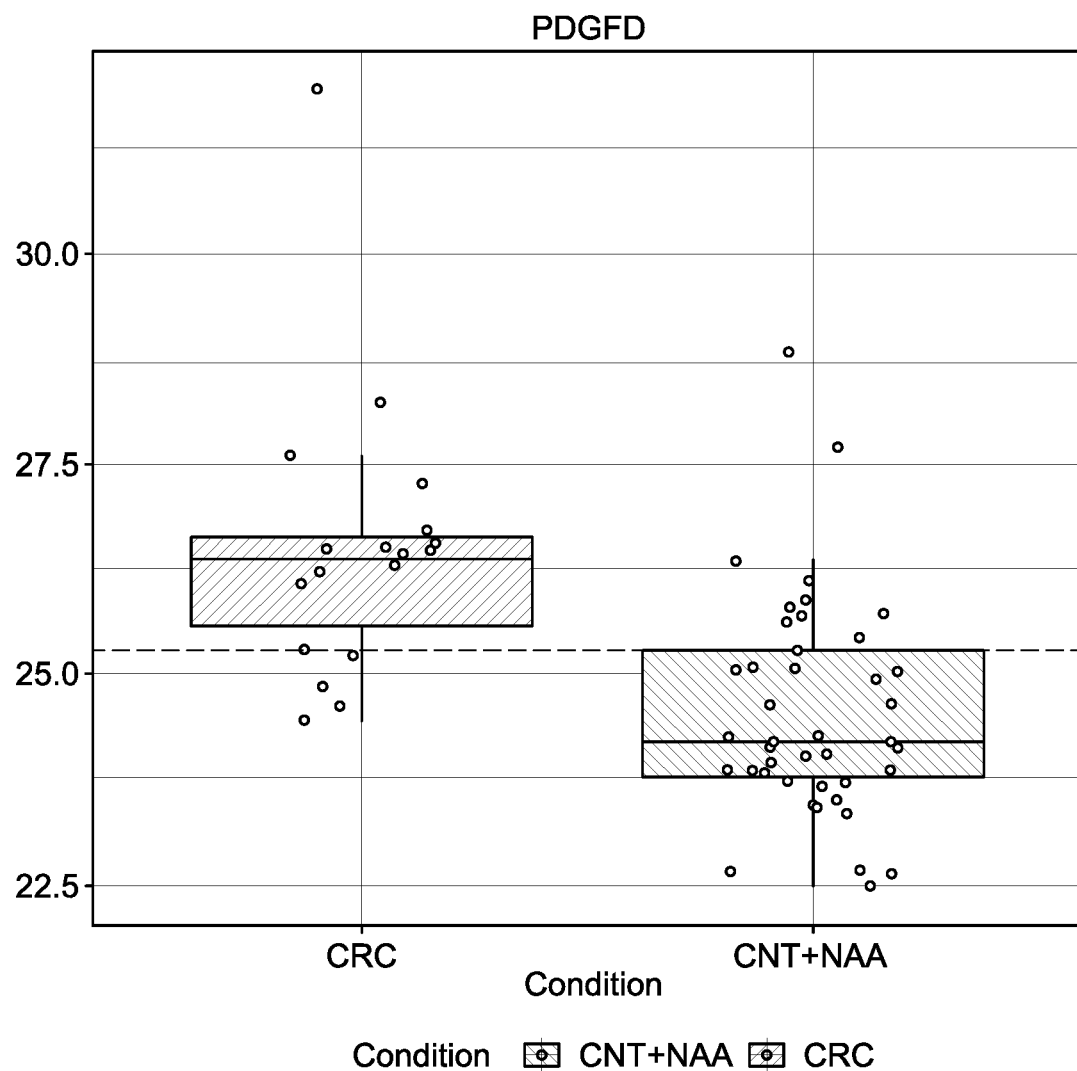
FIG. 7 is a graph representing Ct values from MSRE-qPCR of PDGFD '388 for subjects with colorectal cancer and control subjects (healthy subjects and subjects with non-advanced adenoma). Data represent the second subject group (63 subjects) used for testing. For display purposes, Ct values are subtracted from 45 (45-dCt). Higher 45-dCt values correspond to higher methylation status, demonstrating hypermethylation in subjects with colorectal cancer.
Figure 8:
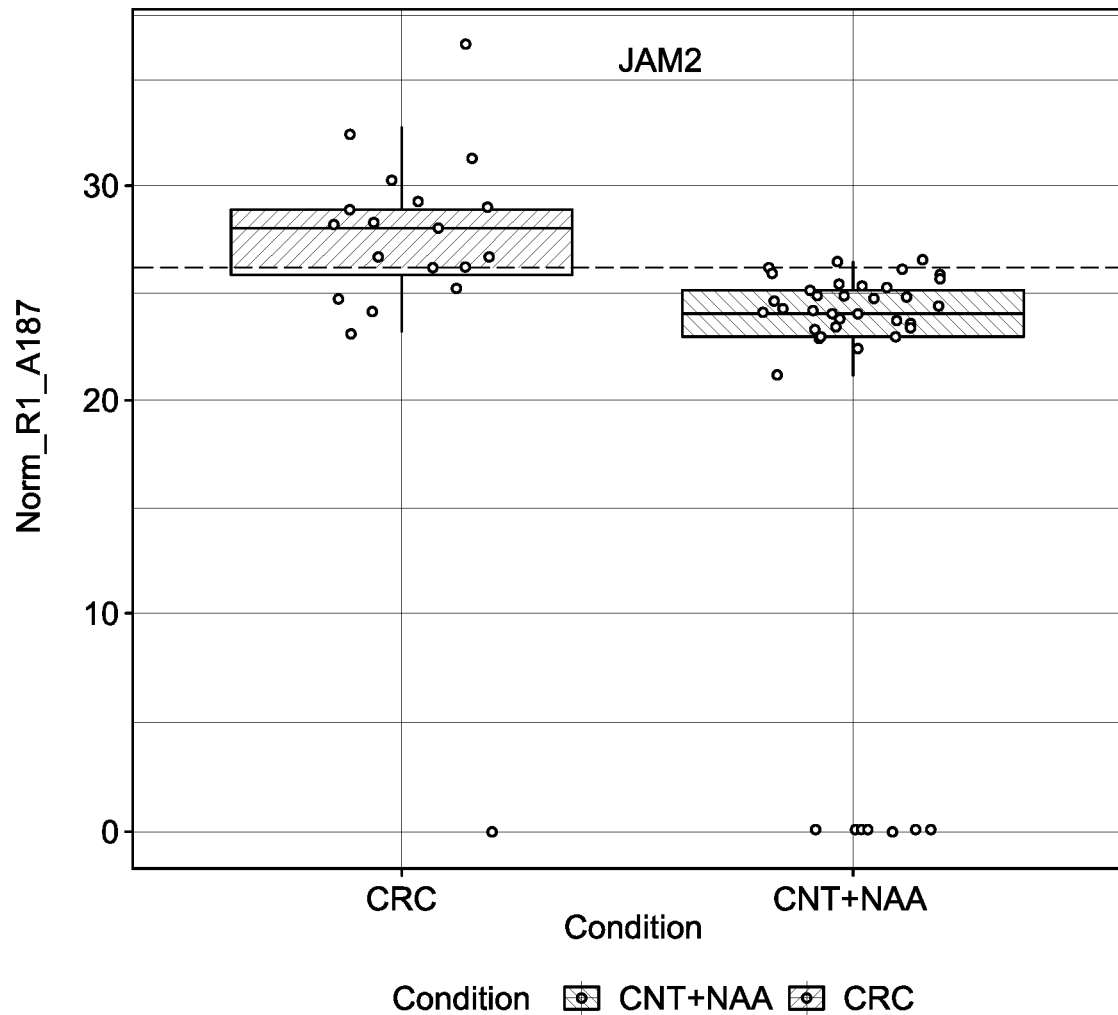
FIG. 8 is a graph representing Ct values from MSRE-qPCR of JAM2 '320 for subjects with colorectal cancer and control subjects (healthy subjects and subjects with non-advanced adenoma). Data represent the d second subject group (63 subjects) used for testing. For display purposes, Ct values are subtracted from 45 (45-dCt). Higher 45-dCt values correspond to higher methylation status, demonstrating hypermethylation in subjects with colorectal cancer.
Figure 9:
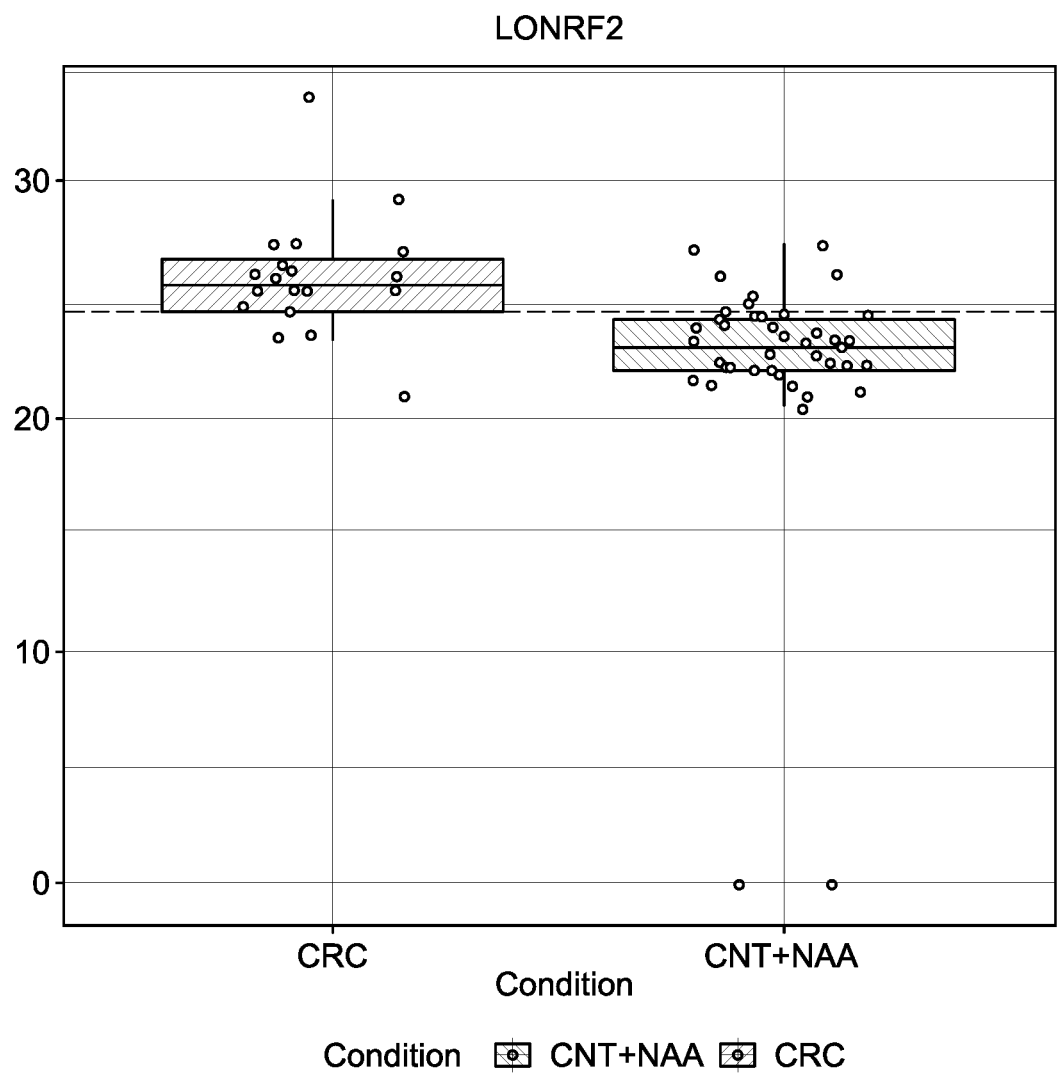
FIG. 9 is a graph representing Ct values from MSRE-qPCR of LONRF2 '281 for subjects with colorectal cancer and control subjects (healthy subjects and subjects with non-advanced adenoma). Data represent the second subject group (63 subjects) used for testing. For display purposes, Ct values are subtracted from 45 (45-dCt). Higher 45-dCt values correspond to higher methylation status, demonstrating hypermethylation in subjects with colorectal cancer.

Example 3: MSRE-qPCR of cfDNA Successfully Distinguishes Subjects by Colorectal Cancer Status To probe clinical diagnostic and prognostic power of identified methylation biomarkers, the DMRs amplified by the MSRE-qPCR oligonucleotide primer pairs covering the 180 methylation biomarker sites, and appropriate controls, were assayed in cfDNA extracted from plasma of human subjects. Subjects were undiagnosed individuals seeking, or in the process of obtaining, a diagnosis regarding possible colorectal cancer, such that methylation biomarker analysis could be performed prior to traditional diagnostic testing for colorectal cancer and then compared to a subsequent traditional diagnosis. In particular, cfDNA was sampled from undiagnosed individuals seeking, or in the process of obtaining, a diagnosis regarding possible colorectal cancer at screening centers and oncology clinics in Spain and the United States between 2017 and 2018. A first subject group included 70 such individuals (see description of the first subject group in FIG. 2), and a second subject group included 63 such individuals (see description of second subject group in FIG. 3). Initial results based on MSRE-qPCR analysis of a small panel of tested DMRs of genes shown in Table 14 in the second subject group provided proof-of-principle for colorectal cancer diagnosis: results demonstrated overall diagnostic sensitivity of 80%, for colorectal cancer, with diagnostic sensitivity of up to 75% for early localized colorectal cancer, and 90% specificity (FIG. 4). The representative proof-of-principle panel of DMRs performed similarly, and/or statistically equally, well with respect to proximal cancers and distal cancers (FIG. 4). The proof-of-principle panel of DMRs also performed similarly, and/or statistically equally, well with respect to localized cancer and advanced cancer (FIG. 4). Moreover, MSRE-qPCR analysis of methylation of MSRE-qPCR control genes and of undigested DNA controls showed high technical reliability of the developed MSRE-qPCR assays in measuring colorectal cancer biomarker methylation status in plasma cfDNA.

FIGS. 5-9 show the association of methylation status of colorectal cancer DMRs with colorectal cancer. Results are displayed as the MSRE-qPCR Ct value subtracted from 45 (i.e., 45-Ct value) for display purposes. Results demonstrate the surprisingly high predictive power of individual colorectal cancer methylation biomarkers, or of as few as three individual colorectal cancer methylation biomarkers, of the present disclosure for colorectal cancer, e.g., for use in determining screening for colorectal cancer in a subject.

TABLE 14

Proof-of-principle DMR panel

| gene | chr | start | end | width | uid |
|---|---|---|---|---|---|
| PDGFD | chr11 | 104163499 | 104164026 | 528 | PDGFD_chr11_104163499_104164026 |
| FGF14 | chr13 | 101919879 | 102403137 | 483259 | FGF14_chr13_101919879_102403137 |
| ALK | chr19 | 58439728 | 58440994 | 1267 | ALK_chr19_58439728_58440994 |
| LONRF2 | chr2 | 29193215 | 29922286 | 729072 | LONRF2_chr2_29193215_29922286 |
| JAM2 | chr2 | 68293114 | 68320928 | 27815 | JAM2_chr2_68293114_68320928 |

Example 4. Further Validation of Methylation Biomarkers by MSRE-qPCR

To verify the predictive power of methylation biomarker DMRs for colorectal cancer, data derived from MSRE-qPCR analysis of samples from the 133 subjects of the first and second subject groups identified in Example 3 (see FIGS. 2 and 3) were further analyzed. Monte-Carlo cross-validation was used over 50 runs and random forest algorithm was used for feature ranking and markers with VIP >2 were used for building a support-vector machine (SVM) algorithm-based classification model. This analysis identified several subsets of markers (2,3,5,8,15,28 as described in Tables 7-12) that in SVM-model gave a good prediction.

All models (2, 3, 5, 8, 15 and 28 colorectal cancer DMR panels) were applied to cfDNA extracted from plasma of a third subject group. The third subject group included 82 subjects who had either previously received a confirmed diagnosis of colorectal cancer or were control subjects known to not have colorectal cancer deemed (the control group including subjects having hyperplastic polyps and/or non-advanced adenoma, but not colorectal cancer), based on colonoscopy screening. The 82 subjects were subjects attending colorectal cancer screening and oncology units in Spain and the United States. Further description of the third subject group is shown in FIG. 10.

Oligonucleotide primer pairs (Table 13) for amplification of the 28 DRMs in MSRE-qPCR cover at least one MSRE cleavage site, typically 3 to 15 MSRE cleavage sites. MSRE-qPCR was carried out according to the methodology described in Example 2.

Figure 11:
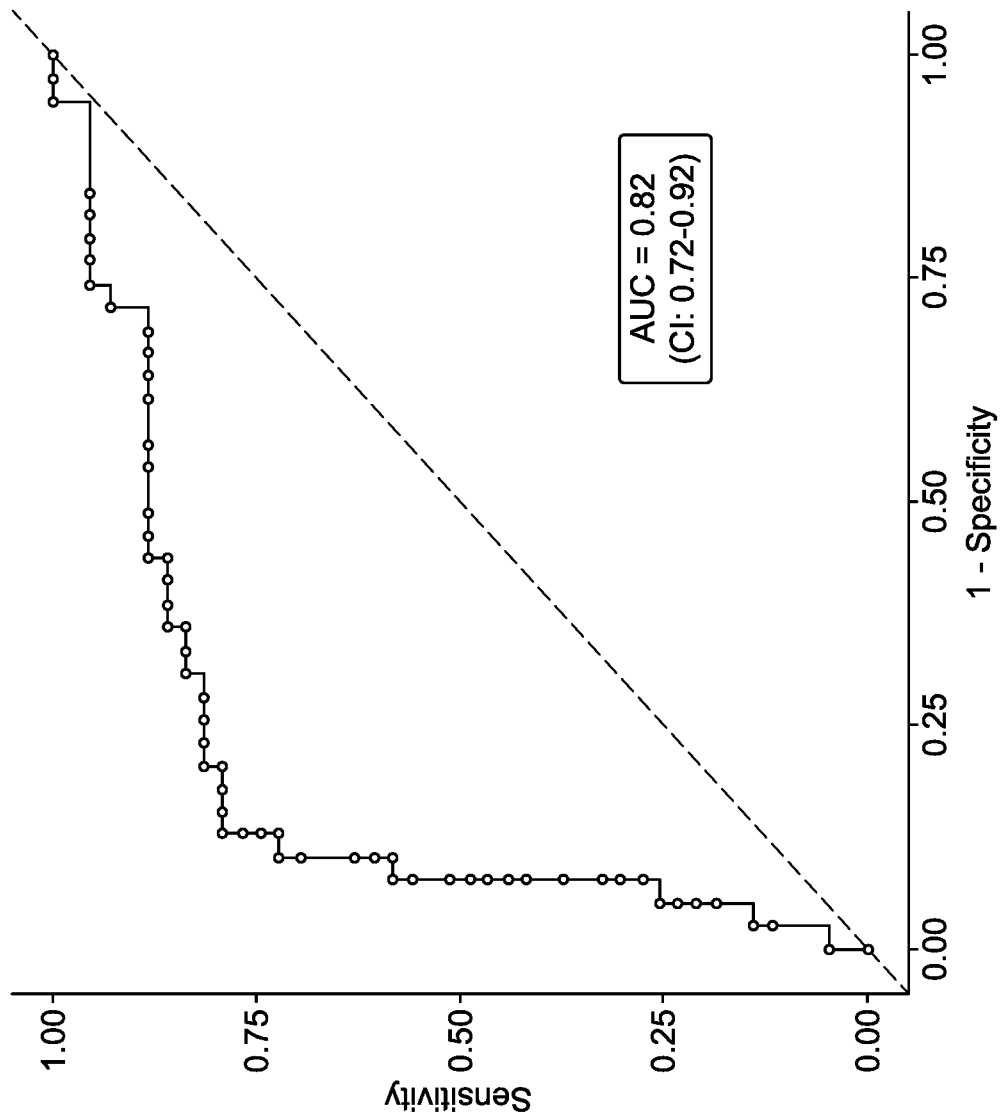
FIG. 11 is a graph showing performance of colorectal cancer screening using a 28 DMR panel in the third subject group. ROC curve and AUC for all subjects of the third subject group are shown. ROC-curve analysis showed that a 28 DMR panel achieved general colorectal cancer sensitivity of 79%, with 75% sensitivity for localized (early) cancer and 84% sensitivity for advanced cancer, on a very stable specificity of 87% at AUC 82% (see also Table 15).
Figure 12:
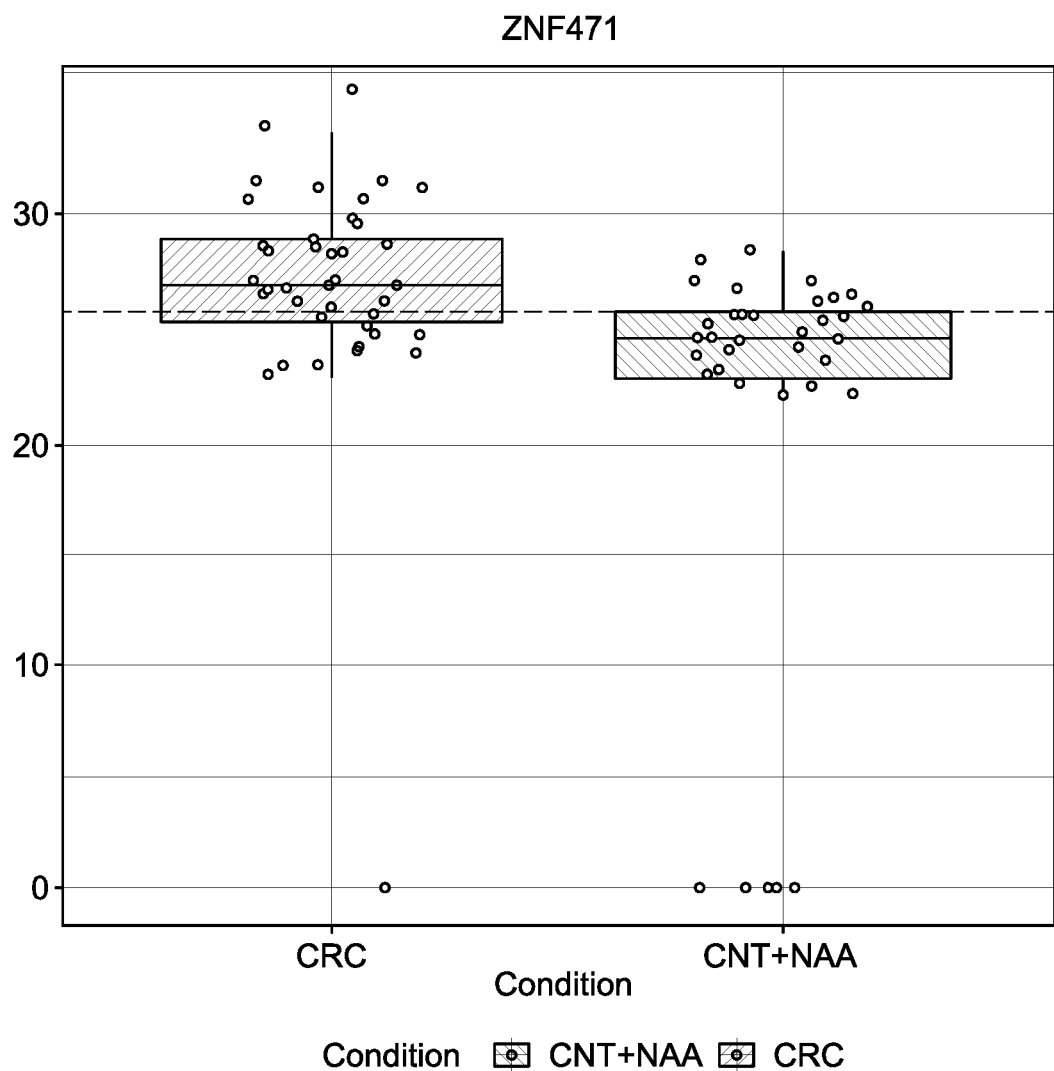
FIG. 12 is a graph representing Ct values from MSRE-qPCR of ZNF471 '527 for subjects with colorectal cancer and control subjects (healthy subjects and subjects with non-advanced adenoma). Data represent the third subject group (82 subjects). For display purposes, Ct values are subtracted from 45 (45-dCt). Higher 45-dCt values correspond to higher methylation status, demonstrating hypermethylation in subjects with colorectal cancer.
Figure 13:
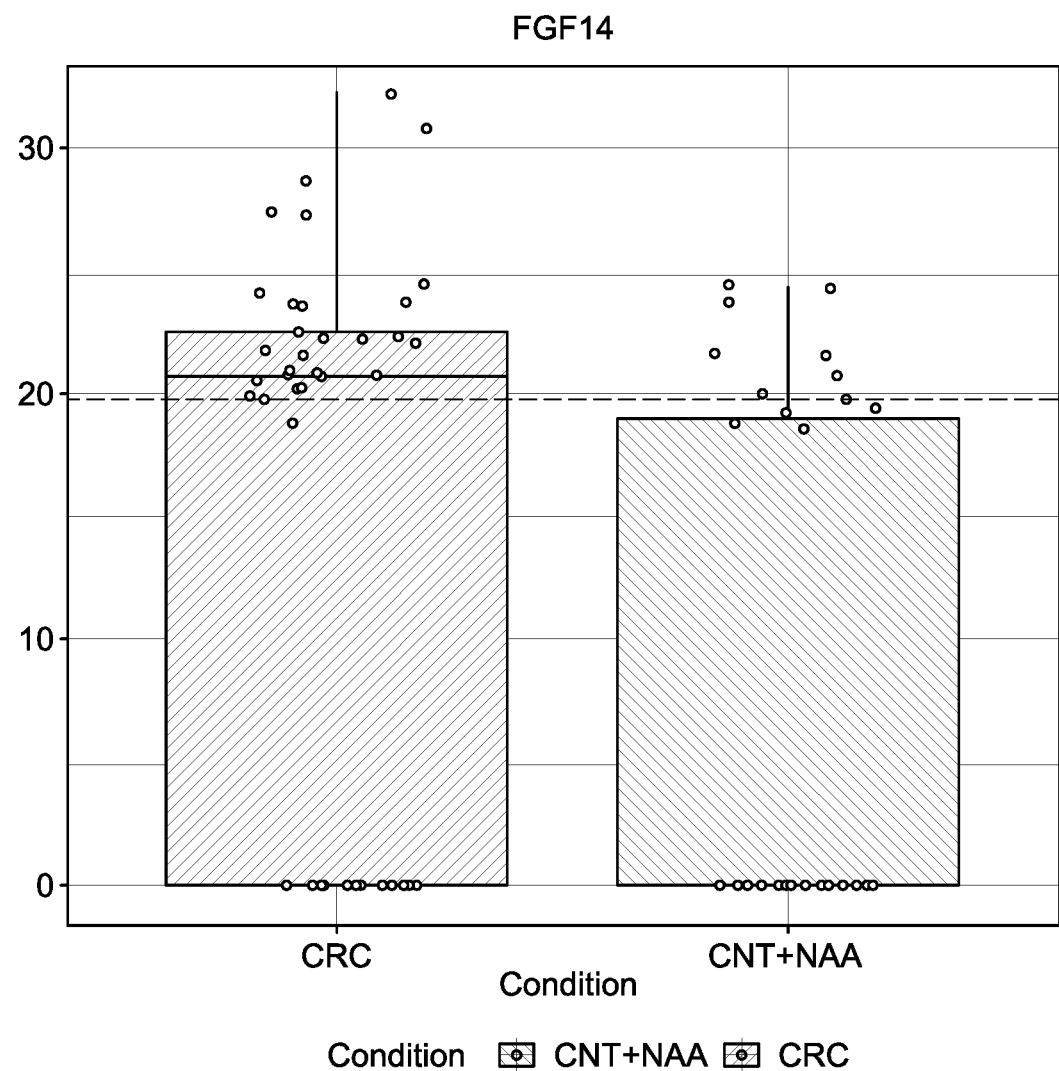
FIG. 13 is a graph representing Ct values from MSRE-qPCR of FGF14 '577 for subjects with colorectal cancer and control subjects (healthy subjects and subjects with non-advanced adenoma). Data represent the third subject group (82 subjects). For display purposes, Ct values are subtracted from 45 (45-dCt). Higher 45-dCt values correspond to higher methylation status, demonstrating hypermethylation in subjects with colorectal cancer.
Figure 14:
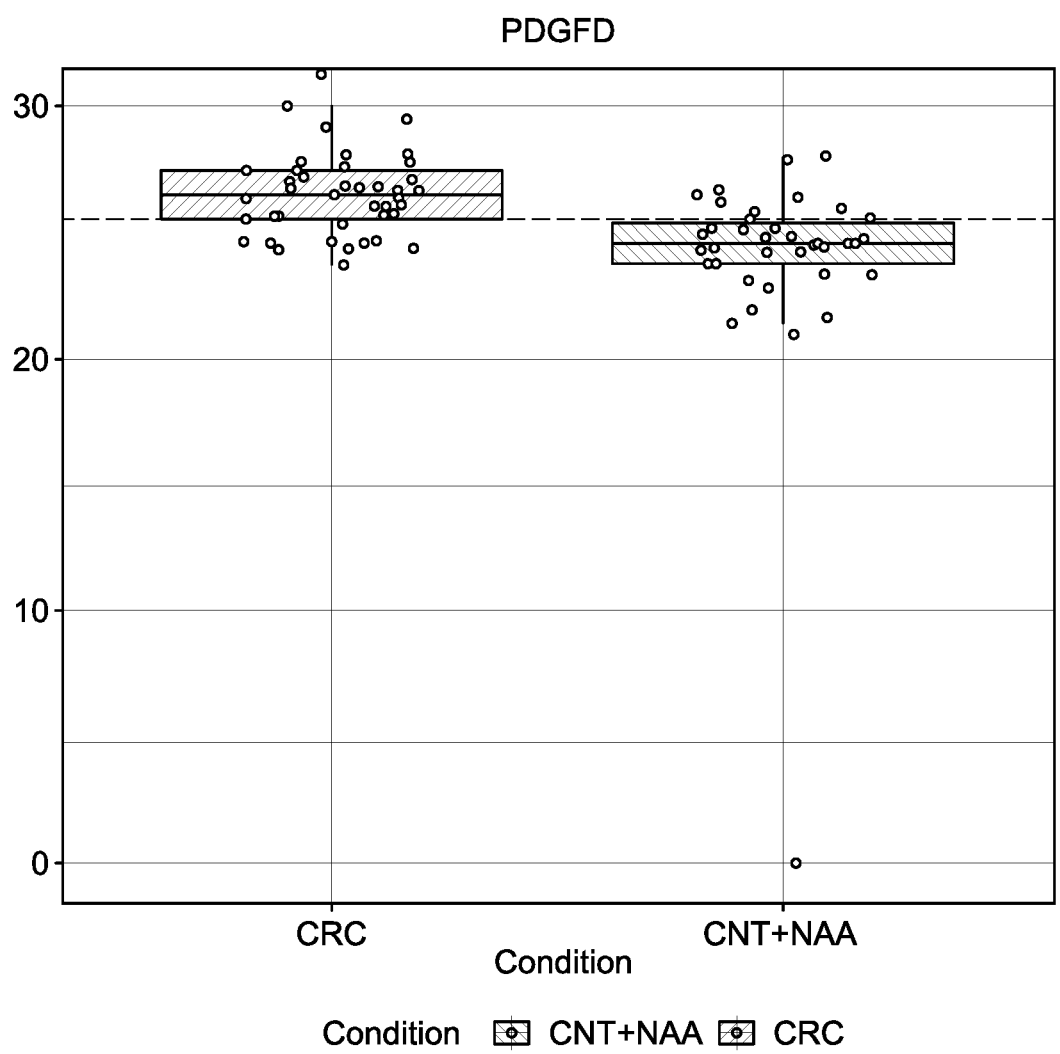
FIG. 14 is a graph representing Ct values from MSRE-qPCR of PDGFD '388 for subjects with colorectal cancer and control subjects (healthy subjects and subjects with non-advanced adenoma). Data represent the third subject group (82 subjects). For display purposes, Ct values are subtracted from 45 (45-dCt). Higher 45-dCt values correspond to higher methylation status, demonstrating hypermethylation in subjects with colorectal cancer.
Figure 15:
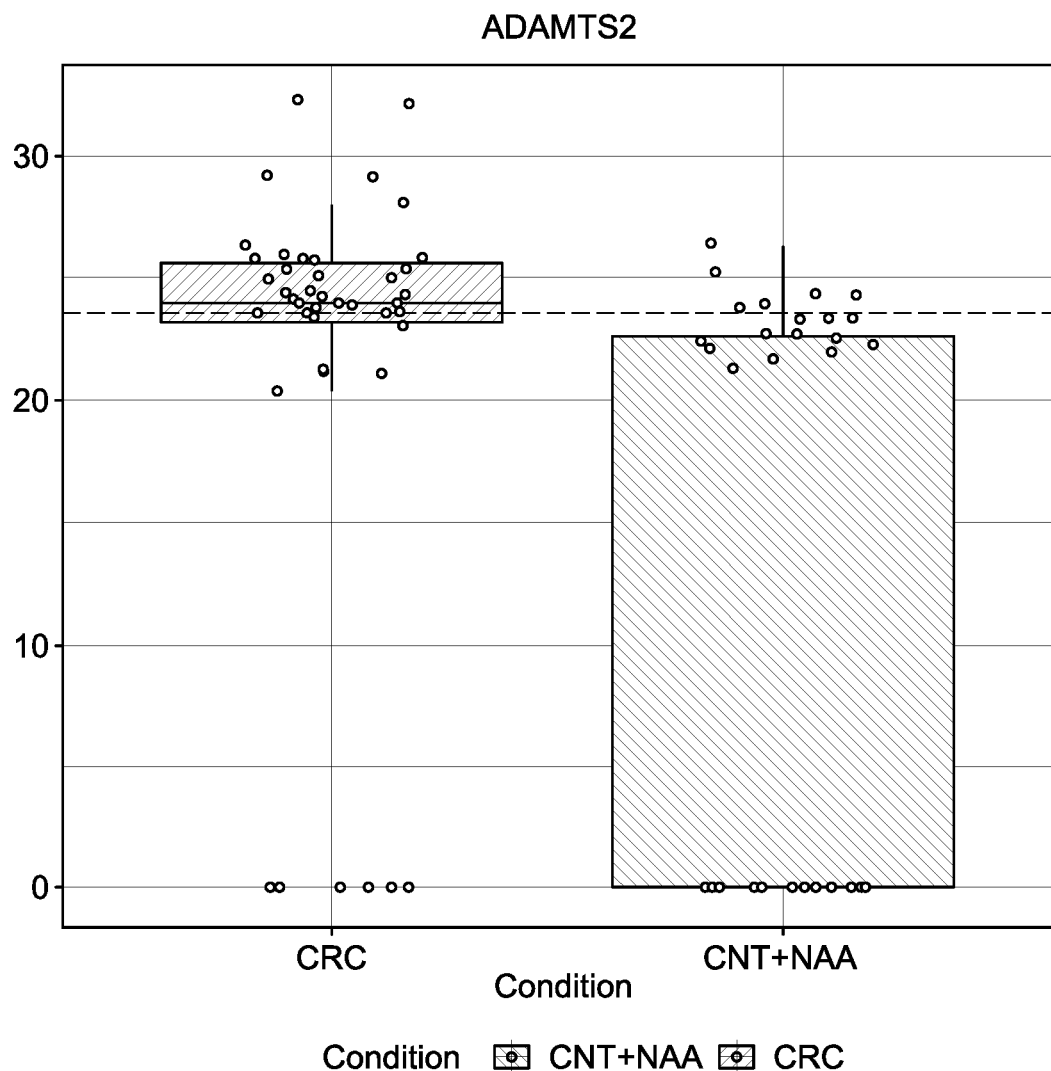
FIG. 15 is a graph representing Ct values from MSRE-qPCR of ADAMTS2 '254 for subjects with colorectal cancer and control subjects (healthy subjects and subjects with non-advanced adenoma). Data represent the third subject group (82 subjects). For display purposes, Ct values are subtracted from 45 (45-dCt). Higher 45-dCt values correspond to higher methylation status, demonstrating hypermethylation in subjects with colorectal cancer.
Figure 16:
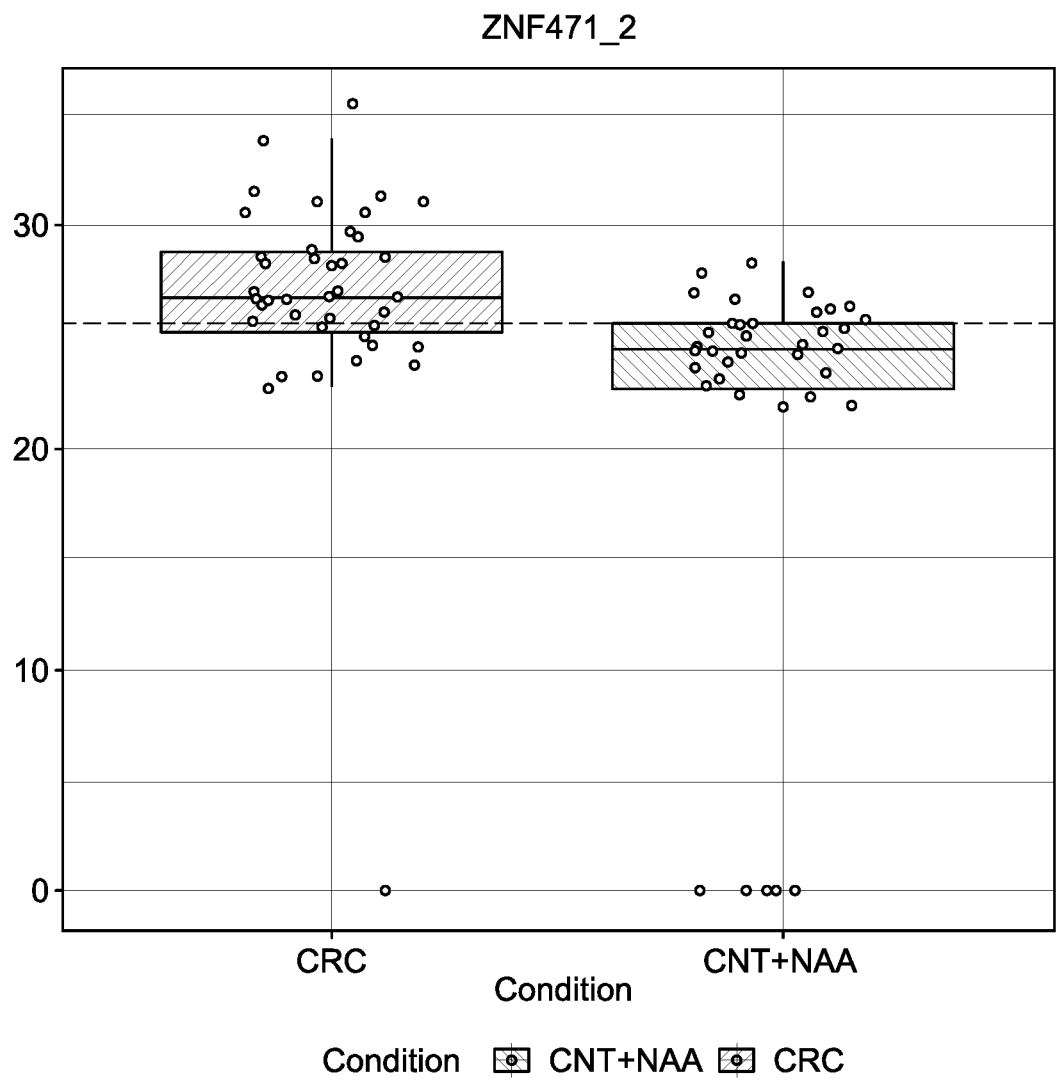
FIG. 16 is a graph representing Ct values from MSRE-qPCR of ZNF471 '558 (which DMR is alternatively referred to herein as ZNF471_2) for subjects with colorectal cancer and control subjects (healthy subjects and subjects with non-advanced adenoma). Data represent the third subject group (82 subjects). For display purposes, Ct values are subtracted from 45 (45-dCt). Higher 45-dCt values correspond to higher methylation status, demonstrating hypermethylation in subjects with colorectal cancer.
Figure 17:
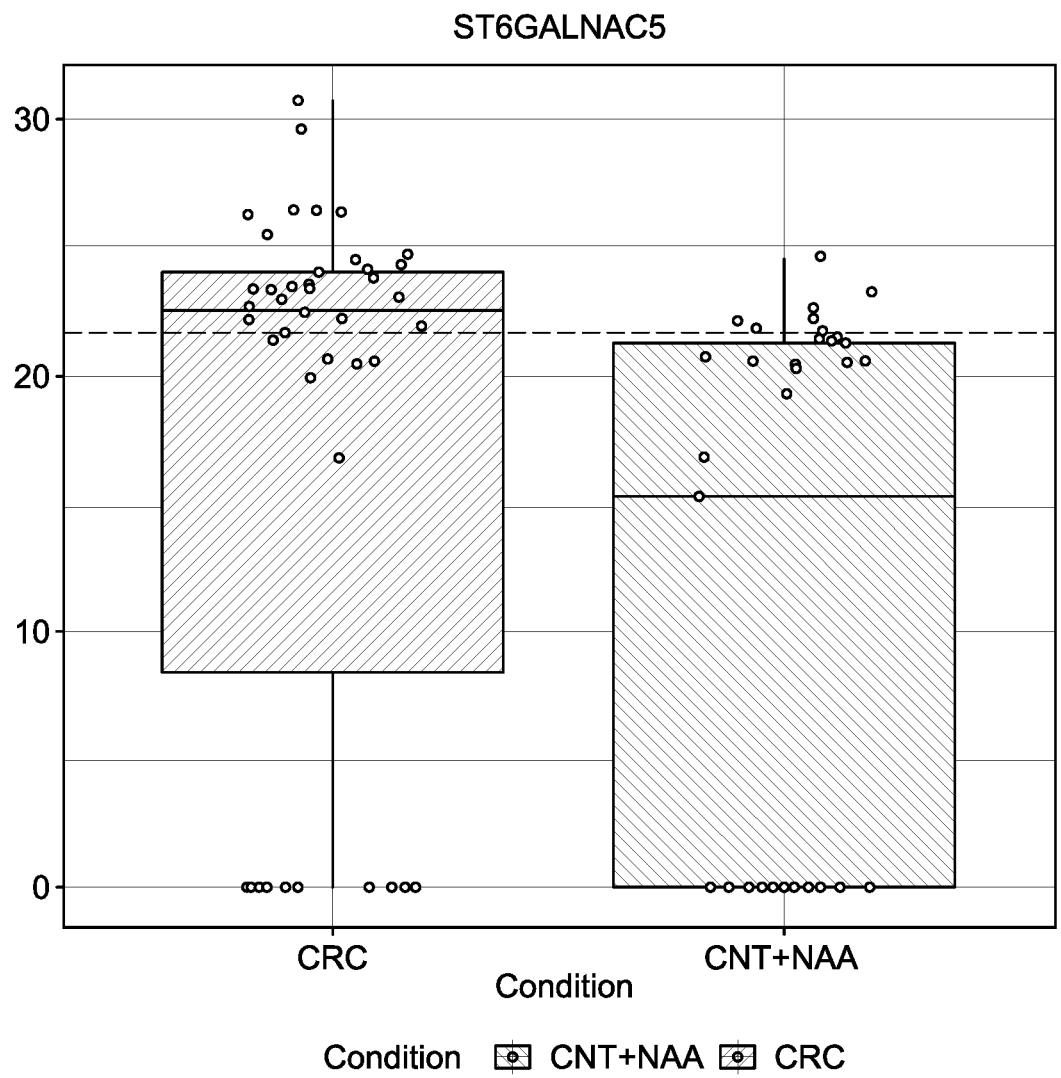
FIG. 17 is a graph representing Ct values from MSRE-qPCR of ST6GALNAC5 '456 for subjects with colorectal cancer and control subjects (healthy subjects and subjects with non-advanced adenoma). Data represent the third subject group (82 subjects). For display purposes, Ct values are subtracted from 45 (45-dCt). Higher 45-dCt values correspond to higher methylation status, demonstrating hypermethylation in subjects with colorectal cancer.
Figure 18:
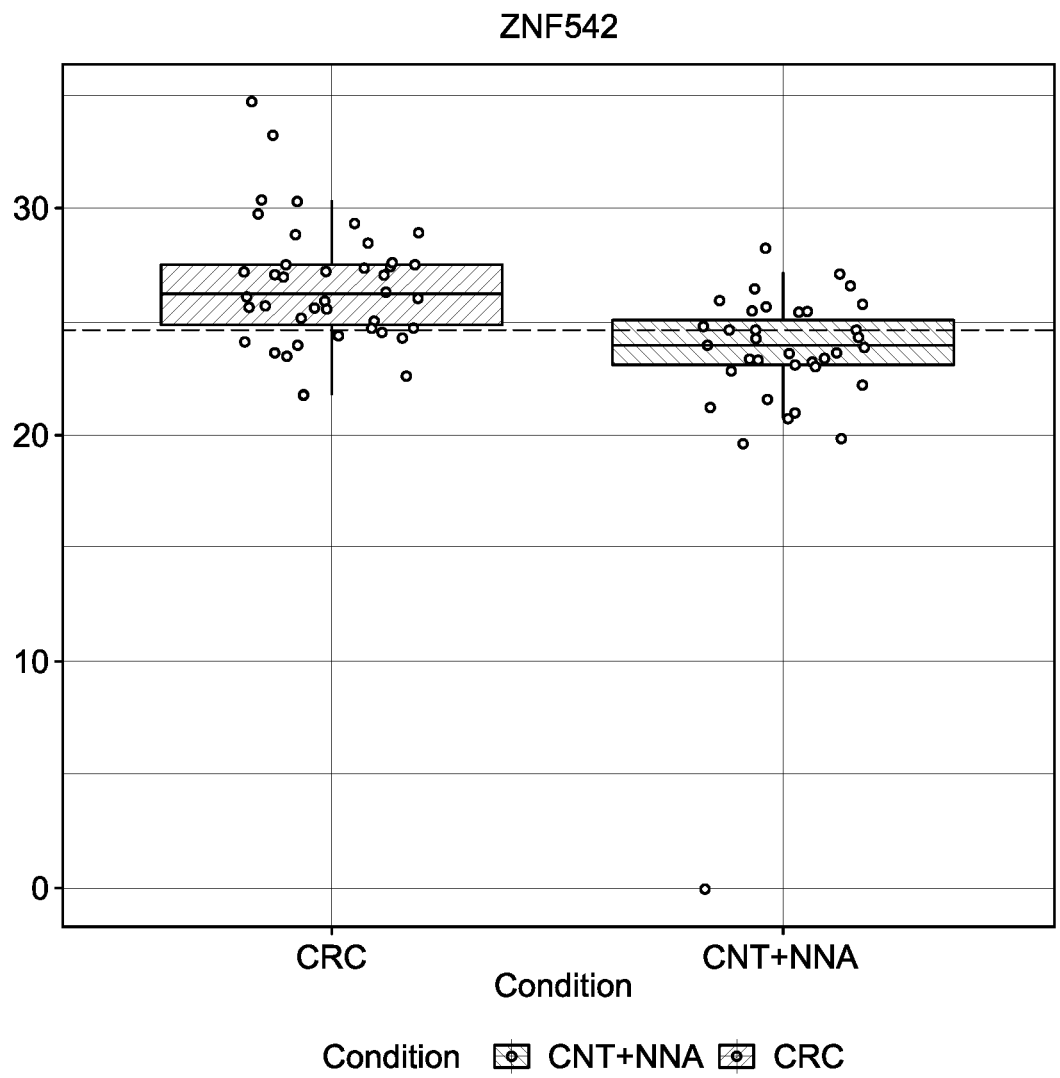
FIG. 18 is a graph representing Ct values from MSRE-qPCR of ZNF542 '525 for subjects with colorectal cancer and control subjects (healthy subjects and subjects with non-advanced adenoma). Data represent the third subject group (82 subjects). For display purposes, Ct values are subtracted from 45 (45-dCt). Higher 45-dCt values correspond to higher methylation status, demonstrating hypermethylation in subjects with colorectal cancer.
Figure 19:
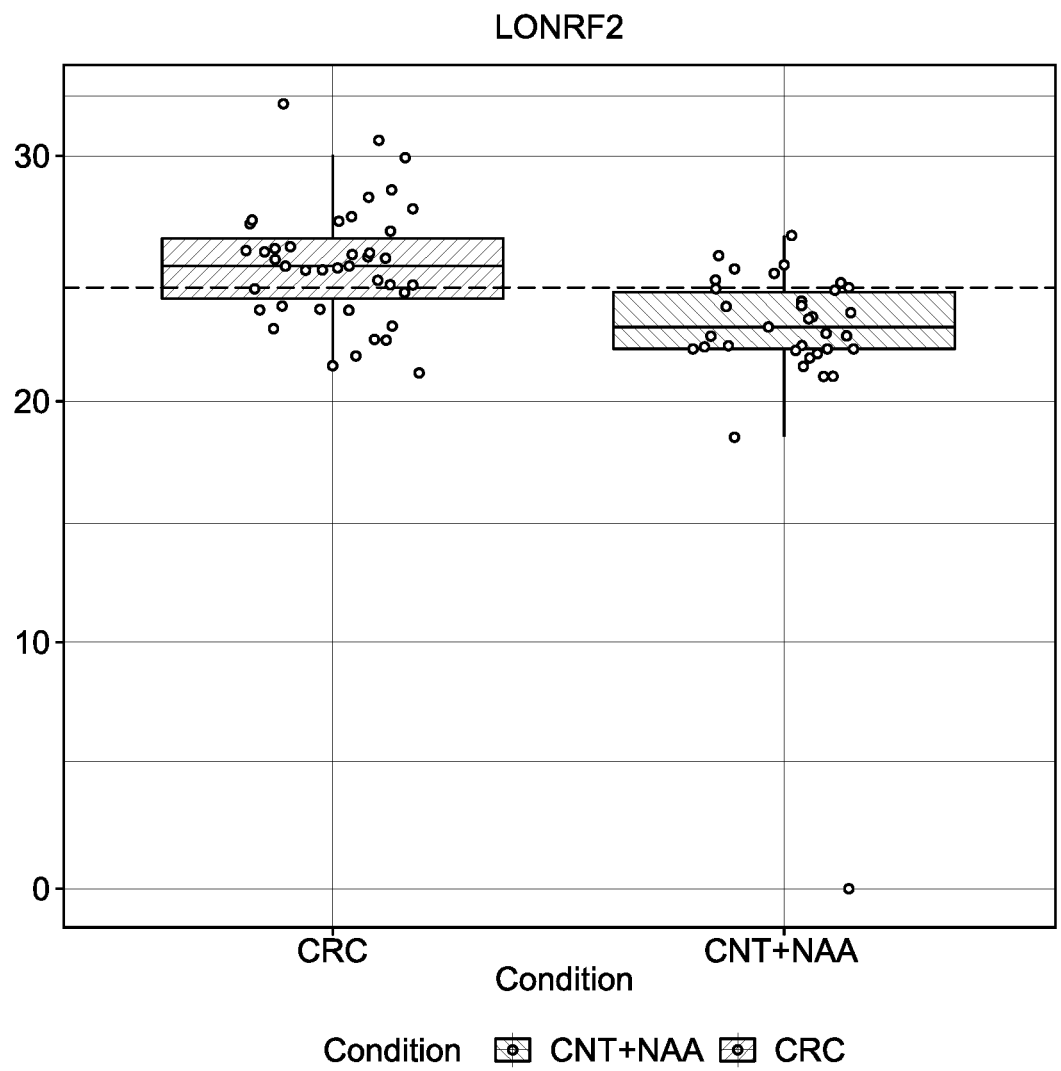
FIG. 19 is a graph representing Ct values from MSRE-qPCR of LONRF2 '281 for subjects with colorectal cancer and control subjects (healthy subjects and subjects with non-advanced adenoma). Data represent the third subject group (82 subjects). For display purposes, Ct values are subtracted from 45 (45-dCt). Higher 45-dCt values correspond to higher methylation status, demonstrating hypermethylation in subjects with colorectal cancer.

Notwithstanding the sufficiency and utility of all tested panels for screening for colorectal cancer, those of skill in the art will appreciate that the 28-DMR panel provided increased sensitivity and comparable specificity as compared to all other DMR panels indicated in Table 15. For the avoidance of any doubt, all of the panels tested, e.g., as described in Tables 7-14, are individually alone sufficient (e.g., in both sensitivity and specificity), and useful, for clinical screening of colorectal cancer. Analysis of the third subject group using the 28 colorectal cancer DMR panel showed general sensitivity for diagnosis of colorectal cancer of 79%, with 75% sensitivity for localized (early) cancer and 84% sensitivity for advanced cancer. Data also revealed specificity of 87% at AUC 82% (FIG. 11). A ROC curve analysis of the second validation group data based on a 28-marker panel identified by the SVM model is provided in FIG. 11.

Thus, evaluation of the performance of the 28 colorectal cancer DMR panel and subsets thereof reveal that both the full panel and each of the various subsets of 2, 3, 5, 8, and 15 of the 28 colorectal cancer DMRs are individually sufficient for clinical screening of colorectal cancer (See Tables 7-14). For instance, to highlight just one example, the 3-DMR subset (Table 9) achieved good separation of colorectal cancer subjects from control subjects, demonstrating sufficient performance for clinical screening of colorectal cancer, at least in part as demonstrated by the determined sensitivity of 60% and specificity of 87% (Table 15).

SVM—model characteristics are described in Table 16. Input support SVM Vectors and their coefficiency (weight) values are given in Table 17 (due to the size of Table 17, Table 17 is presented in several portions, with the coefficients and gene names repeated in each portion for reference). For prediction purposes the provided information was used in combination with predict( )function in R-package (see cran.r-project.org).

TABLE 15

Accuracy metrics for application of 28 colorectal cancer DMR panel and subsets thereof to third subject group

|  | 2 | 3 | 5 | 8 | 15 | 28 |
|---|---|---|---|---|---|---|
| AUC | 0.77 | 0.82 | 0.83 | 0.83 | 0.82 | 0.82 |
| AUC_Cl_LOW | 0.67 | 0.73 | 0.73 | 0.74 | 0.73 | 0.72 |
| AUC_Cl_HIGH | 0.87 | 0.91 | 0.92 | 0.92 | 0.92 | 0.92 |
| Sensitivity | 0.63 | 0.60 | 0.65 | 0.53 | 0.72 | 0.79 |
| Specificity | 0.79 | 0.87 | 0.82 | 0.87 | 0.79 | 0.87 |

TABLE 16

SVM-model input characteristics

| vars | value |
|---|---|
| type | 0 |
| kernel | 2 |
| cost | 1 |
| degree | 3 |
| gamma | 0.035714 |
| coef0 | 0 |
| nu | 0.5 |
| epsilon | 0.1 |
| nclasses | 2 |
| rho | −0.73551 |
| probA | −2.14936 |
| probB | −0.10114 |
| sigma | 0 |

TABLE 17

| | | | SVM Vectors | | |
|---|---|---|---|---|---|
| coefs | GSG1L<br>GSG1L '861 | ZNF492_2<br>ZNF492 '499 | ZNF568_2<br>ZNF568 '252 | ZNF568_1<br>ZNF568 '405 | ZNF542_2<br>ZNF542 '525 |
| 1 | 0.166333806 | 0.423405118 | −0.939531248 | 0.275236404 | −0.052862411 |
| 1 | 0.183718034 | −2.19255911 | −0.092363545 | −0.327541264 | 0.309450278 |
| 0.160992568 | −0.094429617 | −2.19255911 | −0.939531248 | −0.413652359 | 0.137466406 |
| 1 | 0.475386751 | 0.318930431 | −0.147777884 | 0.019978514 | 0.164983826 |
| 1 | −0.152377044 | 0.473593938 | 1.146062978 | 0.429006217 | 0.574305439 |
| 1 | 0.315065536 | 0.442866089 | 0.835406834 | 0.041506288 | 0.55940017 |
| 0.539110203 | −0.428593114 | 0.344536972 | 0.864793226 | −0.0507556 | 0.174156299 |
| 1 | 0.143154835 | −2.19255911 | 0.848840613 | −0.373672208 | 0.025103611 |
| 0.228841426 | −0.16396653 | 0.392677269 | −0.939531248 | −0.0507556 | 0.161544148 |
| 1 | 0.691723813 | 0.288202582 | −0.939531248 | 0.232180856 | 0.641952428 |
| 1 | 0.152812739 | 0.548365038 | 0.897538063 | 0.321367348 | 0.6259006 |
| 0.086502196 | 0.152812739 | 0.413162502 | −0.939531248 | −0.318315075 | 0.260148235 |
| 1 | 0.058165275 | 0.455157229 | −0.939531248 | −0.035378619 | 0.421813073 |
| 0.022981588 | −0.055797999 | −2.19255911 | −0.939531248 | −0.469009492 | 0.310596837 |
| 0.199753156 | 0.029191561 | 0.425453641 | −0.939531248 | −0.192223828 | 0.392002536 |
| 0.640672506 | 0.401986676 | 0.512515881 | 0.731295044 | −0.352144434 | −2.050168434 |
| 0.488436741 | 0.11224954 | −2.19255911 | −0.939531248 | −0.327541264 | −2.050168434 |
| 0.290813367 | 0.038849466 | 0.455157229 | 0.842963334 | 0.038430892 | 0.370217912 |
| 0.93438076 | −0.165898111 | 0.292299628 | 0.996612184 | −0.293711905 | 0.182182213 |
| 1 | 0.34597083 | 0.531976852 | −0.939531248 | 0.622756182 | 0.534175869 |
| 0.177133374 | 0.291886565 | 0.201140342 | 0.931122511 | 0.312141159 | 0.439011461 |
| 0.363673626 | −0.252819252 | 0.199091819 | −0.939531248 | −0.232203979 | 0.408054364 |
| 0.372869951 | −0.022961123 | −2.19255911 | −0.939531248 | −0.438255529 | −2.050168434 |
| 0.180416799 | −0.0152348 | 0.246207854 | −0.939531248 | −0.247580961 | 0.130587052 |
| 1 | 1.837151292 | 1.131169911 | −0.939531248 | 1.084065621 | 1.180835225 |
| 0.236974727 | −4.54286045 | 0.032617172 | −0.240135117 | −0.619703909 | −2.050168434 |
| 0.433173404 | −4.54286045 | −2.19255911 | −0.939531248 | −0.40442617 | 0.427545869 |
| 0.037394649 | 0.15474432 | −2.19255911 | −0.939531248 | −0.204525413 | 0.471115116 |
| 1 | 0.245528623 | 0.455157229 | −0.939531248 | −0.207600809 | 0.380536944 |
| 0.263636311 | −4.54286045 | −2.19255911 | −0.939531248 | −1.72992196 | −2.050168434 |
| 1 | 0.682065908 | 0.557583393 | 1.034394689 | 0.828807731 | 0.838014042 |
| 1 | −0.042276933 | 0.55553487 | 0.775794438 | 0.158371346 | 0.349579848 |
| 1 | 0.025328399 | 0.467448369 | 0.848001002 | −0.524366624 | 0.018224256 |
| 0.26169536 | −4.54286045 | −2.19255911 | −0.939531248 | −7.963750185 | −2.050168434 |
| 0.1799778 | 0.295749727 | 0.267717349 | −0.939531248 | 0.226030064 | 0.467675439 |
| 0.898868481 | −0.18521392 | 0.324051739 | −0.939531248 | −0.023077034 | 0.29339845 |
| 0.042908076 | 0.019533657 | 0.191921987 | −0.939531248 | −0.622779305 | 0.275053503 |
| 0.140898434 | −4.54286045 | 0.204213127 | −0.939531248 | −0.567422172 | 0.123707697 |
| 0.140415448 | 0.293818146 | −2.19255911 | −0.939531248 | −0.699664211 | 0.061793503 |
| 1 | 0.166333806 | 0.135587597 | −0.939531248 | −0.044604807 | 0.459649525 |
| 0.108835219 | −0.378372011 | 0.333270094 | −0.939531248 | −0.604326927 | −2.050168434 |
| 1 | 0.608665834 | 0.370143513 | 0.901736719 | 0.641208763 | 0.750785547 |
| −1 | 0.322791859 | −2.19255911 | 1.066299914 | 0.186049912 | 0.550227697 |
| −1 | 0.025328399 | −2.19255911 | −0.497895756 | 0.026129307 | 0.433278665 |
| −1 | 0.311202374 | 0.387555961 | −0.939531248 | −0.182997639 | 0.5192706 |
| −1 | −0.059661161 | 0.322003216 | 1.020121298 | 0.422855425 | 0.403468127 |
| −1 | 0.403918257 | 0.612893521 | 0.959669292 | 0.468986368 | 0.589210708 |
| −1 | 0.172128548 | 0.145830214 | 0.701908652 | 0.182974516 | 0.491753181 |
| −1 | −0.16396653 | 0.411113978 | −0.939531248 | −0.336767452 | 0.473408235 |
| −1 | 0.336312926 | 0.694834453 | −0.939531248 | 0.819581542 | 0.740556515 |
| −0.27309104 | 1.360050807 | 0.923244798 | 1.68509337 | 2.378807448 | 1.22669759 |
| −1 | 2.101777876 | 1.346264856 | 1.939495565 | 3.255295383 | 1.550027268 |
| −1 | 0.712971203 | 0.404968409 | 0.776634049 | 0.475137161 | −2.050168434 |
| −0.675668601 | 0.382670867 | 0.677422005 | 1.048668079 | 0.579700634 | 0.674056084 |
| −1 | 0.245528623 | 0.403944147 | −0.939531248 | −0.545894398 | −2.050168434 |
| −0.228886868 | 1.516508861 | 0.993918852 | 1.713640151 | 2.252716201 | 1.264534042 |
| −1 | 0.523676274 | 0.505346049 | 0.922726399 | 0.272161008 | 0.602969418 |
| −0.253709663 | 0.53719734 | 0.671276435 | −0.939531248 | 0.186049912 | 0.764634257 |
| −1 | −0.007508476 | −2.19255911 | −0.939531248 | −0.284485716 | 0.336967697 |
| −1 | 0.465728846 | 0.297420936 | −0.939531248 | 0.075335647 | 0.648831783 |
| −1 | 0.206897005 | 0.52480702 | 0.981499183 | 0.066109458 | 0.583477912 |
| −1 | 0.626050062 | 0.583189934 | −0.939531248 | 0.804204561 | 0.654564579 |
| −1 | 0.094865312 | 0.356828111 | 0.968065204 | 0.112240402 | 0.397735331 |
| −1 | 0.04850737 | −2.19255911 | −0.939531248 | −1.041033197 | 0.29339845 |
| −1 | −0.241229766 | −2.19255911 | 0.913490675 | −0.14916828 | 0.136319847 |
| −1 | 0.419370905 | −2.19255911 | −0.939531248 | 0.099938817 | 0.659150816 |
| −1 | 0.228144395 | 0.438769043 | 0.834567222 | 0.413629236 | 0.549081138 |
| −1 | 0.45220778 | 0.585238457 | 0.886623117 | −0.103037336 | 0.838014042 |
| −1 | 0.237802299 | 0.444914613 | −0.939531248 | 0.078411043 | 0.295691568 |

TABLE 17-continued

| | SVM Vectors | | | | |
|---|---|---|---|---|---|
| coefs | ZNF542_1<br>ZNF542 '502 | ZNF471_2<br>ZNF471 '527 | ZNF471_1<br>ZNF471 '558 | ZNF471_3<br>ZNF471 '662 | ZNF132_2<br>ZNF132 '268 |
| 1 | | 0.210023302 | 0.448781467 | 0.381358009 | 0.276869984 | −0.079808848 |
| 1 | | 0.096511033 | −1.701659498 | 0.111027436 | 0.245615084 | 0.220719423 |
| 0.160992568 | 0.011755205 | 0.491015986 | 0.192253523 | 0.011882788 | 0.004011962 |
| 1 | | 0.075322076 | 0.362552655 | 0.179561947 | 0.342097602 | 0.355650484 |
| 1 | | 0.438561338 | 0.531490735 | 0.353436542 | 0.351609963 | 0.275918493 |
| 1 | | 0.322022075 | 0.502454502 | 0.314092655 | 0.193976554 | 0.091921593 |
| 0.539110203 | 0.007214715 | 0.395108431 | 0.091990071 | 0.143696932 | −0.206562268 |
| 1 | | 0.010241709 | 0.604521258 | 0.298862764 | 0.238820541 | 0.200275323 |
| 0.228841426 | 0.010241709 | −1.701659498 | −0.009542539 | −3.291624259 | 0.120543333 |
| 1 | | 0.477912258 | 0.220891037 | 0.146563849 | 0.172234015 | 0.333161974 |
| 1 | | 0.228185265 | 0.381030258 | 0.097066702 | 0.160003836 | 0.380183404 |
| 0.086502196 | 0.116186493 | −1.701659498 | −0.38775151 | −0.122649173 | −0.237228418 |
| 1 | | 0.194888333 | 0.592202857 | 0.357244014 | 0.299971432 | 0.053077803 |
| 0.022981588 | −0.13808099 | −1.701659498 | −0.060308843 | −3.291624259 | −0.186118168 |
| 0.199753156 | 0.15705091 | 0.495415416 | 0.260788035 | 0.227949271 | −0.034831828 |
| 0.640672506 | 0.120726984 | −1.701659498 | 0.215098316 | 0.210283458 | 0.183920043 |
| 0.488436741 | 0.05867361 | −1.701659498 | 0.02853219 | 0.007806062 | −0.341493329 |
| 0.290813367 | 0.063214101 | 0.449661352 | 0.10848912 | 0.248332902 | 0.433338064 |
| 0.93438076 | 0.043538641 | 0.359912998 | 0.034877978 | −0.051985921 | 0.051033393 |
| 1 | | 0.211536799 | −1.701659498 | −0.187224606 | −0.012577568 | 0.482403904 |
| 0.177133374 | 0.264509192 | 0.375750943 | 0.046300397 | −3.291624259 | −7.69E−05 |
| 0.363673626 | 0.073808579 | 0.258726128 | 0.171947002 | −0.049268103 | −0.204517858 |
| 0.372869951 | −3.407234345 | 0.527971191 | 0.279825399 | 0.138261297 | −0.406914449 |
| 0.180416799 | −3.407234345 | −1.701659498 | −0.136458301 | −3.291624259 | −0.406914449 |
| 1 | | 1.345145995 | 1.182606248 | 1.282459921 | 1.285180239 | 1.347189337 |
| 0.236974727 | −3.407234345 | −1.701659498 | −2.980640533 | −0.383559643 | −0.085942078 |
| 0.433173404 | 0.001160727 | 0.382790029 | 0.060261131 | −0.069651734 | −0.110474998 |
| 0.037394649 | −0.468023319 | 0.373111285 | 0.013302299 | −0.008500842 | −0.257672518 |
| 1 | | 0.455209804 | 0.5957224 | 0.409279477 | 0.446733572 | 0.001967552 |
| 0.263636311 | −3.407234345 | −1.701659498 | −2.980640533 | 0.049932232 | −5.066124854 |
| 1 | | 0.721585263 | 0.52181199 | 0.325515074 | 0.344815419 | 0.791109815 |
| 1 | | 0.060187107 | 0.342315281 | 0.10848912 | −0.046550286 | 0.071477493 |
| 1 | | −0.038190193 | 0.419745234 | 0.317900128 | 0.173592923 | −0.413047679 |
| 0.26169536 | −3.407234345 | 0.529730963 | 0.213829203 | −0.096829908 | −0.366026249 |
| 0.1799778 | 0.155537413 | −1.701659498 | −0.034925691 | 0.191258736 | −5.066124854 |
| 0.898868481 | 0.278130664 | 0.655554636 | 0.5463485 | 0.405966311 | −0.192251398 |
| 0.042908076 | 0.079862567 | 0.491895872 | 0.225251622 | 0.179028558 | 0.020367243 |
| 0.140898434 | 0.051106125 | −1.701659498 | −0.243067541 | −3.291624259 | −5.066124854 |
| 0.140415448 | −0.074514119 | −1.701659498 | −2.980640533 | 0.154568201 | −0.304693949 |
| 1 | | 0.128294469 | 0.220011151 | −0.135189143 | 0.202130006 | 0.106232463 |
| 0.108835219 | −3.407234345 | −1.701659498 | −2.980640533 | −3.291624259 | 0.026500473 |
| 1 | | 0.526344159 | −1.701659498 | −0.140265774 | 0.233384926 | 0.603024094 |
| −1 | | 0.368940479 | 0.572845368 | 0.377550536 | 0.036343145 | 0.177786813 |
| −1 | | 0.31445459 | 0.503334388 | 0.298862764 | 0.181746375 | 0.132809793 |
| −1 | | 0.240293241 | 0.61683966 | 0.287440345 | 0.473911746 | 0.378138994 |
| −1 | | 0.134348456 | 0.407426833 | 0.248096459 | 0.279587802 | −0.165674068 |
| −1 | | 0.424939866 | 0.570205711 | 0.39151127 | 0.305407067 | 0.523292104 |
| −1 | | 0.347751522 | 0.558767195 | 0.404202846 | 0.324431789 | 0.210497373 |
| −1 | | 0.325049069 | 0.280723273 | 0.102143332 | 0.295894706 | −0.286294258 |
| −1 | | 0.577803055 | 0.540289593 | 0.434662629 | 0.505166646 | 0.881063855 |
| −0.27309104 | 1.379956424 | 0.847369747 | 0.820486547 | 0.710361859 | 1.046661066 |
| −1 | | 1.806762557 | 1.486166858 | 1.711435198 | 1.720031023 | 2.25286297 |
| −1 | | 0.343211032 | 0.614200002 | 0.400395374 | 0.426349941 | 0.654134345 |
| −0.675668601 | 0.455209804 | 0.547328679 | 0.424509368 | 0.408684128 | 0.776798945 |
| −1 | | −0.012460745 | 0.328237108 | −0.031118218 | −0.007141934 | 0.077610723 |
| −0.228886868 | 1.384496915 | 1.151810244 | 1.269768345 | 1.328665317 | 1.330834057 |
| −1 | | 0.391642933 | 0.754981735 | 0.631382061 | −3.291624259 | 0.118498923 |
| −0.253709663 | 0.741260723 | 1.184366019 | 1.220271198 | 1.031064312 | 0.367916944 |
| −1 | | −0.147161972 | −1.701659498 | −0.187224606 | −0.133520443 | 0.065344263 |
| −1 | | 0.536938638 | 0.610680459 | 0.408010319 | 0.446733572 | 0.425160424 |
| −1 | | 0.188834345 | −1.701659498 | 0.259518877 | 0.237461632 | 0.480359494 |
| −1 | | 0.421912872 | 0.484856786 | 0.344552438 | 0.318996154 | 0.692978135 |
| −1 | | 0.190347842 | 0.604521258 | 0.31663097 | 0.270075441 | −0.024609778 |
| −1 | | 0.060187107 | 0.410946376 | 0.26332635 | 0.282305619 | 0.108276873 |
| −1 | | 0.043538641 | 0.546448794 | 0.279825399 | 0.100211854 | −0.063453568 |
| −1 | | 0.443101829 | 0.402147518 | 0.429585999 | 0.274152167 | 0.055122213 |
| −1 | | 0.446128822 | 0.451421124 | 0.211290888 | 0.308124884 | 0.220719423 |
| −1 | | 0.774557655 | 0.410946376 | 0.221444149 | 0.145055841 | 0.717511055 |
| −1 | | 0.110132505 | 0.549968337 | 0.243019828 | −0.111777904 | 0.273874083 |

TABLE 17-continued

| | SVM Vectors | | | | |
|---|---|---|---|---|---|
| coefs | ZNF132_1<br>ZNF132 '415 | JAM2<br>JAM2 '320 | MCIDAS_1<br>MCIDAS '855 | MCIDAS_2<br>MCIDAS '003 | PDGFD_1<br>PDGFD '388 |
| 1 | 0.238896666 | 0.406419198 | 0.492859834 | 0.416450063 | 0.046762915 |
| 1 | −0.397730773 | −2.423671354 | 0.320276073 | 0.121123394 | −0.124572283 |
| 0.160992568 | −0.170552517 | −2.423671354 | −2.052243039 | 0.091026409 | −0.261640442 |
| 1 | 0.347202579 | 0.464995238 | 0.485753444 | 0.245273459 | 0.426555938 |
| 1 | 0.120024323 | 0.545266109 | 0.761887461 | 0.544362251 | −0.027482338 |
| 1 | 0.006435195 | 0.297945048 | 0.524330991 | 0.190722673 | 0.235231633 |
| 0.539110203 | −0.693590827 | 0.228521593 | 0.262409754 | 0.038356684 | −0.53577676 |
| 1 | −0.550944015 | 0.287097633 | 0.044142056 | −0.183608583 | 0.20382018 |
| 0.228841426 | −0.352823443 | 0.214419954 | 0.199467441 | 0.028951376 | 0.121008168 |
| 1 | 0.299653641 | 0.447639374 | 0.58219731 | 0.501097835 | 0.423700352 |
| 1 | 0.26795435 | 0.317470395 | 0.572045325 | 0.252797705 | 0.266643087 |
| 0.086502196 | −0.487545432 | 0.333741518 | 0.359868819 | 0.213295412 | −0.16169491 |
| 1 | 0.088325031 | 0.395571783 | 0.40961355 | 0.333683353 | 0.126719341 |
| 0.022981588 | −1.155872162 | −2.423671354 | −2.052243039 | 0.019546069 | −0.669989332 |
| 0.199753156 | −0.231309492 | −2.423671354 | 0.225862604 | 0.043999869 | −0.17882843 |
| 0.640672506 | 0.407959554 | 0.378215919 | 0.322076073 | 0.141815072 | 0.152419621 |
| 0.488436741 | −0.410938811 | −0.105578787 | 0.311139286 | −4.590935879 | −0.375863908 |
| 0.290813367 | −0.049038566 | 0.15367443 | −2.052243039 | 0.168149934 | 0.358021859 |
| 0.93438076 | −0.614342598 | 0.187301416 | −0.001541881 | −0.078269134 | −0.624299946 |
| 1 | 0.415884377 | 0.216589437 | 0.588288502 | 0.241511336 | 0.469389738 |
| 0.177133374 | 0.135873968 | 0.230691076 | 0.443115103 | 0.15122038 | 0.132430514 |
| 0.363673626 | −0.025264097 | 0.130894859 | 0.318245676 | 0.072215793 | −0.247362509 |
| 0.372869951 | −0.281500037 | 0.267572287 | 0.200482639 | −0.042528964 | −0.190250776 |
| 0.180416799 | −6.542110115 | 0.37930066 | 0.199467441 | −0.245683615 | −0.435831227 |
| 1 | 1.855560534 | 1.410889819 | 1.44105532 | 1.953277379 | 1.120463492 |
| 0.236974727 | −0.71208208 | −2.423671354 | −2.052243039 | −4.590935879 | −0.344452455 |
| 0.433173404 | 0.104174677 | −0.128358358 | 0.297941704 | −0.078269134 | 0.292343366 |
| 0.037394649 | −0.226026277 | 0.150420206 | −2.052243039 | 0.049643054 | −0.104583177 |
| 1 | −0.424146849 | 0.275165477 | −2.052243039 | 0.072215793 | 0.063896435 |
| 0.263636311 | −6.542110115 | −0.08605344 | −2.052243039 | −0.591798947 | −7.103626036 |
| 1 | 0.69061157 | 0.407503939 | 0.605546878 | 0.314872738 | 1.134741426 |
| 1 | −0.038472135 | 0.309877205 | 0.161905093 | −0.241921492 | 0.295198953 |
| 1 | −0.014697667 | 0.199233573 | 0.256318562 | −0.24004043 | −0.407275361 |
| 0.26169536 | −0.878503361 | 0.122216927 | 0.038050865 | −4.590935879 | −0.415842121 |
| 0.1799778 | −0.125645187 | 0.492113775 | 0.581182112 | 0.352493969 | −7.103626036 |
| 0.898868481 | 0.101533069 | −2.423671354 | 0.41671994 | 0.02142713 | −0.470098267 |
| 0.042908076 | −0.281500037 | −2.423671354 | 0.402507159 | −0.345379879 | −0.235940162 |
| 0.140898434 | −0.532452762 | 0.177538743 | −2.052243039 | −0.040647902 | −0.707111958 |
| 0.140415448 | −0.136211617 | −2.423671354 | 0.160889894 | 0.143696133 | −0.147416977 |
| 1 | 0.006435195 | 0.180792967 | 0.542604565 | 0.326159107 | −0.304474242 |
| 0.108835219 | −0.292066467 | −2.423671354 | 0.051248446 | −0.388644296 | −0.632866706 |
| 1 | 0.574380834 | 0.446554633 | 0.667473992 | 0.599813037 | 0.812060135 |
| −1 | 0.196630944 | 0.384724368 | 0.345656038 | 0.218938597 | 0.363733032 |
| −1 | 0.180781298 | 0.228521593 | 0.117236355 | −0.119652489 | 0.546490577 |
| −1 | 0.471358137 | 0.249131681 | 0.483723047 | −0.149749474 | 0.483667671 |
| −1 | −0.022622489 | 0.469334204 | 0.406567954 | 0.145577195 | −0.007493231 |
| −1 | 0.574380834 | 0.309877205 | 0.617729261 | 0.132409764 | 0.466534151 |
| −1 | 0.030209663 | 0.205742022 | 0.451236692 | −0.003026671 | −0.010348818 |
| −1 | 0.02228484 | 0.213335212 | 0.123327546 | 0.237749213 | 0.078174368 |
| −1 | 0.970621979 | 0.511639122 | 0.606562077 | 0.311110614 | 0.689269909 |
| −0.27309104 | 0.981188409 | 1.000857535 | 1.309079503 | 1.5507302 | 1.465989476 |
| −1 | 2.840880179 | 1.538889315 | 1.185225275 | 1.65795071 | 2.031395631 |
| −1 | 0.574380834 | 0.560452489 | 0.650215616 | 0.561291805 | 0.777793095 |
| −0.675668601 | 1.139684867 | 0.64072336 | 0.720264319 | 0.572578175 | 0.892016561 |
| −1 | −0.178477339 | 0.079912009 | 0.120281951 | 0.008259699 | 0.123863754 |
| −0.228886868 | 1.945375193 | 1.1646535 | 1.014671911 | 1.069178434 | 1.683014061 |
| −1 | 0.064550562 | 0.462825755 | 0.547680558 | 0.290418937 | 0.395144485 |
| −0.253709663 | 0.79099266 | 0.783909237 | 0.578136516 | 0.538719066 | 0.709259016 |
| −1 | −0.276216822 | −2.423671354 | 0.205558632 | −0.010550917 | −0.298763069 |
| −1 | 0.36833544 | 0.443300408 | 0.530422182 | 0.094788532 | 0.400855659 |
| −1 | 0.36833544 | 0.212250471 | 0.372051202 | 0.143696133 | 0.226664874 |
| −1 | 0.761934976 | 0.514893347 | 0.615698864 | 0.350612908 | 0.717825776 |
| −1 | 0.283803995 | 0.427029286 | 0.48169265 | 0.243392397 | 0.149564034 |
| −1 | −0.659249928 | 0.18296245 | 0.281698527 | −0.371714741 | 0.118152581 |
| −1 | −0.241875922 | 0.190555641 | 0.327382464 | −0.001145609 | −0.116005524 |
| −1 | 0.149082006 | 0.290351858 | 0.572045325 | 0.388234139 | 0.452256218 |
| −1 | 0.347202579 | 0.420520837 | 0.494890231 | 0.164387811 | 0.466534151 |
| −1 | 1.055153423 | 0.579977836 | 0.862392122 | 0.811472996 | 0.186686661 |
| −1 | −0.123003579 | −2.423671354 | 0.184239462 | 0.29418106 | 0.443689458 |

TABLE 17-continued

| | SVM Vectors | | | | |
|---|---|---|---|---|---|
| coefs | PDGFD_2<br>PDGFD '921 | ST6GALNAC5<br>ST6GALNAC5 '456 | ZNF492_1<br>ZNF492 '069 | CNRIP1_1<br>CNRIP1 '272 | LONRF2_1<br>LONRF2 '281 |
| 1 | 1.302789852 | 0.466406944 | −0.240707793 | −0.064165795 | 0.182108844 |
| 1 | −0.682617737 | 0.569041467 | −0.17761095 | −0.307307386 | −0.063816882 |
| 0.160992568 | −0.682617737 | 0.705281983 | −0.150569446 | 0.093547669 | −0.189987472 |
| 1 | −0.682617737 | 0.569041467 | 0.176933218 | 0.189928119 | 0.325387311 |
| 1 | 1.475318586 | 0.828806718 | −0.132541776 | 0.498783653 | 0.197078236 |
| 1 | −0.682617737 | −1.277471664 | 0.08679487 | 0.38268902 | 0.201355206 |
| 0.539110203 | −0.682617737 | −1.277471664 | −0.210661677 | 0.019071866 | 0.100846431 |
| 1 | −0.682617737 | 0.367405503 | 0.056748754 | −0.149593922 | 0.090154008 |
| 0.228841426 | −0.682617737 | 0.246605578 | 0.194960887 | 0.161452077 | −0.098032635 |
| 1 | 1.096640133 | 0.76522781 | 0.480398989 | 0.178975795 | 0.534958799 |
| 1 | −0.682617737 | 0.792475913 | 0.065762589 | 0.119833246 | 0.338218218 |
| 0.086502196 | 1.281555546 | −1.277471664 | −0.327841529 | −0.079499049 | −0.207095348 |
| 1 | −0.682617737 | 0.638978265 | 0.149891714 | 0.369546231 | 0.333941249 |
| 0.022981588 | −0.682617737 | −1.277471664 | −0.360892257 | −3.744146627 | −0.585607118 |
| 0.199753156 | −0.682617737 | −1.277471664 | −0.162587892 | −0.042261148 | −5.029378066 |
| 0.640672506 | −0.682617737 | 0.586298599 | 0.23702545 | −0.07073719 | −0.22634171 |
| 0.488436741 | 1.209005001 | −1.277471664 | 0.017688804 | −0.348926217 | −0.160048688 |
| 0.290813367 | −0.682617737 | 0.638069995 | 0.110831763 | −0.007213711 | 0.165000968 |
| 0.93438076 | 1.368262294 | 0.469131755 | −0.57421968 | −0.379592724 | −0.014631737 |
| 1 | −0.682617737 | −1.277471664 | 0.423311368 | 0.316975076 | 0.498604562 |
| 0.177133374 | −0.682617737 | 0.554509145 | 0.243034673 | 0.222785091 | 0.154308545 |
| 0.363673626 | −0.682617737 | 0.566316656 | −0.369906092 | −0.186831823 | −0.068093851 |
| 0.372869951 | −0.682617737 | −1.277471664 | −0.231693959 | −0.06635626 | −0.435913198 |
| 0.180416799 | −0.682617737 | −1.277471664 | −1.154109717 | −2.41672497 | −0.136525357 |
| 1 | −0.682617737 | 1.508192759 | 1.468916202 | 2.071537366 | 0.917747538 |
| 0.236974727 | −0.682617737 | −1.277471664 | −0.330846141 | −4.848140877 | −5.029378066 |
| 0.433173404 | −0.682617737 | 0.542701634 | 0.056748754 | −0.243783907 | 0.263371258 |
| 0.037394649 | −0.682617737 | −1.277471664 | 0.149891714 | −0.362069006 | −0.068093851 |
| 1 | −0.682617737 | 0.620812863 | 0.336177632 | 0.045357444 | −0.311881093 |
| 0.263636311 | −0.682617737 | −1.277471664 | −7.154319065 | −0.734448018 | −5.029378066 |
| 1 | 1.438158551 | −1.277471664 | 1.072307472 | 0.660878047 | 0.791576948 |
| 1 | 1.220506917 | 0.624445943 | 0.131864044 | −0.048832542 | −0.016770221 |
| 1 | −0.682617737 | 0.609913622 | −0.204652454 | −0.160546246 | −0.269111401 |
| 0.26169536 | −0.682617737 | −1.277471664 | −7.154319065 | 0.207451837 | −5.029378066 |
| 0.1799778 | −0.682617737 | −1.277471664 | 0.534481997 | 0.062881162 | 0.607667275 |
| 0.898868481 | −0.682617737 | 0.698015822 | −0.021371147 | 0.268784851 | −0.040293551 |
| 0.042908076 | −0.682617737 | −1.277471664 | −0.339859976 | −0.567972695 | −0.326850485 |
| 0.140898434 | −0.682617737 | −1.277471664 | −0.571215068 | −0.537306188 | −0.442328652 |
| 0.140415448 | −0.682617737 | −1.277471664 | −0.144560222 | −3.146149742 | 0.111538853 |
| 1 | −0.682617737 | −1.277471664 | −0.021371147 | 0.178975795 | 0.505020015 |
| 0.108835219 | −0.682617737 | −1.277471664 | −0.318827695 | −4.848140877 | −0.463713497 |
| 1 | −0.682617737 | −1.277471664 | 0.429320592 | 0.560116667 | 0.757361195 |
| −1 | 1.29571175 | −1.277471664 | 0.092804093 | −0.136451133 | 0.107261884 |
| −1 | −0.682617737 | 0.76613608 | 0.393265253 | −0.094832302 | 0.220601567 |
| −1 | −0.682617737 | −1.277471664 | 0.324159186 | 0.260022992 | 0.415203663 |
| −1 | 1.442582365 | 0.811549586 | −0.108504883 | 0.424307851 | 0.248401866 |
| −1 | −0.682617737 | 0.770677431 | 0.579551171 | 0.380498555 | 0.637606059 |
| −1 | 1.147071609 | −1.277471664 | −0.084467991 | −0.241593443 | 0.094430977 |
| −1 | −0.682617737 | 0.633528644 | 0.342186855 | 0.216213697 | 0.081600069 |
| −1 | −0.682617737 | 0.821540557 | 0.792878594 | 0.619259216 | 0.872839362 |
| −0.27309104 | 2.042451502 | 1.427356719 | 1.264602614 | 1.732015325 | 1.51224625 |
| −1 | −0.682617737 | 1.5981115 | 2.0127509 | 2.529344505 | 2.128129808 |
| −1 | 1.308983191 | 0.435525761 | 0.480398989 | 0.316975076 | 0.733837865 |
| −0.675668601 | −0.682617737 | 0.837889419 | 0.726777139 | 0.551354808 | 0.63332909 |
| −1 | −0.682617737 | −1.277471664 | 0.083790259 | −0.06635626 | −0.040293551 |
| −0.228886868 | 1.923893295 | 1.317456036 | 1.381782466 | 1.839348099 | 1.349721423 |
| −1 | −0.682617737 | 0.856963091 | 0.315145351 | 0.343260654 | 0.259094289 |
| −0.253709663 | 1.235547883 | 1.01500209 | 0.964141455 | 1.026685666 | 0.729560896 |
| −1 | 1.354106091 | −1.277471664 | −0.048412651 | −0.099213232 | −0.076647789 |
| −1 | −0.682617737 | 0.617179782 | 0.393265253 | 0.303832288 | 0.505020015 |
| −1 | 1.269168867 | 0.629895564 | 0.342186855 | 0.481259935 | 0.421619117 |
| −1 | 1.248819324 | 0.831531528 | 0.315145351 | 0.308213217 | 0.673960297 |
| −1 | 1.336410836 | 0.788842833 | −0.168597115 | 0.371736696 | 0.188524298 |
| −1 | 1.133800168 | 0.567224926 | −0.126532553 | −0.134260668 | −0.001800829 |
| −1 | −0.682617737 | −1.277471664 | −0.105500272 | −0.090451373 | 0.216324598 |
| −1 | −0.682617737 | 0.717997765 | 0.390260641 | 0.411165062 | 0.513573954 |
| −1 | −0.682617737 | 0.735254897 | 0.231016227 | 0.384879485 | 0.541374253 |
| −1 | −0.682617737 | 1.01681863 | 0.231016227 | 1.147161228 | 0.703899081 |
| −1 | 1.284209834 | −1.277471664 | 0.158905548 | −0.103594161 | −0.574914695 |

TABLE 17-continued

| | SVM Vectors | | | | |
|---|---|---|---|---|---|
| coefs | LONRF2_2 LONRF2 '387 | ADAMTS2_2 ADAMTS2 '254 | ADAMTS2_1 ADAMTS2 '284 | ADAMTS2_3 ADAMTS2 '328 | ALK ALK '434 |
| 1 | 0.816278101 | −1.226540092 | 0.479237716 | 0.308464228 | 1.224961864 |
| 1 | 0.707526931 | 0.608032885 | 0.377972809 | 0.108720604 | −0.67135809 |
| 0.160992568 | −1.17952336 | −1.226540092 | −1.402761026 | −3.569757964 | −0.67135809 |
| 1 | 0.644016248 | 0.715511247 | 0.413319994 | 0.342021157 | −0.67135809 |
| 1 | 1.028560383 | 0.889956898 | 0.805960341 | 0.757487893 | −0.67135809 |
| 1 | 0.704916903 | 0.774210969 | 0.512674242 | 0.359598595 | −0.67135809 |
| 0.539110203 | −1.17952336 | 0.74444773 | 0.34931293 | −0.159734825 | −0.67135809 |
| 1 | −1.17952336 | −1.226540092 | −1.344485938 | −0.001537876 | 1.290071562 |
| 0.228841426 | −1.17952336 | 0.651850986 | 0.265243951 | 0.155061125 | −0.67135809 |
| 1 | 0.849338456 | 0.647717203 | 0.611073161 | 0.319649871 | 1.311232214 |
| 1 | 0.788437801 | 0.675826929 | 0.455354484 | 0.27330935 | −0.67135809 |
| 0.086502196 | 0.548315219 | −1.226540092 | 0.357910894 | 0.155061125 | 1.30146576 |
| 1 | 0.564845397 | 0.690708548 | −1.172526662 | 0.340423208 | 1.271352524 |
| 0.022981588 | −1.17952336 | −1.226540092 | −1.818329276 | −0.437777949 | −0.67135809 |
| 0.199753156 | 0.650976323 | 0.717164761 | 0.579547294 | 0.310062177 | −0.67135809 |
| 0.640672506 | −1.17952336 | 0.763463132 | 0.44458019 | 0.290886789 | −0.67135809 |
| 0.488436741 | −1.17952336 | 0.617127208 | 0.287216525 | −0.153343029 | −0.67135809 |
| 0.290813367 | 0.570935463 | 0.735353407 | 0.491656997 | 0.316453973 | −0.67135809 |
| 0.93438076 | −1.17952336 | 0.666732606 | 0.444845861 | 0.169442666 | −0.67135809 |
| 1 | −0.840219712 | 0.793226371 | 0.47350574 | 0.389959626 | −0.67135809 |
| 0.177133374 | −1.17952336 | −1.226540092 | 0.355044906 | 0.129493941 | −0.67135809 |
| 0.363673626 | 0.538745116 | −1.226540092 | 0.304412453 | −0.142157387 | −0.67135809 |
| 0.372869951 | −1.17952336 | −1.226540092 | 0.354089577 | 0.111916502 | −0.67135809 |
| 0.180416799 | 0.499594695 | −1.226540092 | −1.818329276 | −3.569757964 | −0.67135809 |
| 1 | 0.880658793 | 1.437269791 | 1.395398525 | 1.705071643 | 1.21519541 |
| 0.236974727 | −1.17952336 | −1.226540092 | −1.818329276 | −3.569757964 | −0.67135809 |
| 0.433173404 | −1.17952336 | −1.226540092 | 0.347402271 | 0.057586237 | −0.67135809 |
| 0.037394649 | −1.17952336 | −1.226540092 | −1.818329276 | −3.569757964 | −0.67135809 |
| 1 | −1.17952336 | 0.671693146 | 0.532736158 | −0.081435325 | −0.67135809 |
| 0.263636311 | −1.17952336 | −1.226540092 | −1.818329276 | −3.569757964 | −0.67135809 |
| 1 | 0.846728428 | 0.660118553 | 0.491656997 | 0.417124759 | 1.282746721 |
| 1 | 0.650106314 | −1.226540092 | 0.401856042 | −0.322725622 | −0.67135809 |
| 1 | 0.640536211 | −1.226540092 | 0.567128013 | 0.254133962 | −0.67135809 |
| 0.26169536 | 0.519604911 | −1.226540092 | 0.536557475 | 0.284494993 | −0.67135809 |
| 0.1799778 | 0.525694976 | 0.613820181 | 0.533691487 | 0.266917554 | −0.67135809 |
| 0.898868481 | −1.17952336 | 0.719645031 | 0.407588018 | −0.172518417 | 1.353553518 |
| 0.042908076 | 0.605735837 | 0.541065597 | 0.508852925 | 0.28928884 | −0.67135809 |
| 0.140898434 | −1.17952336 | −1.226540092 | −1.818329276 | −3.569757964 | −0.67135809 |
| 0.140415448 | −1.17952336 | −1.226540092 | −1.818329276 | −0.332313316 | −0.67135809 |
| 1 | 0.771037614 | −1.226540092 | 0.249958682 | −0.099012764 | −0.67135809 |
| 0.108835219 | 0.456094228 | 0.611339911 | −1.818329276 | −0.242828173 | −0.67135809 |
| 1 | 0.865868634 | −1.226540092 | 0.373196163 | 0.410732963 | −0.67135809 |
| −1 | −1.17952336 | 0.717991517 | 0.575725977 | 0.27330935 | 1.293327047 |
| −1 | −0.466985698 | 0.596458292 | 0.295814489 | 0.17903036 | −0.67135809 |
| −1 | 0.741457296 | 0.675000172 | 0.399945384 | 0.287690891 | −0.67135809 |
| −1 | 0.838898344 | 0.763463132 | 0.587189928 | 0.35160885 | −0.67135809 |
| −1 | 0.764077539 | 0.795706641 | 0.609162503 | 0.4315063 | −0.67135809 |
| −1 | 0.920679223 | −1.226540092 | 0.530825499 | 0.139081635 | 1.257516713 |
| −1 | −1.17952336 | 0.608859641 | 0.236584071 | 0.044802645 | −0.67135809 |
| −1 | 0.706656922 | 0.8155488 | 0.656928968 | 0.760683791 | 1.349484162 |
| −0.27309104 | 1.371344069 | 1.329791428 | 1.262607751 | 1.433420315 | 1.942796285 |
| −1 | 1.875079486 | 1.591046526 | 1.560670496 | 2.013475797 | 2.200793463 |
| −1 | 0.539615126 | 0.697322601 | 0.524138194 | 0.247742166 | −0.67135809 |
| −0.675668601 | 0.845858419 | 0.760982862 | 0.572859989 | 0.501816055 | 1.410524504 |
| −1 | −1.17952336 | 0.765943402 | 0.286261196 | −0.031898906 | 1.241239289 |
| −0.228886868 | 1.433114734 | 1.358727911 | 1.26451841 | 1.481358784 | 1.862223034 |
| −1 | 0.513514845 | 0.884996358 | 0.706606092 | 0.567331964 | 1.322626411 |
| −0.253709663 | 1.074670879 | 0.993301477 | 0.790675072 | 0.69996173 | 1.619689409 |
| −1 | −1.17952336 | 0.583230186 | 0.338804308 | 0.166246768 | −0.67135809 |
| −1 | 0.977229831 | 0.713030978 | 0.603430527 | 0.370784238 | −0.67135809 |
| −1 | 0.684036679 | 0.742794216 | 0.471595082 | 0.263721656 | −0.67135809 |
| −1 | 0.950259541 | 0.777517995 | 0.650241663 | 0.568929913 | 1.333206737 |
| −1 | 0.843248701 | 0.738660433 | 0.582413282 | 0.319649871 | −0.67135809 |
| −1 | −1.17952336 | −1.226540092 | 0.244226706 | −0.234838428 | −0.67135809 |
| −1 | 0.717097034 | −1.226540092 | 0.458220472 | 0.107122655 | −0.67135809 |
| −1 | 0.689256735 | −1.226540092 | 0.342625625 | 0.242948319 | −0.67135809 |
| −1 | 0.864128615 | 0.785785562 | 0.597698551 | 0.452279637 | −0.67135809 |
| −1 | 1.023340327 | −1.226540092 | 0.275752573 | 0.006451869 | 1.64085006 |
| −1 | −1.17952336 | 0.702283141 | 0.516495559 | 0.334031412 | −0.67135809 |

TABLE 17-continued

| | SVM Vectors | | |
|---|---|---|---|
| coefs | FGF14<br>FGF14 '577 | DMRT1<br>DMRT1 '934 | CNRIP1_2<br>CNRIP1 '232 |
| 1 | 0.955300844 | 1.131612847 | 0.296394201 |
| 1 | −0.93950462 | −0.701307401 | 0.101966839 |
| 0.160992568 | 0.846924723 | −0.701307401 | −2.336804129 |
| 1 | −0.93950462 | −0.701307401 | 0.230086604 |
| 1 | 1.296419127 | 1.516680127 | 0.443619546 |
| 1 | 0.974844079 | −0.701307401 | 0.407656103 |
| 0.539110203 | −0.93950462 | 1.17300758 | 0.203114022 |
| 1 | −0.93950462 | −0.701307401 | 0.261554616 |
| 0.228841426 | −0.93950462 | 1.199962289 | 0.268297762 |
| 1 | −0.93950462 | −0.701307401 | 0.368321087 |
| 1 | 0.734106957 | −0.701307401 | 0.228962746 |
| 0.086502196 | 0.761645152 | −0.701307401 | 0.236829749 |
| 1 | −0.93950462 | −0.701307401 | 0.536899725 |
| 0.022981588 | −0.93950462 | −0.701307401 | −2.336804129 |
| 0.199753156 | 0.771416769 | −0.701307401 | 0.216600313 |
| 0.640672506 | 0.814944884 | −0.701307401 | 0.384055093 |
| 0.488436741 | −0.93950462 | −0.701307401 | 0.073870399 |
| 0.290813367 | −0.93950462 | −0.701307401 | 0.268297762 |
| 0.93438076 | −0.93950462 | −0.701307401 | 0.027792238 |
| 1 | 0.960630817 | −0.701307401 | 0.3997891 |
| 0.177133374 | −0.93950462 | −0.701307401 | 0.092975978 |
| 0.363673626 | 0.769640112 | −0.701307401 | 0.317747496 |
| 0.372869951 | −0.93950462 | −0.701307401 | 0.225591173 |
| 0.180416799 | −0.93950462 | 1.108508811 | −2.336804129 |
| 1 | 1.728146955 | 1.533045486 | 1.467453809 |
| 0.236974727 | −0.93950462 | −0.701307401 | −2.336804129 |
| 0.433173404 | −0.93950462 | −0.701307401 | 0.284031768 |
| 0.037394649 | −0.93950462 | −0.701307401 | −2.336804129 |
| 1 | 0.834488119 | −0.701307401 | 0.25031604 |
| 0.263636311 | −0.93950462 | −0.701307401 | −2.336804129 |
| 1 | 0.798066635 | −0.701307401 | 0.540271298 |
| 1 | −0.93950462 | −0.701307401 | −0.045258506 |
| 1 | 0.853143025 | 1.17300758 | −2.336804129 |
| 0.26169536 | −0.93950462 | −0.701307401 | 0.450362691 |
| 0.1799778 | −0.93950462 | 1.108508811 | 0.412151533 |
| 0.898868481 | −0.93950462 | −0.701307401 | 0.412151533 |
| 0.042908076 | −0.93950462 | −0.701307401 | 0.205361737 |
| 0.140898434 | −0.93950462 | −0.701307401 | −2.336804129 |
| 0.140415448 | 0.748320219 | −0.701307401 | −2.336804129 |
| 1 | 0.726111997 | −0.701307401 | 0.384055093 |
| 0.108835219 | −0.93950462 | −0.701307401 | −2.336804129 |
| 1 | −0.93950462 | 1.12487417 | 0.598711893 |
| −1 | 0.830046474 | −0.701307401 | 0.314375923 |
| −1 | −0.93950462 | −0.701307401 | 0.078365829 |
| −1 | −0.93950462 | −0.701307401 | 0.552633732 |
| −1 | 0.867356287 | 1.072890087 | 0.532404295 |
| −1 | 1.115200039 | −0.701307401 | 0.452610406 |
| −1 | 0.632837467 | 1.202850294 | 0.307632777 |
| −1 | 0.974844079 | −0.701307401 | 0.05476482 |
| −1 | 0.946417555 | −0.701307401 | 0.585225602 |
| −0.27309104 | 1.777893371 | 2.092355709 | 1.213461994 |
| −1 | 1.891599465 | 2.29451603 | 1.66750046 |
| −1 | 0.822939843 | −0.701307401 | −2.336804129 |
| −0.675668601 | 0.790071676 | −0.701307401 | 0.593092605 |
| −1 | −0.93950462 | −0.701307401 | 0.252563755 |
| −0.228886868 | 1.602004256 | 1.983574202 | 1.266283301 |
| −1 | 1.124971657 | 1.209588971 | 0.542519013 |
| −0.253709663 | 1.057458663 | −0.701307401 | 0.829102699 |
| −1 | 1.010377234 | −0.701307401 | 0.017677519 |
| −1 | 0.846924723 | 1.254834377 | 0.354834796 |
| −1 | 1.049463703 | 1.121023497 | 0.557129162 |
| −1 | −0.93950462 | −0.701307401 | 0.488573849 |
| −1 | 0.948194213 | 0.985287281 | 0.479582988 |
| −1 | −0.93950462 | −0.701307401 | −2.336804129 |
| −1 | −0.93950462 | −0.701307401 | 0.325614499 |
| −1 | 0.225094519 | −0.701307401 | 0.389674381 |
| −1 | 0.870909602 | 1.213439644 | 0.285155626 |
| −1 | −0.93950462 | 1.568664209 | 0.829102699 |
| −1 | −0.93950462 | −0.701307401 | 0.224467316 |

Example 5. Various Individual Methylation Biomarkers are Each Highly Informative Evaluation of the performance of individual colorectal cancer DMRs from among the 28 colorectal cancer DMR panel reveal that various individual colorectal cancer DMRs are sufficient for screening of colorectal cancer (See FIGS. 12-19). For selected colorectal cancer DMRs, FIGS. 12-19 show methylation status of the indicated DMR in colorectal cancer samples and control samples. Results are displayed as the MSRE-qPCR Ct value subtracted from 45 (i.e., 45—Ct value) for display purposes. Data provided in this Example, as well as data provided by the present Examples cumulatively (including, e.g., FIGS. 5-9), demonstrate that for each individual colorectal cancer DMR the methylation status signal is sufficiently stable across subject groups to permit clinical screening. Results presented in FIGS. 12-19 therefore confirm that methylation markers of colorectal cancer provided herein can provide a robust signal for screening of colorectal cancer. Moreover, those of skill in the art will appreciate that the present disclosure provides methylation biomarkers that are individually independently useful in screening for colorectal cancer, and specifically that methylation biomarkers provided herein are useful both individually or in combination.

SEQUENCES
(ZNF132) (see Table 1)
SEQ ID NO: 1
>ZNF132 chr19, bp 58439728 to 58440994 of hg38

(DMRT1) (see Table 1)
SEQ ID NO: 2
>DMRT1 chr9, bp 841340 to 968090 of hg38

(ALK) (see Table 1)
SEQ ID NO: 3
>ALK chr2, bp 29193215 to 29922286 of hg38

(JAM2) (see Table 1)
SEQ ID NO: 4
>JAM2 chr21, bp 25637848 to 25714704 of hg38

(FGF14) (see Table 1)
SEQ ID NO: 5
>FGF14 chr13, bp 101919879 to 102403137 of hg38

(MCIDAS) (see Table 1)
SEQ ID NO: 6
>MCIDAS chr5, bp 55220951 to 55221051 of hg38

(ST6GALNAC5) (see Table 1)
SEQ ID NO: 7
>ST6GALNAC5chr1, bp 76866255 to 77063388 of hg38

(LONRF2) (see Table 1)
SEQ ID NO: 8
>LONRF2 chr2, bp 100285667 to 100323015 of hg38

(PDGFD) (see Table 1)
SEQ ID NO: 9
>PDGFD chr11, bp 104163499 to 104164026 of hg38

(GSG1L) (see Table 1)
SEQ ID NO: 10
>GSG1L chr16, bp 27920615 to 28064275 of hg38

(ZNF492) (see Table 1)
SEQ ID NO: 11
>ZNF492 chr19, bp 22633051 to 22666433 of hg38

(ZNF568) (see Table 1)
SEQ ID NO: 12
>ZNF568 chr19, bp 36916312 to 36943940 of hg38

(ADAMTS2) (see Table 1)
SEQ ID NO: 13
>ADAMTS2 chr5, bp 179118114 to 179344392 of hg38

(ZNF542) (see Table 1)
SEQ ID NO: 14
>ZNF542 chr19, bp 56367838 to 56370986 of hg38

(ZNF471) (see Table 1)
SEQ ID NO: 15
>ZNF471 chr19, bp 56507245 to 56508589 of hg38

(CNRIP1) (see Table 1)
SEQ ID NO: 16
>CNRIP1 chr2, bp 68293114 to 68320928 of hg38

(see Table 7)
SEQ ID NO: 17
CCTCCTCACCCATCATCAGCGCCCGCGGCTTTGGGTGGCCGACCAGAGGG

CGGCCGGAAAGCACCTCGGTGCCCCGCGACCCTCCGAACAGAGGCGGCGG

GAGGTACC (see Table 7)
SEQ ID NO: 18
GCGTGCTGGGTTTAATCTTCACCTCAACCTTGTAGGAGGAGCCGGTGAGC

AGCTTGATGGTGCGGTTCTGGCCGAAGCGCTGCCCGTCCACCTTGTAAAA

GACCGGGCCGT (see Table 7)
SEQ ID NO: 19
AGGAAGCAAAGTGACCCCTAAGCCTAGACAAAGCTCTCGAAAGCCCAAAG

CCTCGGGCCCACCGGCCAGCTCCCCACCCCGCTGCTGGGCCGGACAGGTG

TAGGGGAGGCGGACC (see Table 7)
SEQ ID NO: 20
CTCTCAGTCCCGCCGGCTTAGGTAACCCAGGTCGCTGCGGTAACGCAGTG

ACCGCGCTCCAGGTCCGCGTCTCTTGC (see Table 7)
SEQ ID NO: 21
CCACTGCGAAGGGAAGGGGCATTCCGCCAGGCGACCCCAGAAGCCAGCCT

GCACCTCCCCGGCTTTCCTGCAACCGGGAAGGGGCGTTAACAGGG (see Table 7)
SEQ ID NO: 22
GCGACCCCAGAAGCCAGCCTGCACCTCCCCGGCTTTCCTGCAACCGGGAA

GGGGCGTTAACAGGGCCACCACTCCGGGGCTCCGCCACTCCCCAGCCGTT (see Table 7)
SEQ ID NO: 23
CAACGGAAACTTCCCGCGCTACGGCGGCTCCAACGGGCCGCTTCCGCCGC

ATTGCGTAGCGAAGCCCCCGGCGAG (see Table 7)
SEQ ID NO: 24
CAAAGCGTCTGGGGCGCTAGTGGGGCGGCCAGCGGCTCGAGCGCCGGGG

GCAGCAGCAGAGGAGGCGGCTCCGGCTCCGGGGCGTCGGACCTGGGTGCC

GGGAGCAAGAAGT (see Table 7)
SEQ ID NO: 25
CGCTCAGCCGCTCTCCTCTTCTCTCTCCCGCCCGCCCGCAGCGCCATGGT

CTGGCAGTGTGTTTAGCGCT (see Table 7)

SEQ ID NO: 26
GGGTTCGGAGCGTGCAAAAGGTGACCTAGGCGCGCTACGCACCACGCACT
CAGCGGTACTCTCCTCTCCCGGGCCCCACGGGTCCCGATGCTGGGCGGG
GATGCACTGAACTGTTC (see Table 7)

SEQ ID NO: 27
GCGCCCCACTTACATCCAGCACCGAGGCCAGGTGCCGGGTTCGGCTGGCG
AGTTCCTTCAGCTGCACGTTCCGCTCCTTGAGCGAGGCGATCTCCTCCTG
TTTCTGGGTCAATGTCACGT (see Table 7)

SEQ ID NO: 28
AACGTCTATCACCCAGGGAAAGCTACTCTTGACTCCTTCCACCTATCAAA
ATTGCCTAAGAAAGGTTGAGTCTGACCAAGGGGCGGCGCAGCTTGCAACT
TTCGCCAACTCCGGGA (see Table 7)

SEQ ID NO: 29
GGTGCATTTGGGATCAGCGACTAGAGACAGCGTCGCTCCAAGAAAAAGCC
GGGTTCTGCTCCCGGGACCGACGCCGCGCCGCCCTGCGCTCTCGCCGCCT
GCGCTCGCCCTGCGCTGGCCCGGGTCGCTGTGCTAATC (see Table 7)

SEQ ID NO: 30
CCGAAAGAAATCCGAGCCAGGGTGAGGGTCTGAGACGCAAGGAGAATCCC
AGGCAAGGCGCTCCTGAGAAAAGATCCCCACGGCGGACGTGGGGCAACAA
AACC (see Table 7)

SEQ ID NO: 31
CGAGAGAGGGGAAGGGGCTGGTTGGAACCGGTGGCAAGAGGCTGTGGCGG
GACTCAGGCCTCCCCGCAGTCGGCTCCACAATCTGCGCCCCAAGTTCG (see Table 7)

SEQ ID NO: 32
GCCCAAGCCTCACCCTCACACAGGAAAGCAGATGTGTTCTGGCCGGAAGT
TGAGTGGGGCCGCGGGCCTGCTGGGAGGTGTTGTCCTCGGAAACGTCGC
TGGCGCGGAGGGATGGTTCG (see Table 7)

SEQ ID NO: 33
GGTCGCCTTCACCCAGCATCTCAGAAACTGCGCGCGGGATGAACATTCGG
GTGTTTCCGGCAGGTGACGCTG (see Table 7)

SEQ ID NO: 34
CCAGAGGCCCAGGGATCCGTTCAGGTCAGCGCTGGCGTCCGGGCCTGAGT
TTGGAGGTGGCGGGTGCCTTACAAGAATGCTCGCGT (see Table 7)

SEQ ID NO: 35
GGGAGGAGTGGGCGGCTGAATGGCCAGAGGCCCAGGGATCCGTTCAGGTC
AGCGCTGGCGTCCGGGCCTGAGTTTGGAGGTGGCGGGTGC (see Table 7)

SEQ ID NO: 36
CCCCACGCGTACTCACACCGAAGGCTCAGCCGTCGCGCGTTTCCCTCCCA
GGCCCCAGGAACTAGTAACTAGGGACGCTTCTGGTCTCTAGGCGAGGAGA
GGGGGAGAGCGCAATCTTTGCGCCTGCGCACACTCCTGCTCTTACCCGC (see Table 7)

SEQ ID NO: 37
GTCGCGCGTTTCCCTCCCAGGCCCCAGGAACTAGTAACTAGGGACGCTTC
TGGTCTCTAGGCGAGGAGAGGGGGAGAGCGCAATCTTTGCGCCTGCGCAC
ACTCCTGCTCTTACCCGC (see Table 7)

SEQ ID NO: 38
CTGCTCTTACCCGCCGGAACCCTGGGCCACGCCCGGCTCGCGTAATCACG
CACTGCGCAGGCACCGCCCGCTCTGCTCTAAGGTCCCTC (see Table 7)

SEQ ID NO: 39
CTACTGCTAGGTCGTTGCCAAGGTGATTGAGGAATGGCGTTTATTGCGTC
GCTGCTCAGGCAACGCAAACTACATTATCCAGAAGGACCCTCGCGGTGCC
TCAGGGCTGGCCATTGGCAGCCGAGGAGACAGGCACTTCCGGGCGGAGTG
TAAGACGCTGGCCAATCA (see Table 7)

SEQ ID NO: 40
GTGTAAGACGCTGGCCAATCACAGCCTGGCAGCGGGACTTCCGTCGTCGT
CCTCGGACCATCACTTTGGCATTTCTCGATTTTGTCTGCTTCTGAAGGGA
CCGCGTTGT (see Table 7)

SEQ ID NO: 41
CCGCGTGGTCTGGGCTCTGTAGCGTCCCAGCTGAGCCGGCGATATGCAGC
GCACTTGTGGGCGGAGGTGGAGGGAATTC (see Table 7)

SEQ ID NO: 42
CAACGTTAAAGGCAAACACCTTCTGCGGTGTGCTTGGCTCAGCTCAGGCA
GGAAGCCCTGCCTGAAAAGGCTGCACCTTCGGCTGTCACTCTGTCCTCAT
TCGGCC (see Table 7)

SEQ ID NO: 43
GCCGGTGAGCAGCTTGATGGTGCGGTTCTGGCCGAAGCGCTGCCCGTCCA
CCTTGTAAAAGACCGGGCCGT (see Table 7)

SEQ ID NO: 44
CGGGAAGGGGCGTTAACAGGGCCACCACTCCGGGGCTCCGCCACTCCCCA
GCCGTTCCCTCCTCCGGAGACCTTGCCTGCCAAGA (see Table 13)

SEQ ID NO: 45
CCTCCTCACCCATCATCAGCGCCC (see Table 13)

SEQ ID NO: 46
GGTACCTCCCGCCGCCTCTGTTC (see Table 13)

SEQ ID NO: 47
GCGTGCTGGGTTTAATCTTCACCTCAA (see Table 13)

SEQ ID NO: 48
ACGGCCCGGTCTTTTACAAGGTGG (see Table 13)

SEQ ID NO: 49
AGGAAGCAAAGTGACCCCTAAGCCT (see Table 13)

SEQ ID NO: 50
GGTCCGCCTCCCCTACACCT

-continued (see Table 13)
CTCTCAGTCCCGCCGGCTTAGGTA (see Table 13)
GCAAGAGACGCGGACCTGGAGC (see Table 13)
CCACTGCGAAGGGAAGGGGCA (see Table 13)
CCCTGTTAACGCCCCTTCCCGGTT (see Table 13)
GCGACCCCAGAAGCCAGCCT (see Table 13)
AACGGCTGGGGAGTGGCGGA (see Table 13)
CAACGGAAACTTCCCGCGCTAC (see Table 13)
CTCGCCGGGGCTTCGCTAC (see Table 13)
CAAAGCGTCTGGGGCGCTAGT (see Table 13)
ACTTCTTGCTCCCGGCACCCAGGTC (see Table 13)
CGCTCAGCCGCTCTCCTCTTCTCT (see Table 13)
AGCGCTAAACACACTGCCAGACCA (see Table 13)
GGGTTCGGAGCGTGCAAAAGGTGA (see Table 13)
GAACAGTTCAGTGCATCCCCGCCC (see Table 13)
GCGCCCCACTTACATCCAGCACC (see Table 13)
ACGTGACATTGACCCAGAAACAGGAGGA (see Table 13)
AACGTCTATCACCCAGGGAAAGCT (see Table 13)
TCCCGGAGTTGGCGAAAGTTGCAA (see Table 13)
GGTGCATTTGGGATCAGCGACTAGAGAC (see Table 13)
GATTAGCACAGCGACCCGGGCCAG (see Table 13)
CCGAAAGAAATCCGAGCCAGGGTGA  SEQ ID NO: 51

(see Table 13)
GGTTTTGTTGCCCCACGTCC  SEQ ID NO: 52

(see Table 13)
CGAGAGAGGGGAAGGGGCTGGTTG  SEQ ID NO: 53

(see Table 13)
CGAACTTGGGGCGCAGATTGTGG  SEQ ID NO: 54

(see Table 13)
GCCCAAGCCTCACCCTCACACAG  SEQ ID NO: 55

(see Table 13)
CGAACCATCCCTCCGCGCCA  SEQ ID NO: 56

(see Table 13)
GGTCGCCTTCACCCAGCATCTCAG  SEQ ID NO: 57

(see Table 13)
CAGCGTCACCTGCCGGAAACACC  SEQ ID NO: 58

(see Table 13)
CCAGAGGCCCAGGGATCCGTTCAG  SEQ ID NO: 59

(see Table 13)
ACGCGAGCATTCTTGTAAGGCACCC  SEQ ID NO: 60

(see Table 13)
GGGAGGAGTGGGCGGCTGAATGG  SEQ ID NO: 61

(see Table 13)
GCACCCGCCACCTCCAAACTCAG  SEQ ID NO: 62

(see Table 13)
CCCCACGCGTACTCACACCGAAG  SEQ ID NO: 63

(see Table 13)
GCGGGTAAGAGCAGGAGTGTG  SEQ ID NO: 64

(see Table 13)
GTCGCGCGTTTCCCTCCCAG  SEQ ID NO: 65

(see Table 13)
GCGGGTAAGAGCAGGAGTGTG  SEQ ID NO: 66

(see Table 13)
CTGCTCTTACCCGCCGGAACCCTG  SEQ ID NO: 67

(see Table 13)
GAGGGACCTTAGAGCAGAGCGGGC  SEQ ID NO: 68

(see Table 13)
CTACTGCTAGGTCGTTGCCAAGG  SEQ ID NO: 69

(see Table 13)
TGATTGGCCAGCGTCTTACACTCCG  SEQ ID NO: 70

SEQ ID NO: 71
SEQ ID NO: 72
SEQ ID NO: 73
SEQ ID NO: 74
SEQ ID NO: 75
SEQ ID NO: 76
SEQ ID NO: 77
SEQ ID NO: 78
SEQ ID NO: 79
SEQ ID NO: 80
SEQ ID NO: 81
SEQ ID NO: 82
SEQ ID NO: 83
SEQ ID NO: 84
SEQ ID NO: 85
SEQ ID NO: 86
SEQ ID NO: 87
SEQ ID NO: 88
SEQ ID NO: 89
SEQ ID NO: 90

GTGTAAGACGCTGGCCAATCACA
(see Table 13)

SEQ ID NO: 91

ACAACGCGGTCCCTTCAGAAGCAG
(see Table 13)

SEQ ID NO: 92

CCGCGTGGTCTGGGCTCTGTAG
(see Table 13)

SEQ ID NO: 93

GAATTCCCTCCACCTCCGCCCCAC
(see Table 13)

SEQ ID NO: 94

CAACGTTAAAGGCAAACACCTTCTGC
(see Table 13)

SEQ ID NO: 95

GGCCGAATGAGGACAGAGTGACAG
(see Table 13)

SEQ ID NO: 96

GCCGGTGAGCAGCTTGATGGT
(see Table 13)

SEQ ID NO: 97

ACGGCCCGGTCTTTTACAAGG
(see Table 13)

SEQ ID NO: 98

CGGGAAGGGGCGTTAACAGGGC
(see Table 13)

SEQ ID NO: 99

TCTTGGCAGGCAAGGTCTCCGGAG

SEQ ID NO: 100

Other Embodiments

While we have described a number of embodiments, it is apparent that our basic disclosure and examples may provide other embodiments that utilize or are encompassed by the compositions and methods described herein. Therefore, it will be appreciated that the scope of is to be defined by that which may be understood from the disclosure and the appended claims rather than by the specific embodiments that have been represented by way of example.

All references cited herein are hereby incorporated by reference.

SEQUENCE LISTING (100 sequences)

SEQ ID NO: 1 - DNA, 1267 bp, Homo sapiens
cgggtgagggcctggggcacactccacttacctgcgccgggcccatcagcaacgctggcaaccccattagaacctgtgggctgggcagggccataacaggaggcccagggctagccctgccgctgggccgaaccctcacacttccgctgggtgacggtcgcactcaggacctgtcttcccaaatgcaaaatgcgcgcaaggcctctgggcaccgcagggacgaaggctgggtatggagaccctggagacgcgtggcgctggctccactttcgggaacaccttggctcataaaagcagagtaattagccgggcactatggtgcgtgtgaaggcgcggtgacggtccctgcacccactcccgtgccctggtgtggctccagaggcctgctgtagcccaacccaccagcagcaaaatgaggaccgcaatggcggcgccggaagtcccgcctctcaatgacagctcggacttgccactggtccgagctttcattggctcaaggatccccgccgtctatgacgctatttccctatgcccgtcacgctactgctaggtcgttgccaaggtgattgaggaatggcgtttattgcgtcgctgctcaggcaacgcaaactacattatccagaaggaccctcgcggtgcctcagggctggccattggcagccgaggagacaggcacttccgggcggagtgtaagacgctggccaatcacagcctggcagcgggacttccgtcgtcgtcctcggaccatcactttggcatttctcgattttgtctgcttctgaagggaccgcgttgtcaggcgagggacggaatcttggaggctccctgggcccatggaaacaggagcgaggaaggcacgagagtcggggaagttccgccttcttgacatacaagcgcccccaccgcggcgaatatcgcccctgagcccagtgttcgccccccacaacaccgcaccccccttccccaccctgtgccttagataaagccggcccagtgggaccctcaggttgcaccgcgcggaggtgtccgcggctctcgggagtcgtcgcccttggcgttatgttggctttagggagcgcgaggccgaggccaagaaaagctacgcattgggaggtcttgacccagtgtgcgcccggctgtaggcatggaacgtgcgccaaaggtctcctggcacccactccgctggactcagcaccattgtcctaagtctccgattgagaagtatctgccccaggtcctctgcgggccccactgaacagtgtggagc

SEQ ID NO: 2 - DNA, 126751 bp, Homo sapiens
cggctctggtcttgacctggggagcccagcttcctcggtgcaccgtgctttggcaaccgggtcttggcgcctccgagagcggggcgaggggtgccacgcgattcccaggccgctctgtatctctcggtgcgcttgcagggaccctgcagcaaagccctggatgcttgcagccggtgcaagtttgcaagcagctggagagcggtggctggagtcggggggcggtgggcgtggccacgctccctcccaggcagtcccgggaatgttctgaaaagtatccgaaagttctgagtcgcgcgcgcgccaaaagaaaaggcacaaccccccaccactccgggcgtggcgtgcccagacctcgccactccagctgcgcctccggctgcagcgcacacgtctcctgcgcctcctcctccggagcgtcgctgtccgtcgggttcatccctcgcagcagtctccaggcgagagagggggccagagtgctcgcacttctcctaggggcaccatgcccaacgacgaggcattcagcaagccctctacaccgtcggaagcccctcacgcccccggggtaccgccgcagggcagagccgggggctttggcaaagcgtctggggcgctagtgggggcggccagcggctcgagcgccgggggcagcagcagaggaggcggctccggctccggggcgtcggacctgggtgccgggagcaagaagtccccgcggctgcccaagtgcgcacgctgcaggaaccacggctacgcctcgccgctcaagggccacaagcgcttctgcatgtggcgcgactgccagtgcaagaagtgcaacctgatcgccgagaggcagcgcgtgatggccgcgcaggtgggtgcgggcgtgcgggagcccgggttcagccttagtttttttttttttttttttttttagatggagtctcgctcggttgcccaggctgcagtgtagtggcgcgatcttggctcactgcaacctccgcttcccgggttcaagcaattctcctgcctcagcctcccaagtagctgggactacaggcgcacaccaccatgcccggctaatttttgtatttttagtagagacgggggtttcaccatattggtcaggccggtctcgagctcctgacctcaggtgatccacccgcctcggcctcccaaagtgctgggattacaggcgtgggccaccgctcccggcggggcccgagtttcttgaatgaagtccccccagcatggccgttgccatgcgggtcctgggttgtggagagatgcggcggtacttgccgacagcggcggcgcttggggtcctgggctcccggccacgctacatcgccggtctgggagcgccggagacgcgtctgatcccgcccgccgggcagagttgcgggcttcgctcggctcggggttccccacgatctctcaccctgtgtttcggcggagttgcgggggttccctctgctcccgggtccctgagatccctgatcccgctctcagggcagggaattccggggttcgcccctctgggcttccccgcgatcccagagcccgcgttccaacagaattgggagggtttattgcgctagaggagtcttcaggatcttcgctcccgccctccgaggtgaggctagaggggagggttcgactccaagggaatcccagggatctctagccccgctcttctagcagagaattaaggaattctctccgctttggggtcccaaaaatctccgaccgcgccttgggagcagagggtttcggggttcgatttcctcgagcgtccccagaatctctgactctccctccttgctgagttgcacttaaattagaaaggatcttggagggcggcagcgctggctgctaggttagcgggaaagggaggctcggccggctgctgcttacgcgggtaacctgtcggaaagccttgtttgtttttctggaaaagtcgctgcaatggacacagcgttgcgcggtttccctgcgcgcctggggcgctttttgtcttcgccctccgtggatggaggctgagcgcctcagccattttgagagctctggaaattttattagcattttaaaatttgcattctcgaccgaagattaaagtgcaaattactttgaagatgttttaaagcacgcttaagaattttaaagaatatgcgcaggtggaaaaaagcgcgccagggtttgagatttggtccgtctgtggttttgtttttttgaaggttcgtaagtaggctggtaatttaacattttaacggaaagttaatgtctttagtattctaaaaggatttttggaaggcagtaatccacgttatttccagttaaaagttgtttcatctttttaagacaggttatttaaaatgaaaagataacgaagaaatgtttgctaacgatgtgctacttttgattaggaacgtgtaaatatcctccattgaaaacaaatgcccgaaggttatatgcttttatataatatatcagatttttacaaatgtgttttatactaaacgtattttggcttcacagatggcgagtgcagtcatgaaaatagatattgttttgcttaatttcttaatagatttttaaagcttaatctgtagtgggtgaaaagaatacactgggtgtggcagtaaaatgcatcacaatgagtttactgaaaaaaattaatggacttttaaattatactctgggcagaaaaattctctaaacatttagtcgttggcttatttagtgtggagaacatgcttgggggatttctcaaaatgtagtaaaaatattctagtagaggaattaattttgaataacctttattagtagaggaggctgcttacaccgttaaaaacaaaagcaactcaaggtcacttagaatgggaaacttcagtattttctacaccagaaggtgtgtactgtgccagatgaatccttaaaaatccataaaacaactacttctagtcatttttaaatagtttgaaattgatcttacgtatgattctaaaataattgtatagttgcatttttaatcaattgttatcccctttcctttttatataatattttctaagaaaccttgagagaaggtccttagcatatggagtagatacctgtgcattttggatgtgcttcagaggtttgcaggggtttaaaacttgtttctggccagattcattgatgttctctttctaagcctcttggttagtaataggaaatccaagatttaagcttaattatttaattttaagtaattaattatttaagatgaatttttctaagtcgaagacttttttttggctatgaggaaaattacttcccaattaatcagcttcctgtgtttggactgtggttttcctaaaacaacatataaattgtagttgtttttctttctttctttcttttttttttttttttttgagacaggagtctcgctctgtcccccaggctgtagtgcagtggcatgatttcagctcacggcaacctccgcctcctgggttcaagcgattcttctgcctcggcctcccgagtagctgggactacaggcacacgccaccacacccggttaatttttgtatttttagttagagacgggatttcaccatattggccaggctggtctcaaactcctgacctcaggtgatccacccgcctcggcttcccagagtgctgggattacaggcgtgagccactgcgcccggcctgtagttgtgttttttaattgaacgttttgatttcacctttggcttatatttgggcagctctgcggtgtgggtgcttcactgtcatttcataagcaccataccttagtttcaacagaaagtctttgttacatgtagaaagcaaaaatacaattaattttctttaaacctgttttttcaatcttattatttatttatttatttttttgagacggagtcttgctccattgcccaggctggagtgcagtggctcgatttcggctcactgcaacctccacctcctggcttcaagtaattctcctctcggcctcctgagtacctgggattacaggcgcacaccaccatgcctggctagtttttgtatttttagtagagatggggtttcaccatattggtcaggctggtctcgagctcctgacctcaggtgatacacctgcctcagcatcgcaaagtgatgggattacaggtgtgagcaaccccgcctggccttttttcaatctttaacggtgttattgaagagggaccatgaagagcttcttgggtatgtcaggtcctttccagtccccagttctggctctcttcttcctgtctgtctggaatatcacacacctgtcttctcccttcctccctgccttcagcctcttcttccttcagggacttcaacaccaaattccagcccctttccccactgcttctcccgcatgctccctccaccccaggaatcagggctctgcaggctttcctaagcagaccctgcctgcctttcctgcccaccctgttccatattattccgatatgtactgccccttcatccttgcctgtccaagtcctcctcatcctattcttcaaggctctgtccaaatactactgctggctgattttaacatgtgaaagacatttctctctctgactttcttctgtaggagtgaaaggtacttctgtgtaccactcttgtggtgttggtctcagtttgccttttgttgtagttgcatgtttgcctcctgtttttgcctttttttttttttttttggagacatagtcttgttttgtcgcccaggctggagtgcagtgtcgcgatctcggctcactgcaacctctgcctcctgggttcaagcaattcccctgcctcagcctcccgagtagctgggactacaggtgggctaacatgcctggctaatttttgtattttttttagtggagatggggtttcaccatgttggccaggccgatctcgaactcctgacctccggtgatcggcccacctctgcctcccaaagtgctgggattacaggtgcgaaccaccactcctggccctgtttcatttgttaaacagtaagtaatgtaggatacaatctactcttactggtacctgtttttagtacagtggccttttacaagtttatggaatgaaggagtgagtgatcccattttccttcctaatctgttagtgcttctgacccactctactcttcagattgtactcctccccttggctgactatagttttttcctgatcctccctagccaatcttattctacacagtcatttgtttaacaagcttttttatttgtttgttaagagacagggtcttgctctgtctcccaggctggagtgcagtggtgcgattatagcccaccgtagcctcaaactcctgggcttaagtgagtctcctgcctcaagctcttgagtagctgggattccaggtatctgcgaccatgtctggcaacaagcattttttgagcacctactgtctggctcaaaactgtttctcagctttgcacatcatagttacctgggtgggtttaagaagaaatgggagattttcagacctcacctccagagctagtgaatcatggtgtctgggatgggtggggcttctgtgttttggcaaagctgattctggagtgctggaggatgactcattgtcgtgtgcttccaggtggccctgagaaggcagcaggcccaggaggaggaattgggtatcagccaccccatcccactgcccagtgcggccgagctgcttgtcaaaagagagaacaatggcagtaacccgtgcctcatgactgagtgcagtggcacctctcagccaccgccggccagtgtccccaccactgcagcttcaggtaatctggaggggctggggttcacatggaggctgggcatgagggaggccgaagggttgcagccacagaagcagggctcccctgagctacatacagtgtttagagcttagaggattctgtagaggattctccctgtgaagggctgtttgtgcctgcatcacaaaggagggggccgtgaattctagaaatgcaggttcaactctttcctgttggttattagtcaagactgagtctggacagagaatgatgttagagagaggtgagattgttcagatttcatctcagtccaccccttcattttccagtcatccttgtgggaactaaatatccttgtttcctagaactagaagtccacttctccactgcatccatttggggaaagtgtctagaaaggccaaatcctagtgtcaaatttgaatgagcgggaagtaacaccggaaggaaggccacgttggcttgaattctctcccctgggtgctaaggaggaatgtgttcttttttacacatgtgaaacctgagacatagacagttatgggattggccaagtttactgaattagaaagtatctgaatgagtttatctgtctccaaagctcaatactcaatgtgcttactgcactaggtctctaaattacacaggtctggagctgtactgtccgatatcgaagcccctagccacatgtggctttttaaatttaaattcattacaatgaaataaatgaaaacattcggtttcttcattacactagccacatttcatgtgcttaatagccatatacagctaagggctatcatactggataatgcattgctgtctcttagaaagtctaattcgatggcactggtctagaatgtgggagctatgagacatccaccaaataaagacctgtggaatcttgttatttctggcaattagatacacatactgtaattcacagaatatctttaaatgtctttaaagtgttctaagctccatgaaatacagcctagcagtgtgatatcaccttgactaagctttcatgaattactccatttgctgggcttaagcactgtgtactaaagtcacacaactatatattattaactagctgtgcaactttggagaagttacttaagctccctgggcctttttttcctcttgtcaaaaatgagggaaagggttcctgagggtcttaaagatcttatgaatcttggccattattaaaaaggaagttaagcagaaaagaagttaaaaaagaagttaagcaccaaagaaagcaggaaggtgtgtctgtctgtgtctgtctttgtgtattttactgaagttactgactatgtaattaacagaggtcaagatactcttttttctttgcttggattggctgctcatagtatgtccttataatagtttccaaacttttgtttcctttctttttttttttttttttttgagatggagtctcactctgttgcccaggctggagtgcagtggtgtgatcttggctcactgcaacctccacctcctgggttcaaatgattctcctgtcttagcctcctgagtagctaggactacaggcgcccgccaccacacccgactaatttttgtattttttagtaaagatggagtttcaccatgttggccaggctggccttgaacttctgacctcaagtgatccacccacctcagcttcccaaagtgctgggattacaggcgtgagctgccatgccaggccaaaactttgcttttcataggaaggaaggagtgtatcagaaatacgatctttatgctttaagattttaagatgtgtcaaaggtttagtgactaaataatacagggtcatggctaatctggtggattcagctgtggggctgagatgagaaatgggatgtgtcacatgagtaaagagggcaagttccagtgccaggttttccataggggagtaactcatttgattttcacaaacgtctcaggaggtaggaattattatcctcatttacagataggaaaaccaaggcttagtaaatggtaaggagactgccacagaaaagagctggctgagctaggatttattccaggcctgtctggttccaaaacctatggatttcccattctacttaactgggaccagttgccatgtttccttggaaaatggacacttaacgattgtttagaggctgtggtctaatcctcagagtaatttagggctgatggacagttagcaacaatgttaggtgaaaaagtccctgccattctatcttggcagagaagacagcagccatgggtcttcacaggaagaaatacagggaaaggccagtgacggatcagtgtcaatgctggatgtggcataacatcaaggtttgattataaaccctaagatagtggagctttagagaaggactttaggctatgcagagttcagaacgactctcacaagggtgtttcagagtggtgatagggaaagttacaaaaggaagcagtaggggggcaagatagagggttcagggtcaaggaggatttaaccagagtcccttcctcacctgtggagttgacagaccttggagtcattctacagccttgaactagcactcacagggaaggggcatgtggaagcctacagcgtgctgtgctcatttgctcaggcacaggtgggcaagtatggctccgggagcctttaccttctgaggacgatgggctctctctctctctctttttttttttgagacagagttttgctcttgttgcccagggtggagggcagtggtgcgattttggctcaccgcaacctctgcctcccaggttcaagcgatactcctgcctcagcctttcaagtagctgggattacaagcatgcgctatctggctaattttgtatttttagtagagacggggtttcctccatgttggtcaggctggtctcgaactcccgacctcaggtgatctgcatgcctcagcctcccaaagttctgggattacaggcgtgagccaccacgcccagctgacaataggctctctgctaaccagctcatctctgtggggcaggagccacaggttgctgtcattcatgggatttgctaccagacctcctgagtgaggattgataacttctggactgagttaggatgtgagcaagagggaaattcagatgccagcagaattaaactacgtaaatatagagacagaaagatggagtgtgggagagtgggggagagccaaaaaaacaaacacactgtggagagtcctgaagcttgtatgcagcaaagggagcttcttagatagcttcctactaacaaatatatagcttatattcatttttcagaggttggatttacttaaaataatttcatggaggtgaatggtaaacatgtatagtggagtacaaaaatatattccatgaaagatcattgttcttctaaccccaacctgcaggtctgtttgtcattccaggatgatttactgcatgtacaggtgtatgtgtctgtttatccttttcatatgtaatataaaatatttgcataattaatatagtggaagtatgttgttcctacttgtgtctaattagcttttttcatttactacagctgagaatttttagtgacctagaattccactgtatagatgtgaggccagccaggcgcagtggctcatgcctgtaatcccagcactttgggaggccaaggcaggtggatcacctgaggtcaggagttctagaccagcctggccaacatggcgaaaccccatctctactgaaaatataaaaattagctgggcatggtggcacacgcctgtaatcccagctactcgagaggctgaggcaggggaatctcttgaatctgggaggtggaggttgcagtgagctgagattgtgccattgcactccggcctgggcgacagggtgagactctatctcaaaaaaaaaaaaaaaaagaaagaaaaatagacgtggaaggctacgatttgaagttatgcagtgagaggtgaaagttgtaggagttgtcatggaatagtaaaacctaccaacctggcacaccttggggcaagttgctaactttctactttctaatacctgatgtctagtgtttactaggtcagtagcttagtgaaatttagtcaacttttatttatttatttattttttgagacacagtctcgctctatcgcccaggctggagtgcagtggtgcaatcttggctcactgcaacctccacctcccgggctcagacgattctctcacctcagcctcttgagtagctgagattacaggcgtgcgtggcgatgcccagctaatttttgtacttttagtagagacagagtttcaccatgttggtcaggctggtctcaaactcctgacctcaaatgattgcccgcctcggcctcccaaagtgctgggattacaggcgtgagccactgcatctggccttagtagaatttaaagtccttgaagtttcttagttatctccttttggctcccaaaagggccaaaagtgaagaagagaaatgctcaagaattattgccaagaatattggccaaattctgaggacacttagaaggaaattaagtatggtttcatttgttggagaaactggcctctctgaggaggataacatatattagaagaaaatctctaaaatctttagccaaagattggctaagactgaccagattaactggatagtctttgaataacgagtgtaaaatatttttgttgttattttcttacatgattttggatattactgtggaaagaaatagtcttttgaagaaattctgtttattgctgttgcttgtaccagcaggatcagttgttagcaggtacactttttttttgttttttttttttgagacagtctcactctgtcgcttaggctggagtgctgtggcgcgatcccagctcactgcaacctctgcctcctgggttcaagagattctggtgcctgagcctcttgagtagctgggattacaggcgatcaccaccacccgtttaatttttgtattttagtagagatggggtttcaccatgttggccacgctggtcttgaactcttgacctcaagtgatccgcctgcctcggcctcccaaagtgctgggattacaggtgtgagctaccgtgcctggccgcaggtacactattgataagcaaatagtttattcccagccatttttggagtattcagaaaaaaaaaagataaatgattttgactctacatgacaaataattaacggcaaatttacatttttttccggtggtttcatgttttgaactttagcataaaatgtacttttttttttttttcgaaagttattagctgacttaaatctcaggtcttcttcctctttgtaaatgtaggctcctctttgttttgttttatttaatattctactttttcttcagcctcccgtgctcctatagaatgctgtttgacacagtacttaatgcaaaggtctgcatagttctcttcctctccttttctgtgcagaagctgtcagatgaagggttgcattgtagataattcagttctgcatgtgtgtcctttgtaaggacctgaatgttatctgtcttggggccctcccttttggagcaccggggacttccatccacactcacattcaccctcccccagatcaaaccacctcgggcccccctgggcagctccagcctcttctgtggctcgtggcccagtttcagtcacctttcccctgttagaaggatcagtcaggtctgtgtctaatattgaaggggcctttccttcacttttcttcagcagttactccacttggagagcacacagtgagagagcacacgccagttgggaaacacattgtgtcgtatgtttaagtgcttaaaagttcataaaacatgaaatgtgttcgtttgaaaatggaatagtatcccatgcagtttttacaagtaagagatatggctggtgaattcacaacggaagatagttgtttaaattaaaaaaaacaattttttagagcagttttaggttcacagcaaaattgagaggaaggtacggagattttttttatatactccctgccccaacacatgcagagcctctcccacattaccagcatccccatcagagtggtgcatttgctagcatcgatgaacttacactgatgcatcattgtcatccagagtccgtagtttgcataggggtttgctcttgttgatgtactttttaatgggtttggacaaatgtgtaatagcttgtgtccattatagtattcacagcattgccactgtcctaaaaattctctgtggggttatttaaatttaagataacattttaaacattttagagttttttgcaaatttttattttattttaaatttttgtttatttaattaattttttttttttttgagacgaagtcttgatcttgtctcccaggctggggtgtagtggtgtgatctcggctcactgcaatctccgcctcccaggttcaagcgattttcctgtctcagcctcctgaatagctgggattacaggcatgcaccaccaaacctggctaatttttgtattttaaattagccactcccactaatttttatatctttggtagagacagggtttcaccatgttggccaggttggtcttgaactcctgacctcaggtgctccgcctgcctcggcctcccaaaatgctgggattacaggcatgagccaccaggactggccatttatttagagacagggtctcattctgtctcccaggctggagtgtagtggctccatcatggctcactgcatcctccaactcctaggctcaaacaattctcccacctcagcctcccgagcagttaggactacaggtgcacgctatcatgcctggctaatttttaaaatttttctttctgtggagacagggtctctttttgttgcccacgctggtcttgaactcctggcttccagcagtcaggagttgaactcctgcttcagctcccaaagtgctgggattacaggtgtgagcctacacactaagcccattttttttttttaatttttcaagagacagaggttcgttctgttgcccaggttggaatgcagtggcacaatcatagctcaccgtagcctcaaactcctggactcaagtaatcctcctgcctcagcctcccaggtagctgggactacaggtgcgctacatgcccagctaattttattaatttatttatttttgggaaacagagtctcactcttgcccaggttggagtgcagtggcgtgatcttgactcactgcaacctccactttccagatcaagtgattctcgtgcctcagcctcctgagtagctgggactacaggcgcatgcaaccatgcctggctaatttttgtatttttagtagagacagggttttgccacgttggccaggctggtcttatctttggagttttctaatgttgtaaagaaggaaatactttattcaaataagcaataaaagcgttttatacaaattggattgagactttatttttgaaagagtctggccacttaagtgaaatgagatccgtttgattttagacagctttcaattaaagctagaataggaaatgatattagattaagaaaaagcttttcagataaaaacattcccaaattttactttcaaattaaacaaattttcagagtttctagcaaaacaaaactcctttttttttttgaaacagagtctcactctgtcacccaggctggagtgcagtggcataatctcggctcactgcaagctccgcctcctgggttcacgccattctcctgcctcagcctcccgagtagctgggactacaggcgcccgccgccacgccaggctaattttttttgtatttttagtagagacggggtttcaccatgttagccaggatggtctcaatctcctgacctcgtgatccgcccgcctcagcctcccaaagtgctgcgattacaggggtgagccaccatgcccggccagggactgatggctttgatagcctattttagatagtgtctcaattttgtttatctcagggatagtctttgcttatatgtcaagtatagcagtttaattggtcagatagaaactttctgtggatagtattttaataaagcaattatgaaaacaaagtacgtaggaagtaacctacttgtctacctttgactagaaaggaaatttagaaaacatctagagccaggaaacgtaaatacaggggttaaagttacaaataaattttataacagcatattaaaaaacaaaaacatttgattggtttacatctgtgtctcccttgtgaaaatctaatctttaaggacaaacactgcattttatccatttctgtatagtacagtacctggctttatagttaatggtcaataaaccattgctgaatgaataaatgatggttaaatttgaagctctattttaaaatactaggtaagtgatctgaacccacctgtagacaccagagaataaaactattgatgttcagtgtacatttttgttctgtgatattttaaacatatatctgaattttttttctttttgagacagggtctcgctttttagcccaggctagaatgcagtggtgccatcttggctcactgctgccttgacctcctgggctcagcaattcttccacttcagtccccaagtaccttggactacaggcacgtgccaccactcctggctcattttaaatatttttatagagatggggatctcgctgtgttgcctaggctggtctcaaactcctgggctcaagtgatcttctcaccttggcctcccaaagtgctgggattacaggcatgaggcagcatgcctgacctctgaattttttttttgagatgaagtcttgctctgtcacccaggctggagtgcaatggcatgatctcggctcactgcaacctctgcctcccaggttcaagcgattctcctgcttcagccttctgagcagctgggattacaggcgcccgccaccatgcccagctaatttttgtatttttagtagagacgaggtttcaccatgttggccaggctggtctcgaattcctgacctcaagtgatccacccgcctcggcctcccaaagtgctgggattacaggtgtgagccaccgcgcccggtgacctctgaatttttaaggtgattaaaaattcaaatgtagtttaacgacttaagatgtaattcatataccaggtaattcatttgtctcaagtgtacaattcagtgttttttagtaaattcacagggttgtaccacagtcacaagaatctggttttggaacatttcagtcactccccatgtactcttcgctccagccctaggcagacactaatagattttctgtctctacagaggtgtctattctggaaattttatataactggaatgataagatgtgtaaccttttgtgtcttacttctcttacttagcctgatgtttctaagtttatccatgttgtagcatgtatttttaattattattgttcctttatattagtaatatttcatcatatggatatataccacattatttttctgtttatcagctgatgaacatctgggttacttatgggttttggctattatgagtaatgttgctgtgaacttgtgtgcaagagtttttgaatgaatgtatgtttcattctcttgggtatataccaagtagtggtgttactgagttttatgttaactctgtccttaacgttttgaggaactgccacacttttccaaagaggctgcactattttacattcctaccgacagtctatgagggttccagaaaattgaaactaagtttttttaagttacaagggaagatgcctttatcctagcaagctacaggtaattaaaaccctgcgagagtctctcatgacaagtttagattatgaaggattctttaggtttgcattttattatcaatagatacatgttaatattcaggctgggtgtggtggctcacacctgtaatcccagcactttgggaggccgaggtgggtggatcacctgaggtcaggagttcgaaaccagccatggtgaaaccccgtctctaccaaaaatacaaaaattagccaggcgtggtggcacatgcctgtaatcccagctactcgggaggcagaggtgggagaattttctgagcccaggacgtggaggttgcagggagctgagattgctccactgcactccagcctgggtgacagagcaagactctatctcaaaaaaaatatatatatgtgtatatattgaatataatatgtatatatatattcagtctttgaaaacgttcctttcttacttgtcacagagtttatattgaaaggaacagtatttgtggaagtaaagcaattcataaagggacctggagagagtttttctttgctgtagctgtattattggttggtagaaatattggtatctataggaagggctaaagtaacattttggactttgggtgacatgtgtttcctgaaaacgagggagcaagaattctgttgccctaaaacttggcaggaatagttttaatctgtgagtttctttttttttctattattatactttaagttttagggtacatgtgcacaacgtgcaggttagttacatatgtatacatgtgccatgttggtgtgctgcacccattaactcatcatttaacattaggtatatctcctaatgctatccctcccccctccccccaccccacaacaggccctggtgtgtgatgttccccttcctgtgtccatgtgttctcattgttcgattcccacctatgagtgagaacatgtggtggttggtgttttgtccttgcgatagtttgctgagaatgatggtttccagtttcatccatgtccctacaaaggacatgaactcatccttttttatggctgcatagtattccatggtgtatatgtgccacattttcttaatccagtctattattgttgtacatttgggttggtttcaagtctttgctattgtgaatagtgccgctataaacatacgtgtgcatgtgccttttaatctgtgagtttctaaaattggaaaaccactgtcactcttctggggagtgaaagagaaaacccgagagttggtgaaaatggacagctgtccttcatgtggccagtgggaagagggcagttcacaaagactttcagacctggttgtagcattggggaacttttacaggtggtgacactaggtattgtccttgtattgtgctgccttacgcttgctgccatagggaacttttggaaggtcacaaaggtcatctgtgtcatcagtgtcacttgcttactcagcagcatccccctggagttctttgactcacatattcctagttacttggtggtttgaggatcctgtcctgttgatcacccctcaggtacctacttacttttggagtcttgtgaatgcctttttgtcctctttttatattaattaacttatttttaaaaactctcttttattgtggtacaatatgcacaacttaaaatttatcattttaggctgggcgcagtggctcacgcctgtaatcccagcactttgggaggccgaggcgggcagatcatctgaggtcaggagttcgagaccagcctgaccaacatggcgaatccctgtctctactaaaaatacaaaaattagttagacatggtggtgggtgccagtaatcccaactacttgtgaggctaaggcaggagaatcgcttgaacctgggagtcggaggttgcagtgagctgagatcgcgccattgcactccagtctgtctcaaaaaaaaaaaaaaaaaatatatatatatatatatatatatttatcattgtaaccatttttaagcatagagttcagtggtattaggtacattcaccataatgtgcaactgtcaccaccatccatctccagaacttcccagacagaaactctgtacccattaaacgattatttcccatttacccctctcatgaactaacttatgactgaggccagtctcttatgcaagcccagctttcttgaaagttccctggcttctgaaatcacctgtagactcacatgagttacgatgattcctttgatctctgccagcatcctttcttggctctcttaactcccaaatgtttcctgtattgctgacttcttcctttgttttaagtgctgctctaacctgtgcctcttgggtaataaggggctccaaagtctgtaaaataactgaggtttatagggaacggatgcaggggactgtatactaacaccttatgcagtacactgtaaattctgtctgatgatctggactctgagcctaggagtgcccttagttgtaccgtgaagcaaaggaagtggagtaggggtgcctgtgggtcccctggggctctcagtgctctctcacggagtcttgacttgtcacggtcccttttgcggttgtcaaaagcagctatgcaaatgtatatgtgcatttctgtttcagcctgaaggtgtcttcactttccaaatcacaaaaaaatccaattcggtgtttttgagtctcctatgaaaattcacataaatattgattactgttgttgaaccaaattacacttcaaaccaagtttatgccagtctctaaaacgtctgcaggcagacttcatagttgctaatctggtctcattgtacaataccactgaacatgctttccagaaaaaaatgtgtaagaaactcttaaagtagactataaatagctggcaagttgtgaaaagaaaataatcaattcagtattacagtaatagcagattttctgatgtttattggcagtaaggttcttagatactgcttcagccatccattgccattcagcatatagtaacagatgactttcaatgttgatttcagaacttataaaaattgccgttaactacccgttaactctagtcctgaggttttaggttttatctaaaatatggggtagggcacggtggctcacgcctgtaatcccagcactttgggaggccgaggtgggtggatcacttgaggtcaggagttcaagaccagcctggccaacatggtgaagccccatctctactaaaaatacaaaaattagccgggcgtggtggcgcatgcctgtagtcctagctacttgggaggctggggcaggagaatggcttgaaccctggaggcggaggttgcagggagccgagatcgtgccattgtactccagcctgggcgacagagcgagactctgtctcaaaaaaaattaaatacataaaaagtaaaataaaatacacaaaatacaaattagttcagtgaagcagattggatttatcaaatggcaataaatgtttgctgaattgaattgaattcatctctgctggagagtttgctgtctgagcaagatttcctccctcactcttcttactctgttttttcattttacttctttattcgttcaacaaatgttcattctatggctgcactgagccagatcctattctaggtgcaggatatatagcagtgcatatatctctcacatggaccttatatctcttgggggctgccagggaagacagttgataaacaagtacatcaataaataagatatttgcagtaagtggtaagtgctgtaaagaaaaacaaagtgatatgatggatgtgaccaaggggacacgggctgttttaaatagggtggtcaaagaagggaggcctctctaaggaagttaagtcagagctagtcccaaatgacagtgagccattctcatcaagatctggggaaagagcatttgaggaggaaggagcagcaaggtgagactgtgctgaggcaggcagctgtgagcctgagtgctttgagcacagggtgacaccagtggggttgtgtcatgggctcatagcagaagggcgcacagctgcctgtgtataccacggaaagggttgggagtttagcatgaatgcagtggacagccattaactattaaagcagtgaatggtgtgatctaatttactttcttttttttttttttttttttttagtatttattgatcattcttgggtgtttctcggagagggggatttggcagggtcataggacaatagtggagggaaggtcagcagataaacatgtgaacaaaggtctctggttttcctaggcagagggccctgccgccttccgtcttctgcagtgtttgtgtccctgggtagttgagattagggagtggtgatgactcttaaggagcatgctgccttcaagtatctgtttaacaaagcacagtttgcaccgcccttaatccatttaacccttagtggacacagcacatgtttcagagagcacggggttgggggtaaggttatagattaacagcatcccaaggcagaagaatttttcctagtacagaacaaaatggagtctcctatgtctgcttctttctacacagacacaataacaatctgatctttcttttccccacatttcccccttttctattcgacaaaaccgccattgtcatcatggcctgttctcaatgagctgttgggtacacctcccagacggggtggcggccgggcagaggggctcctcacttcccagaaggggcagcggccgggcagaggggctcctcacttcccagacggggaagccgggcagaggggccccccacctcccagacggggcggctggccgggcaggggctgccccccacctcctggacggggcggctgctgggcggagatgctccccacttcccagacggggcggctgccgggcgggggggggctccttcagacggggcggccggtcagagacgctcctcacctcccagacggggtcgcggccgggcagaggcactcttcacatcccagatggggcggcggggcagaggcgctcccaacatcccagatgatgggcgggcgggcagagacgctcctcacttcctagacgggatgacggccgggaagaggtgctcctcacttcccagactgggcggccgggcggaggggctcctcacatcccagacgatgggcggccaggcagagacgctcctcacttcctagacggggtggcggctgggcagaggctgcaatctcagcactttgggaggccaaggcaggcggctgggaggtggaggttgtagcgagccgagatcacgccactgcactccagcctgggcaacactgagcactgagtgagcgagactccgtctgcactcccggcacctcgggaggccgaggctggcagaccactcgcggtcaggagctggagaccagccccgccaacacggcgaaaccccgtctccaccgaaaaataggaaaaccagtcaggtgtggcggcgcgcgcctgcagtcccaggcacgcggcaggctgaggcaggagaatcaggcagggaggctgcagtgagccgagatggcggcagcacagtccagcctcggcatcagagggagacggtgcaaaggggagacgaggaccgtgcaatggggagggggagggggagggggagggagattgagatttactttcttaaaatatctctgctcttgtgtggtggtgtttgaagggaactgggtgagagattgatgggaaggtcgtgctgttgtccaggtgaaagggagagctgcttaggctggggtggtggcagtagagatggaaagaaaggctgggacgggaagtctatactgggggtacgttgaagtgtagttttggtgggtgttgtcaatggtattcccttctgagagtggctgctacagcgcagccagcactaggtggttggggttttcctagttaggtgaggttatgtacatcagcgtggtcaggtgaataacggcctcccaaaagatgcctgtgccctaatccctgcaacctgtgaagttggtaccttacatggcagaagggactttgcaaatgtgattgagtcaagagtcttgagatgagtgagatgatcctggattttccggatgggcacaatctaatggcatgaatccttaaaagtggagagctccctgggtgtggtagctcatgcctctcatcccagcattctgggaggctgaggctgaaggattgcttaagctcaggagtttgggaccagcctgggcaacagcgagatcaggtctctacaaaaaaaaaaaaaaaaaaattagccaggtgtgggggtggctgcttttagtcccagctgcttgcgaggctgaggtgggaggattgcctgaccccaggatttcaaggctgcagtgaacagtgatcatgccactgcatttcagcctgggtgacagagtgaggccacgtctcttaaaaaaaaaaaaaaaaaagggcaggggaagtgtggacagaacctttcctggctgcaactagagatgccatgacagaagacacaggagagtttccaggcttgacagagacttgacctgctattgctggctttgaaggtggaggaagggaacccctcagccaaagaatatgggaggcctctacaggctagcaacagccctcagctgacagccagcaaggaatgggacctagtcctactaacacacagggagctgaattctgccatctaactgattgagcaaagaaacagtccctgctagaggctccagaaagaaatgcagccccacagacaccttgacagagactggcgtcagatttcggacccacagaactctaagatagtcaatttgtgtcatttacgccactaaatttctggtgatttgttaacacagtgaaagatgactaatgcaactggtatagtttataatctagatttcccttgttagtggggttgaacatcgttccgtatgtttaaaggccatttgtattttattctctgaaccatctatgtcctttgcccatttctctattgatcccggccaacatcaagaatttccttatttattgtggagattggccctttttgatatgaggtgcaagtttcccccgactatttggtattttaaaccaggaaactatatgagactggcgggggacagactgcggggtgataagagtcccaggactgagtcctcgtcactgcactctttggaggacaagcagaggagcagagaagcctgtaacttttccacttcctgttggtaggccattcttcagtccaaatgaaaatggccatagaatggctaaaccaatgtgttatttgtattcttttaacttcttcttcttcttttttttctttttttttttttgagacagtcttgctttgtcaccaggctggagtgcagtggtgtgatctcggctcactgcagcctctgcctctcaggttcaagcgattctccacttcagcctgccgagtagctgggattaaaggtgtctgccaccacgtttggctaattttcatatttttagtttcaccatgatgaccaggctggtcttgaactcctgacctcaggtgatctgcccgccttgtcctcccaaagtgctgagattacaggcgtgagccaccatgcccagccagtactctttttttttttttttttgagacggagtcttgctctgtcgcccaggctggagtgcagtggtgcgatctcggctcactgcaagctctgtgtcccaggctcatgccattctccttcctcagcctcctgagcagctgggactacaggcgcccgccaccacgcctggctaattttttttgtatttttagtagagacagggtttcaccatgttagccaggatggtctccatctcctaaccttgcgatccgcccacctcggcctcccaaagtgctgggattacaggcgtgagccaccgtgcccgccagccagtattcttttaacttctattcctcagttcaattttagctatgagtaggtctcaagttttaagccaaaagcttcgactaaaccatttcatagttatggtttggaagttttacagttccattcattatataataaactgtggtatggccgtgatgcaggaatggggagatatactgtccagtcacatattctggtttctagaggctaatcttattcttaccagtgtggtcagtgagcatggaattagaatgcacgttaccttcagctatctcagagtcattttactgtttgcgttgatgtggaatgagcattgtcattattcctgcatgacgtttccaggttttccctgagagaatggtatatggcttgatcaaagttctcgaatattgaagacacctgggaaaagagatttgttgttatcttgataactttatacctggaaaggactctcagtgaaagaacctaagatctggagtcaaaagacctggctcagtttcttaccacctctctgattttcagcagttcatttaactttgtctgtttgttcatttgtgaaatgaataaaataataatatctatctaggatatcttgtagaattgttagagtgctcatttttttcttaagatatgtatggtacttaatttttcataaatatatatgatatatatgaaatataaggtatttatgaaaaatacctttgtacactgtgatgaagtacatgaacaagtcatagagctcacatttcagatattaataggaggagcagatgaatgagcccggatatgatttatcctgtagcaataaacaagtttttgcaaaaatgaagctacctgaacagatacaacaagaattacatctttgggtgaggattacataacccatcacatttccctacacccccagttgccaggaatctcagagacacatcttaatgctcaaacatggtagatgtattaaaccgtcccattagaatataaatatttccccttcttttcatgaccttctttttctgttttgttgacttcgctgatagatgccttcagtattagccatctgtcatcctttcaaaagagagtgagggcagcgcacggtggctcacacctgtaatcccagcactttgggaggccaaggtgggcggatcacctaaggtcaggagttcgagaccagcctggccaacatggtgaaaccctgtctctactaaaaatacaaaaattagctggatgtggtggtgggtgcctgtaatcccagctgctcaggaggctgaggcaggagaatcgcttgaacccaagaggcagcagctgccgtgagccgagatcctgctactgcactccagcctgggtgacagagtgagagtccatctcaaaaaaaaaaaaaaaaaaaaaaagacagtggtgggtgttttataaccacacaaatactcaggactctgagactgggacgttacctttagcagaacaggtaaagcaccatcaatgcacatttagaaatcgtcaggacattgcatatcagatgaagaagcaggaggcatcagcactggcctgcgggtgggacaagggaatgtcataatatttcagaccccttgacgtcaccacctttaagaagcaatatggggaagctgaactaggtgtgtcacactgtgatccattgcaaaagggactcatttaccccgttgtggggatagtattttaaagtgtttagtttcagaagttttccttcttgaaaacactctcaaaacttgtgtttacttgaaaataaacagtgtcagatttttcattaggggcaaaccagaaagcaacgagagagtctcaaggacgttattgggctgatacactgataccaaatgcagtggatgggcaaggaagtaacaagcggaagcaatgtatgtacacggtgcataattcctctttagtgagtttgagatgtgtgtgagactgtcccatggcttcccaccccaggagctgctaccttgtagagtccagtcatccacttgatgagggtggtgttcattttccttatcaccctctccctcaatttttatctgagagatggaattatgagttacaggaggaaggagtaagaggcacatcaaagcctttttgtgtggctttgaataagcggccttattggtttggggttgttagctttgggtgtgctattttcatcatgaagcacctggggtttgtttttttctaaaagatgtagataaactagagagaatccaggggaagggcaacaaaaatgatgtatgacttggagagaaggagaataacagtctataaatatttgaaaggtaatataaaagagggagagagattatttacagcagtggagaggagtttgacagggaacaaaagcatgcatctaggagcagggggaaattgggtaggactgaaaaaaaacaaagcataataagggtgattaagcaaagaaatgtaattctcacattagtttgtgtttccaggatgcaggatggtaggaggaagaagtgacgtttgtcaaactgaagatccacacacgactatgaatcacgttttcctaattcctctctgggaagccaggagagcgggcagtgctttattctgtgcctcctaagcatgcagtcggtttaattctcaactctttggcattatgttttcataggtggtagtaataattataacccgagtagctctcatttaccgagtgtctgccttgtggcaggtgttgtcttagctgctttgttatttatattttcatttaatctttacggcaactctgtaaataggaagtatgtttttccaattatagggaaattgaggtttagtaacttccacaagatggcatgtgtattaagtggtggaggtggaactcaaacccgggtctgtgacccacagcccatgctcatgccctacatcgggctccattactctgtcattgtggtcatgagagtagtaactgggacccagtaggtggccaggtggtttgtatcttggtacaagggtaagtaaaatagttgatgtccaaggctccctttgctttctttttctcttattttcctttcttgagatatattttctctgtaagtgctgtgttattaacatactacattttatcattctgtaaattaagttatactatatgcttttagtcatctttgtggttatatagtgatatgtacaatctcacttaggaaatcaacaattgttgttttttattttgagacagggtctctatcgcccaggctggagtgcagtcgtgtgatcacagctcactgcagccttgacttcctgggctcaagcagtcctcccacctcagcctcctgattagctgggactacaggcgcaagccaccatgcccggctaagttttgtatttttttgtagagatggggttttaccatgttgcccagggtggtctcaaactcctaagctcaagcgatctgcctgtttctgcctcccagagtgctgggattacaggcgtgaccactgcacctggcctgaaagaaagtattttacaaggcaagcattatcctggatcttacaggggatctcttagctgtattctatatttgcctcagctttctgtctctgatatttgataatatccggtgtattgatgattgctttaaaaaaacaaaattcacagaattcttcactacttagaataaaagtgaagagctgtgtgtctgggtttttcatgtcattgcaagaagttaccaaacctggaatcaaaaggcctgggtttcaatcgcagttccagctatgtttctttgtgtgctgggcacctttctaagcacagctagctcctctgtcttgggccattgtacctcctggtcttcaaccttacaaggttatcgtaggtagcgtttgaaagaatatacataaaatgttgtttatgaattgcagagtatacttaaatgaaaaatgttaagtttaaaagttagcatcggctgggcacgttggctcatgcctataatcccagcactttggaaggccaaggcaggtagatggcttgagcccaggagtttgagatcagcctgggcaacatggtgaagccccattcctacaaaaaataaaaaaattagctgggtatggtggcacacacctgtggtctcagctacttgggagatgcaggtgggaggatcacctgagcctggggaggttgaggctggagtgaaccatgatcgtgccacctcactccagcctgggtgacagagtgagacactatctgaaaaaataataataataaaaataaaagttagcatcctttatattagcagcttttttcttagtgcagcttctcttggtaaaactctgatatagtttagggatggttgaggcttctgaggaagttgacatccaaaggaccttgttagatttttatccgggggcggaacagaaagtactaagtgaatttcaaggatattctactaaggccacagcttttgcctcttcctcccctttccctatggtgacatgcaatggagaccatgccagatcttaaaggtggatggcatagaaataaaaatgtggctcaaggcattggcatgttcatctacacttgcattgtgaatacaaaggtgtactcatctgcacctttccatttgccagttctcctagctgttctccgtaggaattaccttccctttggaattgtgtaccttttaaaattcagaactttttgaatttccgtctccgggtcattgctcctagttgttgtctctagtgaattcttctctaaagtatccctagattacttttactgtaaactgtaatgatttgactctggccatatttctcccaaggtctcctatctcggttacttgtaaggctactcctcccctctcttgttctctttgatcttttataattggcttaaagctctctatatttaatctgcagtgactttgtttctcctccctattttggctttttcaatccccgagaatttaataatctgtttctcattattttctattttttcttaaggtgtcgcattctctgtcgcacagttaatagtcttttctcctcttctccccatttggtttatattagctattaatgcaagtctgcattgtgtctctattttggcttgtaataaagtcctgtgtattctgtggagttggtgggcgtcctagttacagacttggctgaacctgaagacccctgcgcgtgtatatggtaatgttgtaaaaatacggccctggagataaacagttgagcacccagtttgtattgaacgaataagtttcttaagtttttgagagctttctcttagaagttgaccttttgggggcaaattactgtgactattcaacatgtaagaaagaatagcttgccgggcgcggtggctcacgcctgtaatcgcaatactttgggaggctgaggcaggtggatcacctgaggtcaggagtttgggaccagcctgggtaacacggtgaaaccccgtttctactaaaaatacaaaaaattagctgggcgtggtgacgtgcacctgtaatcccagctactcgggaggctgaggcaagagaatcgcttgaacctgggaggcggaggttgcagtgagccgagatcatgccgctgcactccagcttggacaacaagaatgaaactctgtctcaaaaaacaacaacaataacaacaacaacatagctctggtcgccatcctgtggcctgtggttgaccttttgatgagtccgtcccgtgacagcatccgtcataattttttcactaagcttagctcttcagctgtgaaatccttttagccacagcattgtagtctcttctcagaaggttaagctttctgatacttttttagtctgtcacttttctggtctctgttgggtccaagaaagaacccctggtgagtctaaaggctttgcttattttgttctttaagcttaggttcccatatttctcattttcttgacttttttttttttttttttttgagacagggtcttactccattgcccacgctggagtgcagtggtgtgatcatggctcactgcaccctctagtcctggggctcaggtgattctccaacctcagcctcccgagtagctggaactacaggtgcacaccgccaagtgtggctaattttttttgtgtgtatgtagaaacagggtttctccatgttgcccaggctggttttaaactcctgggctcagctgatcctcctgacacccaaagtgcggggattacagttgtgagccattgtgcccatacattcaagccttttaaaactgtattattgggtttcagggggtctttgaacccaaggtctggctctgttgcccaggctggagtgcaatggggcaatcatgggcacattgcaaccttcgccttctgggctcaagccatcatcctacctcagcctgagtagctgggactacaggcgtgtgcaccaccatgcccggctaattttttgtagagacggggttttgccacgttgcccaggctagtcttgaattattgagctcgagcaattctccaccttggcctcccaaagtgctgggattacaggcatgaaccggtagcccggctggtctttgaactcttttttttttttgagactgagtcttgccctgtcacccaggctggagtgcagtggcacaatctcggctcactgcaagctccgcgtcccgggttcacgccattctcctgcctcagcctccagagtagctgggactacaggcatgcgccaccacgcccggctaatttttttttttttttttttttttggtagagacggggtttcaccgtgttagccaggatggtctcgatctcctgacctcgtgatccgcccgcctctgcctcccaaagtgctgggattacagacgcgagccaccgcgccggctaactttttgtatttttagtagagacggggtttcaccgtgttagccaggatggtctcaatctcctgacctcgtgattcgcccgcctcggcctcccaaagtgctgggattacaggcgtgagcaaccgtgcctggccggcctagtctttgaactcttaaagctgcatttcttttggaagatggcccagcatttttgtctgattcttcaaggagtctgtgacctaaaaagtattaagaaccactgctttgagtttaaaacgatggcccttttccaacaactaccatttcttgttatattttcttcatctctctatatacctatttacatttttctattgatttctgagtaaataggaagcagactttatattatttgagacccttctaaaaataacttactgaggtataatttacatgccataaaactcaccatctttttttttgtgatggcatctcactctgtcacccaggctggagtgcagtggcttgatttcggctcactgcaacctctgcctcccaggttcaagggattctcctgcctgagcctcccgagtagctgggattacaggcgcccgccaccatgccaggctaattttttgtatttttagtagagatagggtttcaccatgttggccaggctggtctcgaactcctgaccttgtgatccacccgccttggcctcccaaagtgctgggattacaggcgtgagccagtgcgcccggccaaaactcactatcttaaggtgatgtttaatatattcacagagttgggtaaacatcaccactatcaaattttaaaacattctcataccatctccaaaaaactcatacccattactggttactgggtttcttcccccagcctctggtaaccactagcctactttctatctgtataggtttgcctattccagacatttcatgtaaatggaatcatacactgtgggattatttgtgtctgacttcttccacttagcatgtttttgaggttcatccgtgttgtagcatgtttcaggacatcaggacttctttttattacttatcagtattttattgtatgaatatacaacatttcgtttactcatcagttaatggaaaacattttatgttcaaatttttgtgtaaatatatgtattctcttgtgtatttacttcaaagcggacttggtggttcatgtggtgggtctgtgtttaacattttgggggactgctaaggtttttcaaaagcgggtgcaccgttttacatttccagcagtgtgacatacatttacacaaaaatttgttcatctgggccagctgattggacgatgtccccccacattaaaggcagatcttctctactctgttcatggattcacatgccagtgtctttcggaaacactcacagacacaccccagaaataatccttgagcagtttgctaggtaacctttaacccagtcaaggtgacatctaaaattaaccatcacaccatcctagtgagcacgaagtggtattatttgtggttctgatttgcagtttgctgatggctaatgacgttgtgcatcttctcatgcactttgtgccatttttgtctgtcttctttagagaaaatggttattcaagtcctttgcccatttgtaagttttttttgtttgtttttttaagtttgaattgtaaaacacatttctataagcattttttttttttgagatggagttttgcgcttgttgcccaggctggagtgcagtggcgcaatcttggctcaccataacctccacctcccgggttcaagtgattctcctgcctcagactcctgagtagctgggattacaggtgcctgccaccacgcccagctaattttttgtattttcttttttttttttagtagagatggggtttcatcttgttggccaggctggtctcgaactcccgacctcaggtgatccacccgccttggcctcccaaaatgttgggattacaggcgtgatccaccgcgcccagcctctatagacatttaatgttcttaggttatcgctaggtcttgtgaatgagtgaaataaaggaagggaaaccctttagctaggcagtggcaaaggtgaggtgaaaggcagtggaaaggtgttttaataactgggggaatggccttctaataccttttaagtattgtattgtccatttggagagactaaggctaaagatgacctgcagggagagaacagacaatgcatagatttggaagtgagaaaaagaaaagaagagaaaaagttcaccttctagtactccccccaaaattcaattagtaggggaaaagaaatataggaagtgggcatatttaacttggaagtggaaagtacctaaaagctctcaaggaaataaattattcctacagagtatggtgaccatgtattttgtatttctcttaagattaaacgaggaaacaaatttaaaatgtagtccttttggtaagtgagattttagcattggcatggtgctctctcagctttgaatagggggtagaatctcttttctcctcatgtgtatgattctctttgaaggtaatgaatgagtcaacaatacctcttgaaattttttcccagtcttgagattctattaaatcattttgttttgttttttgagatggtgtaagttttgattcatggatcagaatatcaggatcatttgaatagttctcagaaaaatcatagcgccttcatctaatatttatacagttgagatatagattgggtccctttttgtatctagatctagttcttgctttgtttccccttcattgtcattttcagccctttatttgtttctgaacttgtatataagtttattttacacaatcttaatatatacagcaaatgtgtatgaggcacacacaagccttaaatacatgtctgtgcatgctatgttagatattcttgttaatgatggcaactgccataaactccctgctcctagttagaaaaagggccatgatgcctgaaaggaatttggaacaaagcagtacccctttcttcaaatcttgatgccttaatttcttgagtgaaatttaggtatgcatcctctctgtggacacaaaaggaacttccttcttggctgtcttggccttccttcctctcttcttgggacttgtcataaccctgtattaaaaacaataacaacaacaacaagttaatcttttttttttttttttttttttttgagatggagtctcgctctgtcaccccagctggagtgcagtggcgctatctcacttcactgcaagctccacctcccgggttcatgccattctcttgcctcagcctcttgagtagctgggactacgggtgcccgccaccacgcccggcaaattttttgtattttttttagtagagacggggtttcactatgttagccaggatggtctgaatctcttgaccttgtgatccacccacctcagcctcccaaagtgctgggattacaggcgtgagccaccgcgcccggccaacacttaatcttaaaacctgtatgtttgtaggagtatgtgcttgtcgttctgataatggcccttccctcattgtaaattttaaaaaacatgtctttattctcttactcttaaaaccagtattgtttccgtggtggaataaaccttgagaattgtgggtgaggctagtggttgacgcagttacagatgataccaggtgctgcccacagactttgcaaactcactttccacagatagggctcccagacctgggcccgacagctttagagtctttgtccttccctgacacaggccggaccctccccacagagattttcctaggttctgcatctattttgattactgtcacatagtttttgatacttgagaggtatcaagaccttgtgaggtaaaatttcagaaagcatgttaggtttctggtgatccagatgtacaaattctgtacaatgaagatcaccaaatgaggaaaatgaaaatatatggatgatggtgtgactatagttgtgggccagttagatagcttctgtcatgctgtttgtgtcttggttgccatagagacattttagctaacaagcccagcatggctctttgtagtcatttctttcagttcagatttgattttcttttcaggtaagattttgagacacgtgcatgtgtgtgtatgtatgtatgtatgtgtacgtatgtgtgtgtgcatatatagtgtatgtacacacacatatatatttacgctcatatcccaagttaccagagccttcagggcttttgaactgctggaaaatagctgcgtccggtgtttaaaagccagaagcccctgtctctggccaaaaagaggtgccacatgtgattggcagagctgtgtcacctgcctggctgggaactcgagttcccgcccctacactggggatgctggagttgacacagtatggcatgctttgctgcacccttttatccctgtggttagtggtagatttggtggagcagttagccctagggacacaattgagagctgggtgacaggtcttcttacctggttccgagtagcttgtgtatatcctttgagaacagcacaacatagttaggttagcagcagctggcagtgaggctgcagtttccaagtacagagctgaacaagaagccagaatttagagggagctgcttccaggataaggtagaagagccacaagtcaggggctttgggccagtgggaagtgacctggggccaaatcatgactctcagccactgccttacctgacattccctgctgaaaaggggaaaaggcctagaccatcacagtctgtctttggagcttaagaacttgacctctttgcttgacacactcccatgtgagtgcttaaagttagtagtcatttatattcttttccaggaaactgctaggttgactcctcgtcaataggcttttttttttttaatctattgagacagagtcttgccctatcatccagtctggagtgcagtggtgaaatcatagctgactacaacccccacctcctgagctcaagtgatccttccccactcagcctcctgagtagctgggtctataggctcgtgccactatgcccagctattttaaaatgttttgtagagatggggtctcgccatgttgctcaggttggtctggaacttctgacctcaagcaatcctcccgccttggcctcttgaagtgctgagattacaggcatgaccactgtgcccaggtaacaggtgtctgagaatgtctatcagccagactccacggctcccttttccccttctgacacggcatggtagacaagtgtgaggtctcagaagaggctgcctcagccatggtcccacttccagttacatgtgtgtcctcagacttgctcagaagaggctgcctcagccatggtcccacttccagttacatgtgtgtcctcagacttgccacttgaacctctctgggtgtagaaacaagggatgaaattacctccaaggacttctctgtggtcacattctgtgaaaggctattggatttaattctctgtggttcaccttccctgactttggtaaaaatgatggttgaaagaatggatgaatttttatttgtagaatcaccttcttttaatgtcaaagaagctttattccaaaggaataaaaaaattgagtggtctcgttcccaggatatacatacactctgctgaacaggttttgaaccgtgtaataccttagaggtatgtctcacccccctggagggtgcagtaagggttctgaaggaggcgatggtagaggagacaaagaaatgccagcaagtggctaagcatttggtgggcacatgtatggccagcaaccctgtttgcaccttttctttccctgctatttatgttgaaaagcaagctaaatgtaaagctgcactttttgatgtagcactagatgtcaattctagcattaatattttgaatccatagggaatctgcacatctcatttcagtcactaatttgaacagaactcctcctcccattccaaaaaaagaagctaaatatggaattgtatatattgaatttaagatgtaaagtttctctgtgtctctgttcactttcccagtagcagtctttaaaaagcacgatacaattaaacagcagaatcaaagcaaagggagtataaagggctccagataattcccagtttgggttatcagctcccacacaatggagagttgattatttttcctttattttagggaaggtaaaagtccatggaggtgagaaaagtacacctggaagagatctgaaatattcctgattctggataagtgtgcctgtacaatgacccatggttggctttggaatataccattaaagtactggaggtcagaaaagcttccttcacaaatttggttaggtggagcaggttgctaaaacatccagcaaccctggaggtcatagaccacgctaggagaaataattatgcatggtaatgggcaattacagataatggccttccgggggtggcagaaaatacacagccccacagccttgcctggaatgaacattgaatagcacattaactttatagcaagctaaaagttcagccctggaactgcagctgctgccccccccccacccaataaaaatgtctgcctgtcttaaggtaatcacaggagtggctgcacttctcaaaagcagagtcgaataaaggaggagatgggactgtgggagacagactttggaaaagggaaggaatggtgcactctactccactgggttgcatttgcctcactaagtagaggtggtggcttgcaggaggtgcacagtaagcagttgttgctttcctggcgccaggtttgtgtttgacgtttaaaatagccctgtcatgattgccttgtgggagaaacacattgttcccgcatttcctgattatgactttagggagtaatatcacaccaaacgcactcaaggctactgtctgacctcagagaaggccaggagtggaagattccaagttcagctgagcttgggaagcctggccaggtgcagcccagccctcctgcagtaccctaatgatgaggatttggagcaaggataactttgtgcggagttatttggtggctctcttgcttgatggcagaaaacgttatggccgtgttgtgattgtgataacaataatagctaacatttattgagcactcaacacgtggcagagcctttctaagtacatgtcttctctcatataattctcaagtagtagtagtatttctttgctacgtgcaaaggctgggacatgcaaaacgtatataacttgccccatgattgcatggcattagatttcagatccgatcaattacttttgcttgggaccagtgctctcaacctgaagttgtgctgcctggccatattgtgtcattcttaatgcctgtttcatggaaagaaatatttcagacataaggataaagccagagctgcctggttaggactttattgctgtctactaataacacaaccctgagagccagctcagaataagatgccaggctctaattctctcaaatcagtccccctaaaaagacaggggctgttaagatggaagttctcaaactttttacttgcagaatctctctacaaccttaaaaagtattgaggacctcaagagcttttatttatgtgggttatatctatcgataccatactggaaactaaaattgagaaatgaaaaaaaaattatgcttttaaaataataaactcattacctcttagcatacgtaacatacttcaataaaaattactacattttgcaaattaaaaaaaaacaagagagtggcattgtttcacatttttgcaaatctcttttacgtttggcttaataggatgtaggtgggtttgcatagctgctgcttcaggtaggctgttgttctaatggaaatacaggaagaaaattcagcttcacgtagatagttagaagaggggtagaagtattttaatagccttttacatcattgtcactattctttgatactagaccaaaacttgacaagtggtaattgcttaaagattagttgtgatgtggaaaccaaaaccatgctaacgaacattttgtactctgtttcattaaaatctattcatctgtctcagacttggcttccaagatcagactagatctgctggtgcgttcaaggtggtatggccatagactctcttatactttggatggctctttcatccgtgtatgactttataacattatgcattggtcatttgggaaatactacttcagtaagttatgtacaacttccaaatgttgacacattttattacaaaataccagaaaatcacattcattaatactactgctgatcttgttagaataatcttcaagtttggaagctgtcatccacatagtggggggccataaattttctaaaattctaatttttacttgaaaactcaaatttcggcaataaatactgtcagttgttttccttgaagtgacaggctcacttagttcattttcaagagaatgccgccaaatatctgagtttcagtaattgtagtttgtcatcagtcactcttccaggatatggtgttcctttaagaaaaagcagtgagtgtagctcttcaacagttgcacaaatgtcctttttcctttggtgtgcagaaaggctgtgtgagtccttcccattgagtcacacagtttttaaaaagacgtgtactctgaggtacagatttgatcaagttactctttctttctgcttcatcaagggtgtctttagcaaaatcaacataacatttttttaaagttttaacattttccttcatagcgatgaggaatatgcgagcattagtatacttgggtagcttgggctgggcgtggtggcttacacctgtaatcccagcactttgggaggctgaggtgggcggatcacctgaggtcaggagttcgagaccagcctggccaatatggtgaatccctgtctctactaaaaatacaaaattgcctgggcatggtggcgcatgcctgtaatcccagccattcaggaggctgaggcaggagaattgcttgaacctgggaggcagaggttgcagtgagctgagattgtgtcattgcactccaacctgggcaaccagcaaaactcagtctcaaaaaaaaaaaaaaaaaaagaaaagaaaaggaaaaaaagtatacttgggtagtttgccatgtgctaaggaccagcggccttccccacccttgccgctgcatcatcagtgcccgtcaccacagcaaaaaaggcaaattacatctttatgttattgcaaaaatacttctgacctcttgggccctcagaaggaagttgtaggcgaggacctccaaccacattttgacagctgctgcgataagatgtaagggtgtgatttcttgacatcaaagcaccaagcttgaatgggtttaaagcagttctcaacttgctctgcctgggtcccattgcgggaggctgtcacgcaaagtggtctggggtgtggcctgatcatggggaattctatagaccccccccacctcctcctcctgtgcagccaggtttgaaaacttctggtttagaggcaggttctaaaacattcttggtagggagggggctctccagtcctgtacaattggataagtcactgttcatgacagccaggaaaatttacaagacaaatgcctgattgaaaattggcgataataaattgaactaggtataatcttgagttgaacggaagctatgtgaaacaatatggtgaggtataattcggtttcttaattgtatacatttatgtagaggtccacttactccttcacatcactttctggggcctgcagggacaaagacaaaacatctatgatcttactagtaaaagaaagtcataaaagcaggatctgaatcctatatctacatggagctgaccatgagcaaacttaaacatgtatctttgctaccttctgtccagctccctacatgctctagagagaaagaccctgataaattaggcttctccattttaagttgtttgattacagttgagagcagatcttttctgtggagacctaaatacatgtacacagtcagtcaaacaagttcctaatttaaaacatcctcagtgtacgaaatatttaaaaggttcaagaagggattctctgtaagacggcttttagaatgtagccttgatggataggaactgtgttgggaatcatccctttcttcttctccacccccaaactcaagctttcccattggcctgtttgtggcacaacctgctcctccaatccgctgggaggtgttgatagagtcccaaactgtctctggtatcttgccaatggtaggacattctgaattggcctaaagagagaaatctctgtcttggccgtgagacaggctttcatggccatgagacattgccttggagggtcagagaaatggcatttcctccaaatctgactctcattgtaggattaacagttttcctcggtgacttgggggaattctgaggcacaggcagaggtgtggaagaaggaggaagctgcagagagcaggaatcagggcagggagaggcagaaacccctgcaggtggaagtgggatcctcctaactttagcatgccactgtgcgttacatgccagccttttcaggcccaattaagtttctctgggggtgtgaagggggatcccaaattgcataccactgtgccaggagcacccccattctcctcctgcagtggaccctgtgctctacctgctctgcaggctcttctcttaaccttacttgtgcctcgaagctcttgttgtgtgtctcctctctttccttgacttggaagtcctttcttatcctttatacatccagaatgttctcttgcttaaaggtgtcttctgggaaaccttttccagtcctttacattctcctttgcactgttaatcacctgagctcctccaggccagggttttgcattcttctcagccaacactttgggagttgctgcacacaatggatgggctttgacactctgggcttttcagtagccccagggcagcctgtttcaaatcaagacctgctcaccttgaaggcctgtgtttgctcagcctcatgtttgtattttcccgtcatcttcctgcttgatttctttgatctggttgtgctcagtggcgcccccgtctcccctgaatctttttttttttttttttttgtctgtctgagacagtctcactcactctgttgcccaggctggagtacagtggcatgatctcggctcactgccacctctgcctctcaggttcaagtgattcttctgcctcagcctccccagtagctgggattacaggtgcctgccaccatgcccggctaatttttgtatttttagtagagacggggtttcaccatgttggccaggctggtttcgaactcctggcctccagtgatcctcccgcctcggcctctcaaagtgctgggattacaggcatgagccaccaagcctgcccaccccacccttttcactctttcactctttccagattccatacgcatagcctgccatctgtcccacattgacgctgcactcccctttgaaccaagcccgctcctatctttaaaagccaacttcaggttcactttgctatgaaaagagttcacaccaagaaaaaaaaaaggagctgacattccttcacaaccaaattacgttaaaaagataagacaaaaatctcttcctgggagaaaggagaaataggctctaccacattccgtgtcttgtgctacaggagcgacactagtgagccaacatcaggggaacctgtactttgaaggttgagatgaatcctctcccctcagtgaggagcatcccagtgccatgaaatcagtcatcatcgaatgacacagccttttaaaaaaatgcattaactcccccgacccccaaaaggagagcccgggtgcagcgactcacacctgtaattccagcactttgggaggctgaggtgggaggatcactggagaccagaatttgagaccagcctgggcaacatagcctgaccctgtctctacaaaaaaaaaaaaaaaattgccgtgtatggtggcgtgcccctgtagtcccagatacttgggaggcagagacaggaggatcacttgagcctagcagttggaggctgccgtgagccatgatcacaccactgcacttcagcctgggcggagcaagacctgtttcttaaaaaaaaaaaaaaaaatggggaaaacaacttacgcttttgctataccctcgtagcgctcaacacaaagtattagttggtgatggatagttttcagacttactggtgaataattttgcctgactggtatgtaactcttaaaactcagaagctaagtaggacaaacaccatgcaagatatggggttacaaagagaaaatctggagtatataaattaatcgtttacatgacctcatgtgaatcacaagtagtttactgtttgtaaatggtaaatttggttttgtgacctttttttacttcatgctggaaactgtgatgtttggttttttcatggaggtgagtgtggatccagatttgaacacaaaggactcaaagtgcaacaactttgggaatcatgacaccagcaaagaggggggcaagccttcacccaccttaaaatgaattactggttaactactattaatatgtcatgggcccagagaccagcatataacactccacgatcagtaagggtatttatcatgtgcaggtattgatccctcatgaaggagtgaatcatatttcacactgcatgttagtgcaaaaaaaaaaaaaaagtagcagagggattgtgaagccctatcaaagaactgaatgtgcagaaagtaaacgggtgtagccatgaacatgagtattagaataagaggtgactgagctcataagcaacatctctgcagatgcatctgaggggagacagtgagctctgttatggtctgtgggacaaatgctattggtaatttttccagatgtgtatttcttgagttcctgatgcttttctgagtggttggatccagtccttctgatcttttgttcttattgcacaaattaggagtatataccaatggtaacacttaaaacatctggccaggtgcggtggctcacgcctgtaatcccagcactttgggaggccgaggcaggcagatatttgaggtcaggagttcgagaccagcctggccaacatggtgaaaccccgtctctactaaaaatagaaaaattagccaggcacggtggtgcgcacctgtaatctcagctactcgggaggctgaggcaggagaatcacttgaacccaagaagtggaggttgcagtcagccaagatcacaccactacactccagcctgggcaacagagtgagtgagactcggtctcaaacaaaaacaaaaacatctaacttcatatttccatttgcatcataacagcagatctgaaatgggaaaggtcctcttgtccccgttttagagcgtgtgaaggaggcatggcttgcttcttcagtgccccactgctcaagcctctaggggagcatacagatgggcaggccgtggggctccgaccccatggcagtgtctaggggtgaatgtttacagctgaagccccagtgggtgtgtgttacagggtgccttttagtttagctgtctgtaggtggcttgcgttagtcggctcaattagatcctctgccttattgcaaggatagagggctttctgtatcccctggttcttgccttggtgtaccaaaagaatgagatcacatgtgggcttggagaatgagtgtaaggttttactgagtggaagtagctctcagcagataggggagtcagaaaggagatggttttcccctggagtcaggctgtcgagcggcccgactcttctcctacttccccaaccaaacgcagcgttgttctgctggtcaaatggcctaggcccatcaatgacctgccagtgcctatcagtctgctctcgacgttgagctgcttgccttcttccaccaatctactcgtctcaatgcccagccgcttgtgtgtctgctcgctagggtttcaggggttttgtagacacaggatggaggcatggtggtccagggtggtcttgggaaatgcaacatttaggtgggaaggcagaagtgcctgtcttcagctagtccatgggcacaggcttctgcagtggagccttcgcaagggaccacgcccacctctacccagcacttccctgcccacttctgtatcagatctacaggttgataattctgtaatggactgtaagggactactggttaagaaagccagcacattctcttggaaagagtgctgctagctttctgttattattcattataacaacacagcacattctcttgaaaacaatgctgctagctttctgttattattcattaagcaattttggccaattatcattctagaaaaatagagagtgagatctagcttaagaattttcagcagactcattaaaatgtttcccttcaatatacttctgtggttgctgtacttagttgtattggccatgcagttttaaaagtccgtgttacagtgcacacaagccatggagactggcaggagtaattcatactcagatcaagggacttgataaacattggtgcattcagctcaggttcatggagccaactgtgtttttttgtttgtttgttttttatttttgagcggagtctcgctctgtcacccaggctgcagtgcaatggtgcgatctcggctcactgcaacctccgcctcctgggttcaagcgattctcctgcctcagccttctgagtagctgggactacaggcacgggccagatacacgcccggctagtttttctgttttttgagatggggttttgccatgttggccaggttggtcccaaactcctgacctcaagtgatccacccgccgcagcctcccaaagtgttgggattacacgcgtgagccaccgtgtacggccaaactgtcacttcttactgtgacttttttttttcctgtggctcagagtgggaatggatatggttgggggagcttattaattgtatgtggaaaaccactttttgaaaactttatgtatatataaatatatacatattttaaattttgtatgataaatttgtgtgttttgtggcgtatcagttggaaatattacttttaggtttatcatcaattaatagggacacttaggctggcctgccatctttgctgacaccccagtgttgaagcaaatattgctggcttctctctggggagtttgctgtagcatgggctggacagatggtaggtatactctgcttatgcttatcctctgtcagtctgggcaaggaatcggatattccttctgaagctgcttattctatgatcactcagcagttgaacaagcatcaaaagggaatctggattgctttcctggtctctggatgacagatattaacaatgtaatttattagctgggcgtggtggcgggagcctataatctcagctactccagaggctgaggcaggagaatcacttgaacctgggaggcggaggttgcagtgagccgagatcaggagatcacgccactgcactccagcctgggaaacaatgtgagactgtctctcaaacaaacaaacaatgtaacttagttgtttggagggaattcatagaaaaggagatctgccagtgattttcatgaagttccttcctttactacggcctccttgtgcaagcttaaagtgacttcttgcctggagtatttaaagcacctagtctattcccccatctccttattctcttaggtctgttttttgtgctttgaccagattcccaaatatatttctgctactcccttgctctgaaaaccttcattggttccctagaggagaacttgttggcctggcattcacattcagggtcttcagcaattaactccagcataaccttccattctcatttgcagttgtcacttgtgaactctgcagtccagccaggctcatctggtcactgtggctggagcgcgtcttgtcctttctctcctttgggcctctgttgacctccctcatgactctattggtattattctcctttttttgagtgtttacccactgtctctaaatcacctccactctggctcatcactcaccgtggccttttctgacacctctctatatagaaccatttggtgacattatctatactgtcactgcggcacttggattattgctttgtagatttcccagtttgcacctaatttccccaaatagatggcaaattcttaagaaaaaatgtaatgtttaaagtatgtttttgtgcctttgacaacatttaaagaaagctttgaacatagttgttatatgataactagtgaatgaatcaaatctaaatataaaaatacaacttaaggtcaagaataaatgatttttgtaacacctgctcctctggattacccagaagtcttctgaagaatattaaattttgactctgcaatgttttgtatctaactgaatgcctgacaaatagtaggtgcttaataaatatttgtcaactggaataagcatttgaatagatgaattaagttactgtggttagaataaatgaagaaagtctggatgtaagccatgaaactcacaaccatttggcagcgatacacacacagtacatacagcttgggatctaagctctgagtgatttaggtagaagcctagcttttcaatacaatggaattctttttttttttttttccttttgagacagagtcttgcccctttgcccaggctggagtgcagtggtgcgatctcggctcactgcaccctctgcctcccaggctaaagtgattctccttcctcagcctcccttagtggctgggactacaggcatgcaccaccatgcccagccaatttttatatgttttgtagaggggttttgtttgcccaggttggtctcgaactcctgggctcaagtgaaccttgtacctcggcctcccaaagtgctgggattatagccaggagccactgtgcctgacctcatttgttgtatacttttatttaatagtcaggactgtcacagcgatgcagtcaggggcatgaaggtatctcatatttttaggaatagcgtgtggagcagttgttaatagtcaggactgtcacagcgatgcagtcaggggcatgaaggtatctcatatttttaggaatagcgtgtggagcagttgctttgaattttgagagtacagccgtgtgtctcaacagttttagcacatcagaatctcctgggctggatgcagtggctcacacctataatcccagcactttgggagggtaaggcaggaggatatcttgagcccaggagtttgagaccagcctaggcaacatggtgagaccccatctgtattaaaaaaaaaaaaaaagaatttctggagagcttagtaaaattcagattgctgggcgccattctcggggtgtatgattttgtcagtctgtggtggggcccaagaatttgcatttctttacgttcccaggtaatgctgatgctactgattcagggaccacactgtgcgaaccattggattagacacatgtagcttgacagatattaatttcaacctttccatgtactagcagtgttcatataaatgccaggagttatgaagctgtttttaacactgactgagaattttaattgggaattttaacatatagaattcggtggtttatacacatagtactttgtcaaatctaacttttttaaagtggttaaacattttaacagcgtaaaggcagacatctgctcttccaaagttcaaatggttttattatttaaatattggtatggaacaacttttccaatacatatctcctatttattcttaaagcttggtataacttgaaagaggaaataaaatacgggtaagtggaaaagtgatggtgttgttaactaattacagtcagctgtaacaaaacaaattattgctttgacctgacgtagcattttagttgaggtttactatgcagtttattgaagccattctcttgttaccttcagagttattactgccattattttgttgcttgataaactgaggcctgataaaaggttcagattaaggtcatgctgcagaaattcaagaacttgtgctgtgccctgattctggaatgctggaatccttgggtttctatttattcgtctgctactgtattttgttttcttttttaagaagcttgcttttgaaaggcaggccttaagtgggaggtattcagtgtttttaatgcagggacaggcctaagtgtctaaaatgccttcctaaatgtctgtgagattgtataggaatgaaccattaatgtttatgactgcatggtaggataggtcatttattctttttctgacttagatgctcatataatttattaaatttgagaagctcataaggcttttgtaatcagataaacaatagagacatgaccttgaaaacaaaagaatgatatagaaaaccaccacttaacgccaccaaacgtgtttttttttttttttttttttgagccggagtcttgctctgtcacccaggctggagtgcagtggcgtgatcttggctcaggccgactgagctgagatctcaggccgcccgcctcagcctcccaaagtgctgggattacaggcgtgagccaccgcacccggcccaaactgatgtttaaaataagagaaaggcccagtggggaagttgaggaggagcgaatggacatgtgccctctccagacttgggggtgtggaataatggcattggaatgtctcatctcattagctgggaagaggagagaagaaaggaaaggaatagaataaaacagtggtttgggagtgcatttacaggagcctagcataggtggatttggtttcctttcagagaaaagtgacaccaatgctgactttaaaatgaggcttcaaaaataaattttgttgtagatctcagccagaccttccagagcttgcactttagttttgccctctcccttgcatgtttttgttttcccacacactcagccagtggatggtttctgggcaccttctttgggccatgcattgtgctggaaatttctctcatgagccaattctgtctgcttaaggacacttaaacctctatttatttctttatttttatttttttatttgagacagagtctcattctgtcacccaggctggagtgcagtgacgcgatctctgctcactgcaacctcggcctcccaggttcaagcaattctcctgcctcatcctctgcagtagctgggtctacaggtacgcaccaccatgccgatgtccggctaatttttttttgtattttttttttagtggagacggggtttcaccatgttggtcaggctggtctcgaactcctgacctcaaatgatcagacctacctcagcctcccaaagtactgggattacaggcgtgagccaccgcgctcagccttaaacctttttagaaaagtgaaacaaggccaggtgtagtggctcatgcctgtaatcgtagcactttgggaggacaaggtggtttgattgctggagctcaggagtttgagaccagcctgggcaacatagtgagaccccatctctatacaaaaaaattaaaaaaaaaaaaagctaagagcttattaaaattcagattgcttgagctcaggagttcgagatcagcctggccaacatggtgaaaccccgtctctacttaaaaaaaatacaaaaatcagccaggcatggtggcttgcgcctgtattcccaattacttgggctgctgaggtgggaggatcgcttgagcccagaaggaggaagttgcagtgagccgagatcgtaccactgcactccagcctgggcgacagagtgagaccctgtctcaaataagtaaataaacaaaataaaagtgaaacgacaagatcttatgactccctggaggttttacttttttttttttttctcccagacggagtcttgctctgtcgcccaggctggagtgcagtggcccaatatcgtctcactccaacctctgtctcccaggttcaagcgattctcctgcctcagcctcccaagtagctgggactgcaagcatacgccaccacgcctggctaatttttttttttttttggtatttttagtagagacagggtttcaccgtgttagccaggatagtcttgatctcctgacctcgtgaatcacctgcctcggcctcccaaagtgctgggattacaggcgtgggccaccgtgcctggctggagcttttacttttaactcacattatttttgatgccaagctacttgaaaaatgattattcctcagtcccttcagcaaatattgacccactgtgtctggcagtgtgctaagcacggaggacacagtggtgtgcccggaggctgggtgccttcttgctggatctcacgtcctggtagtcctggtaggagagaggccattcactggagtcatctctttggatttcttgttgcttgttgctccttgctctcttgcaggcctgcatctgctcctttcatcatggttaaaaccgcaaggccctgaagacctagttgtctgttggtcttttctagaactgtttgcttgatgtcccagcagcagttgacaccacagcctgcttgctctgtgattcaagtcagctttaacctctgtgacgttgtattctctgtttttcacgctccaggtcttggctctcctttattctgtaacagctcctcccttccttgcccagatggagctagcacctccagtggtgactcttggatctggcttccagtctcagcctctcccaaaagcacgcgtttcatgttcctcaccctcacccagccctccacctgcacacctgcccaccctctgctctacacacccaggctcctgctctctgcctcccctgcatcttaattcctggcagcccctcagccctccagttctgttgcgtttcatcccccacatgtccctggaacaggctcctctcttacatttgcaggccttagagttctggtctgtccttgaactcactttggtggttccctagcaggtctttctgcctctgatctctctctccttcacttgccctaagcagttgcccttagataaatctcctccaagcacagctctgaccgtgtaacctccttgctcagaactcagtggttcccattacatcccagagtcaggagagctggactgaggcccgcctcaccttaccctagcccatctttcatactacatgtctccttcccttttctcatccagttcctcagcctcacttccctgcccatcattccaaactctacccccactttcctgcttccactcctttgtccttgctgctcctttctccttcctctccttttctcatttttcacctgtgtcctgcatctttttttaagtgcaactcaggtgcagttttgtccatgaatttctaactaggctacaagccatctctgtttcctctgacttcccatggaagtttatgggtcttcctgtatgatggtaggtggtaggtggtattcccttcccatcttctatcctagaccgtagactccctgtgggcacggcagctggcagacgtttcaggcacccggactggctcttagaacattgtttaataaatgtccattggatggatgacttaggaattcatttattggaattgacaataaacactttaatgtctgtgccagaggttgggaaactagtctttgggttagatcagcccactgcctgtttttataaataaagttttattgcaacacaagcatgctgcagcagtgattgaatagttgacaaaacctgaaatagttactgacctcttacactagaagtttgcccctggtccgcacctttggccagatttctgaagatacctgatcacctgtggaaggaagttaaggaaacaggtgttcacctaaattcacctaaactcttggccactcgttttgactttctaacctatctatgtggctacaattaattttgttttaagaatgcacaatcaggtcaactagatttgctcttcagtttcttgacattaggataggaatttctggatagaagttgtgctgttgggctttatgtaattaaaatcacctctaaaatggttttgatactctcagtaaaaacaatcagctgagtctttcggttgtgccaccagagtgaagcgaaccttagaaactctcccttattttggctataggagaagcaacagatggttttgtcttctgcatattcagctaccttgctccgcaggtcttgggtaggaaggtttagaagtaaagtttcgtggactaacattaataccatgttgtatttttcttttttcttccaatttagagggacgtatggtcatccaggatattcctgctgtcaccagcagagggcatgtggagaacacacctgacctggtttcagactccacctactacagcagcttctaccagccgtctctgtttccttattacaacaatctatacaactgcccgcagtactccatggccttggctgctgattctgcttctggggaggtgggaaatcccctcgggggatcccctgtgaagaacagccttcggggcctccccggaccttatgtgcctggtcagacaggaaaccagtggcaggtatgatattaattacccagagagtgaactggttgtgtgaaagccacatgcatgtgcacacacatgcacatacacacagaggcacacacgcacttgtgcgcccagaggcacacacaggtgacacacacaggtacacacacatatgtgtgtgtgccattttgcacacatgtaggcacaatatgcaaaatgtgtaaggaattttttactctgtcaataatgccctttagcctcaaaggttggctgcaaggaattggaaagaaataatgtacaaacttgttttctttttcaaattttacttttctcattttttgaatgttgcataaataaccagttgggcacaggcagatcacaagtactgaatgaggtaccacctcctccagctttgtccccactttcgttgggcaccttagaaaatgctgggtaaagccttctgggtggcagtaatctgcgtgatgaatttgcaccttgggaaggaaacaggtcataatctgtatggaagaaaggtaagaaaaggaattcggtcactgttgagctggacccaacctgggtgcatttttcgctaggaatagaggtcagtctttcattctccaagtttgtttttttttttgtttgtttgtttgttttggtttggtttttgagacagagtctcgctctgttgcccaggctggagtgcagtggtaggatctcagctcactgcaacttctgcctcctgggttcaagtgcttcttttcacctcagcctgtgaagtagctgggattacaggcgcctaccaccccacccggctaatttttgtatttttagtagagatggggtttcaccatgttgaccaggctggtcttgaactcctgacctcaggtgatccgcccgcctcggcctcccaaagtgctgggataacaggcatgagccaccgtgtccggccccaagtatgtatttttaaaatagcatgcaatcaagggcatttgatatttggagtaaaacaaagcattttactttattagagaagggagcgtttatctagggctgttctgcttcctcagttgcaaccattttcatcatgcccgtttgttagcagcagattgaaggcatcaaaagcattcagaggctagattaccttgtacagaggtatgttgtgggaatatgtaggtgaaaagttagactcaacacctccaagccctcttccaagtgaaagacattaggattctgcaagaactgttctcattctggatgcatttgccatgctcaggcttcctcagtggggatttgattcaacgcaatgccacatatatatttgggagttcagtgcaagtgtttgaccctctttttcactttcccagctttattgacgtatcatgggtaaaaaaagttgtatatatttaagatgtacaatgtgatgatttgatatatgtgtaccttgcacaatgattgccacaattaagctaattaacaaacacattaatcacctcacatagttaccatttttatgtgtgtggttgataacacttaagatctactctattagcatttttcaggtgtacagtatattattaagtacagtcaccatgctgtatgttagattcccagaatttactcatcttataactgaaacttttttttttttttttttttttgagagggagtcttgctctgtcacccagctggagtacagtggcgcgatctcggctcactgcaacctctgcctcccgggttcaagccattctcctgcctcagcctcccgagtagctgggactacaggcacgcgccaccaagcccagctaatttttgtatttttagtagagacggggtttcaccatggtggccacgatggtctgtatctcttgcccttgtgattggcccacctcagcctcccaaagtgctgggattacaggcatgagccaccactcccagccgtaattgaaactttttaccctttgcccaacatctttttttttttccagctcaatgaattttatttcccttgttgtatataaatgctttgattgaccagtagatatttgtcaaccattagtatcttggttctgttgaaggagtaagaacattttaaactgagattttttttttcttgtcttttcttttttttttttttttttcctgagacagagtctcactctgtcgcccaggctggtgcgatcttggctcactgcaacctccacctcctgggttcaagtgattctcctgcctcagcctcctgagtagctgggattataggcacgcaccaccactcctcgctaatccaacatccctttatttcctccacctcgagctcccggcaaccactgttctctgattctgtgaggttgactttttaagcattatttaggccaggtgcggtggctcatgcctgtattcctagcactttgggaggccgaggcgggtggatcacgaggtcaggagttcaagacctgcgtggccatcatggtgaaaccctgtctctactaaaaatacaaaaattaactgggcatggtggcgcacgcctgtaattccagctactcagaaggctgaggcagaagaatcgtctgaacccgggaggtggaggttgcagtgagcagagatcgcgccattgtactccagcctgggcgacagagtgagactctgtctcaaaagaaaaaaagaattgacttttctaagcccacttcaagaaaatgtgaattgaaattttcctctgacccattctgttccattttgcgtctgcctttttcaggtattaaaatgttgttaaaattgaagtcattaggttgataaaattgaagtcattccacttttgggatcttttgctaccctcagggatctgacttcttgggcatattaaaatgtcaattttaatcccctgagctacaaattttcttaagttcttcatacgttttatttttggaatcatattattattattattattattattattattattatttttgagacagattctcgctctgtcgcccaggctggggtgcagtggcgccatctcggctcactgcaacctctgcctcctgggttcaagtgattctcctgcctcagcctactgagtagctgggactacaggcacgtgccatcacgcgtggctatttttttttctgtatttttagcagagatggtgtttcaccatgttagccaggatggtctcaatctcctgacctcgtgatccaccagcctcgggctcccaaagtgctgggattacaggcgtgagggaatcatactatttttgaagggagcttttaaagcacattgatattggaattgagaggtaatatacgtataaaggaaatgcaatgatctgtggaactgagactgagatgggagcccgggagttggaggctgcagtgagctatgattacactactggactccagcctgggtaacagagcaagacactgtctccaaaaaaaaaaaacaaaattaagtagattttgcattctactatcttctccctattatgtcgttgttggttttttccaatttaagaatgttttaaaatcatgtttgttcattataactgtctcctgagagccaccgcgcccggcctaaaaaatctattgagttcttgactgtttgttcatatgtattttcgttagctacctcagatcccctttgtagcaagatagggtataaaaatacatatgttaactattatcaaaagactgacatgcgaatatggaccaagtatgaatgtgtatggattgatttctgtatctttggggaagaatttgatgcccttaggaaatagaaaacataaagtataggtaaaaatgataatggtgcaaaatgcgttaagacatagatgttataaagaagtattaaaattaaatagtaaaaatctacaaataatacctttagctaatgttgaagggagagaaactggatggctcactttttaaccagagtcgtttttcttttttcttttgttattgttgtttttctttttttgagacagggcctcactctgtcattcaggctggcgtgcagtggcgtgatcttggctcactgcaacctccacctcccaggttcaagtgattcctgtgcctcagcctcccaagtagctgggattacaggcatgtgccaccacgcccggctaatttttgtatttttagtggacatggggtttcaccatgttgtccaggctgttctcaaactcctggcctcaagtgatccgcccactcggcctcccaaagtgctgggattacaggcatgagtcaccgtgcctggcccagagaggtagcagaagtgtcaggaacagagatctggatggcagtcttttcctcacttcgctttttctgctgttcctggaaggctctctcactctgctctttggacaatgccttgcccctcttggtggcagcttcctaggagagggcagagtcgggggctcttctttggttgctgccctgcttttctgtcttctttgtagaaggtgccccaccgctgcacttggagagcacctgtgctgttctctcctgactgattttcttggtgtgaaaatggctcaaccttgaggccagaatgtgaggttgggtcttcaactactttcttgactgtgttgctaaggccggactctcctcctaacttaaccagatggagtcatctttttattagctatcctgcctagtaggatgtaaactctctttttctttttagattgtgatacaaatttgggtagtgtggacattttagccatattaattcttacagcccatgaacatggaatatcttttcatttatctgtcttcggtttctctcatcagtgttttatagttttcagtaaagaaatctttcacctctttgattacatgtatttttttaactattgtaaatgggattgttttcttgatttctttttcagatggttcactagtcatgtatagaaatgctaactaatttttgtatgttgatttttgtatcctgtaggataactcctttctgatttatatcagaatcaagaaagattcaaatctttcttcaaaaaaaatcaatattttaaaaaagaaacaagaaaacaatttgtattaaaaccaacaactcctttttgattcctagaaaaaaaaaactgactctagtggagatcgtcataactttttaaagctagaaggaattcttagagatgagtagaaagggtttcgaatttttattgtacagttgagacttcctgcaagcctccctataaaaacaagcaagccacgaataattactgagcacctactaagtgccaaacctccttaaaaaatagagcagtctcctagctcggcattccagaatcttaaggctcttttgtgtaaatgccctgcctgctgagagctgcttttaattgcttctggtctgcctcagcctgtgtaggagatttgtggcccaatcatagattcctgtcctgttgtgaaacaggaataacatttgtgacactggaacaaactcacaatgaatggctggttccgctgaccagcagctcaatttcacttctgcatttaattgcctgcaaaagctgtttattgccttgtgcactcctccaccgcaacattatctcttaaataaacatgttgtaccaggttgacaagggagaggtgcgtatcgagtgagcagaaataaatatgggaggactctgagctatgcctcggatctcctttcaggccctatggcaggcgccctcttgactgcttttccaaagcttgtgcccccagatgtgtagacttacattccagccacgtttagggtgtggccaaatggcagcactggcagttatttcgttctttctggtggttatgtggtctcctctgaagtgttttatggttgtccattgacgataaggcacctcgaaggaatgcattcatgtcttaacatgcttccagagcccaccatgtgctggggatctaccactgaacaaaacacaaaaattgggaaaagtgagtcttgggagaaggctgctatttcttgatccctggagttggggattgcctaaacctttctacaggtaggaaggaaaccgcgttctggcatctggagcttgaagcacagaaaaaagtgcccccttgtgagtgttcctggcccggtgctccagcaccttctgcctgctgagggtggaagggttgggaagggcactcagaaaagccagtaccttttcactgcttgtccgccgtaaggagcagccagacaggctctcgttttcccactgccccccctttttttgttgttttttaagtgtagctcagcatcagaacaacctgtttgttagcttgaaagaatggtcaaaacaagtcactttccaaagtatctgctgtgtgggggtggccagagcactctctgcagctgtgccatatttgtgctgtaggaaggcgcagtgagggtggagccatgggaagacaaggcggaaacctggctctcaggagacagttatgatgaacaaatatgattttaaaatactcttaaattgaaaaaaaaacaacaaagacataatagggagaagacagcagaatgcaaaatctacttaatttttttttttttttggagacagcgtcttgctctgttacccagactggagtgcagtagtgcaatcgtagctcactgcagcctccaactcctgggttcgagtgatcctcccatctcagtctcacgagtagctgggactacaggtgtgtgccaccatgccacacctggctaattaaaaaactttttttgtagagatgggggtctcagtgtggtgccgaggctggtcttaaacttttggctcaagtgagcctcctgcctcagcctctagaagcgctgggattacaggcttgagctgctgtgcctagctctacttcagttttttttttttaattattattattttttaattgagaaggatcttgctctctcacccaggccagagtgcagcagcatgatctcagttcactgtagcctccacctcctggacttaagcgatcctcctacctcagccccctcagtagctgaggctacaggcatgtaccaccacacccagctaatttctgtactttttgtagagatggggtttcaccatgttgcctgggctggtctcagactcctggacattcaagtgatctgcctgccctggcctcccacagtgctgggattgcaggcatgagccaccacgcctgaccaattttttgtgtgtttgttttttattgtgagacagagcctcactctgttgcccaggctagagtgcagtggcgcgatctcggctcactgcaacctctgcctcccgggttcaagcgattctcctgcctcagccttccaagtagctgggattacaggcccctgccaccatgcctggctaatttttgtatttttagtagaaacggggtttcaccatgttggccaggctggtcttgagctcctgacctcaggtgatccgcctgccttggcctcccaaagtgctgggattataggcgggagccaccgcgcccggctgcctgaccaatttttaagacatagtaggagacttcacatgagtttttttttttgccactgagctccacggtcaggtttcccaggatgatgtgctctggtcactggaaactcctgggaagttctggatggagaaagcgggagtgacttgccttacgaacctgccctgggccctctcacccttggccgggagcccttcacagtcttgttatccacaagataacaccctcactccaaggctgccctctcacccccatggcccacaccatcagcaagtgaaactagccctttttttttttttttttttgagacagagtctcgctctgttgcccaggctagagtgcagtgatgcgatctcagcccactgcaacctcctccctagttcaagcggttctcctgcctcagcgtcctgagtagctgggattacaggcgtgcaccaccacgcccagctaatttttgtatttttagtcgagatggggttttgccatgttggccaggctggtctcaaactcctgacctcaggtgatccgcccccctcagcctcccaaagtgctgggattacaggcgtgagccaccgcgccagccacttttcaactttttaaaacataaagtgatgtattagatggtgggatgttttttgttaatgctcttattcagcaatgtaaaaagttgatacccgttgtctctcgcctccttcctacaccccctcctcctccacctttcttttttaagactgctgcagtactcagtgtgtccttgtgacaacagtgaagttctttaggggcttcagtgtgctccctttagcaattatgtggacttacatttgtgcttacctcttgacttgcagggtgcttcccctcccaccacattttttttttttttagatggagtcttgctgtcttgcccaggctggagtacaccaatgcagtttctcggctcactgcaacctctgcctcccgggttcaagcgattctcctgcctcagcctcctgagtagctgggactacaggcacacgccaccatacccagctaatttttatatttttagtagagacagggtttcgccatgttggccaggttggtctcgaactcctcacctcgagtgatccgcccacctcagcttcccaaagtgctgggattacaggtgtgagccaccatgcccagctttccgctcctttttatgacagccatgggaacaccctcatgctggtctagcattttgaggaattcattcacaggaaccccaagtaggttctgctgtcaggtacatggtgaggatgtaatgattgggcctactaggtcagtaggcaagttttggagactcttctgtttaaggaaatgcaactccaaagtcatgatagaccctagaaagtttaaagccagtggaattaaagctgtcatgttccctgagtttgggggtcacattactattagtataaactttgccttaaatggcttgtcaagtcttagccatgcctatgatgttttcttctgcaacataattcctcattaggttcctctcttttaaagagaaatagtggacccaattctcttgggtctttacaacatagtcttactcctgcagggagcaaagctttctttctctagctggccctgtaaggagcagtgagagtccttgcccacccccacccacattactcctctgaagcattaagcctgggtgaatgcagtcccggctttctgtttctaggtgatcacctcacctaccagcactttcaccaaggagttcctattttgtctcattttagctgatgacaagtgatgatcgtgacagtcatcatctggtttttattacacctttccttgaaggaattgctgttttgtttcacagatgatgaaagcttaatgacttgcatgcttttgatcctgcagcaagggtagttgtttgtaagaactggtgcctgcgatgacaattttcccagtggctctttgtctggagccaaagctcagggagggtgatggtgggaagtttagccgctgagcccagacagatggtgagaggttgggtttaggaatatcccgtagctacagtatagtgcacaggagagacatttttggagtgtgttttggttaaaaatatgtagattccagaagaaactagaattggcctctggatacctggggccctggagaacagacagctctgactcagagaatatctagaaggagtgcagacctgggcatcctaagggattgttttttcagtctggttgaagtggtccagtagcatcccaggaagccagatagagtgaaacattaggtttttcagcaaccttcggaagacttgtgtaagtcctgggctgtcctacagattcatttccattgttagatgacttcagtgtgatctgggctgagtaagaaatcccctgtaaagtgctgatgtactccagggactacttcacaattgaatcggaggcagaagcatattattagtcttgcgaggttgttacattacctattatctgacacagtagcattaggttagtaaataatatagtcatttggggattctgtaattggcttgaaatttagataattagatcacagtttttgaaagctttcagatttgatttggtttggctggtggccaaaatcttatccatttatgtttgcccttttagcttactttttttcctgttaagtagacatgaatatgatatgaaattagttgcttttcagaacgtttaattacatgtataagtgattctcagatttcttaggagtctatatttctgtggtctcttaagtgttcctcatcatttgaataaagatgaaaatcaagggaatgcataacaggtttgccctgttttttcaataccataatagaaataggatagaaaaaaagactagagttgccaaaaaatatccactgtattacagagtatgcgttagagactcctttatgcatttgttgattgtttttattgagtggctgctccgtgcctggcactgtgctagagactctcaagtactggctcatggtggaatggatgagaaagaaaactcaaaagacccatgtggccgggtgctatggctcacgcctgtaatcccagcactttgggaggccgaggcaggtggatcacctgaggtcaggagtttgagaccaatctcagcaacatggagaaaccctgtctctactaaaaatacaaaattagctgggcgtggaggcaggtgcctataatcccagctactcgaggctgaggcaggagaatcgcttggaccagggaggcgtaggttgcggtgagccgagattgcgccactgtactccagcctgggcaacaagaacgaaactccgtctcaaaaaaaaaaaaaaaagacacatgtaattctcttattcctgtttcgatcagagcccggggagaactgtgatgccttgtggaaagatgagcccttgctgtggcatgccaagaggcagggtggggacaagtgtttgatcacaactattgtttagaatttccagtgcatggtgatagattgactttagtggattttatttttaaaaaattatcccacagtgagtgcacccccttactgcctccccccaggatgggttgccctcagcaccccctccttggtatagcattggccctgtgggcatcaccattgagatgcacagcctcctggaaggggtgttcatacatagactgaggaacagggaaaaaggtattatccccacattttatttatcacattccttctcacaacattctttctggcaagtcccagttctaggggaaggaaggcagacataattctatgtctggagtatttgtataaaaccaaaaaatgggaaggcctggaaatttcgctgtctcctcactcccttgcccctgtgtgtgtgtgtctgtgtgtgtgtgtgtgtgtgtgtgtggcactgcaggacatgtcaaactaaagtttatgtacttaaaatcacctttaaagtgtataatggaaaggttttttgtttgagtcatttgtttgcaaaccccgaagaggagtctttcattgcggtgccccgttctcccgttgacagaagcaggtggacccgtgaggggaagaggagggtgcaagcagaacagccctggaacagtgtcacgctgctgggcacttcctgtctcctattccatttcatccataaacacagcctttccgggctgtgagcctccttttgtggatgaggaaactggggctcagggagatgaagtagctagctagtactgcacggctggaaacggggaagctggatttggagtttgcctgactgcagagaggcacctctgttcccgtggtgtctctgctttccttgcagggcagtgcacatttcttggttttccttttaaagccgtgaaattctggaaaatcactaggcatgctgtctctcaagatgcttctgtgacacacacacccacacacacacacacacacactcacacactcttccaaatccatgtactttagggaacagtggtaacgtgatgcttttggtcattcttgtgtcatttcaattagttggaggtggactcccttcatggtcttagagtgggcagggctttttcctgccacccacaagttgagtgtgtccatcagaggtcaccagcctgcgtcggatcttgaataccagtttggtaaaggatgtgagtgtgtgcgtgtgcttagttagaatgtggccccagacagcctcacgttgccctcccggcaggctctcatgttctgtgctcataagacacccttcacactgctgatttatgctaaaagtatcctaatgtttctgacagctcatgtgtgacatgaatataatccatatttcttacagcagctaatccaagtggcttattttcctatactgctgatagggctatatctcttgatgtcgcagccctggagattgtgatggtgacatattgtttctgggtcactagttttgtctaaaacagtaggttggaacagagtagcaaaggttaattaagtttgtccatcaaggtgggaacagatatggatgcctctgatgtttctggttctgaaatcaaagttcctaaatgtgcggttgtgggcatcatttctcattttcagacaatcaaaaaaaaagtttatttgctccagaagtagagacaatgcgaagagttgttaaaagctaaaggcagcaaagtaggtctttatactaagcagataccttcatttaaaattagaaagtttccttggtttagtagagagaaatctcagaagcgtctgaggtgatttactttgaatcttgctgtctgtacttaattccttgggaccagaaccaagttatttgatctctctgagcagtttcttcctatatcaatgattattaaattatgaagactcatgagataacaagtctctatattatttctcaatagatgctcattttcttcctctgaaatttggttaatcttatcgtcagtaaccagtattttctcaggaaaattaacattaagaatatcatcagtacaacccccatccgtacaaacacacaccccagtcttaagaagcattgtagatgccttcagagactggacatgtgagagagtggagcgtgctgatcattattaaccaaatttaaaaaatacaacctttttaatttcctttctctccagccattttactgaaactctgtttcttagttgcttttatgtaaatggtacttgcatttatgcctggtatacatgggttcagttgggaagtccgggtctgtattttagatttgtgaactagacaaatgtaggtttccaacccaggaactggaaaatcctgcatagatttctcaagatgaagaaggcgctgagctagtcccagccagacactggtccaaaccaaccaccccactctcttttgtgaaccccctgatatgcaccaagaccctttcaggttttaggaaaaggaaacattttttaaaatttggctttttcttactgtttacctccttttagaggtacttgcatccctttacctgatttatacgttggtgtctttcaaacattttagattgagacccacagtaagaaactgtattccagtatatatttacacacacatacacaaaatgacaagttttgtagaacagttcttaccccttacccaaattgtatatgcaatgaattcttatatacagttctcttttattctgttctgttctattctattgcattctgttcaattccatacagttctctaaaatatatatgtgtgtgtgtgtgtgtgtgtgtgtgtgttatatgtatataacacacactgactgcatactgaattatttgagggccctataaaaggtaacacttctgccttttggaaaacatggtctcaagaagtacactgttgttccgtcagtaccactgatggcagatggtgaaaacagttgaacaacacaagttaaaaaaataatttggcctttgtaaaatgtcaaaatactcacatctgaattgcttctgggctaaagataagcaaaatggaccactaataaatacaagtgtaatcctgatatcctatggggtttctatccttaatgggtattcaggattgttgtgggctgggcatggtggctcatgcctgtaatcctagctcttggaggggggcccaaggtgagaggatcacttgaggccaggaattcaagaccagcctgggcaacatagtgggaccctgtttctacaaaaaatataaaaaatttagctggtcttggtgttgtgcgcctgtagttctagctactcaggagcctgaggtgagaggatcacttgagcccacgagattgaggctgcagtgagctgcgatcacaccactgtactccaggctgggcgacagagagaccctgtctctaaaaatgtttttttaaaaaagactgatgtgaatttctcttccatgccctctccacaatttatggaaattgcgggagggcttgctttatatccttgtgttcaattttggttctgtttttccatgtgagttgtttgtttttttatggttcaccttagggctgttgtttatttttatttttggagctactgtaatacaaactttcctttggttctttttttttgaaaactccacccacactttttcttttgtttttgcatgtgtagtgggaaatttgggatttgcaacttaaaacatcttaaatgaatcacttctgaaatggttggttctctctgccctgttgtgtgagcgtcctcctctccactcctcccccgttttcccctcccacctctcctgggcgcatttggagggagagctttcgtttggaaaaaggactcttgggttcttcagcatctgaatgcccagccccagccccacgcttagcacagcagcttcacccctcccctgtccacccctcaccccacacacgttgaaggatcctcttggcctttgcgggaatcccttacaaaggctgagtcctcacaagtgcctgtctctgcctgcctcggttctttcctccctctaggagggaagtggagggcattccatagcaggaccacctaagagaaagcaaggtgagcgcaggagaggaagggagcaaaggactcatcttcagagctctggacacaaaaggaaaggaagtcgggaggggcgggttttcgctgtgggaatctgcttgggtcacacacctcagcatttggcctggtgctttggtaatctctgaaatgtgtgcataatagcaatcattttagcctatatattaaaatttttttctcagctgtgaaatatggaatgctgaaaaatgaataaggtgtgtatttcagaaggtgaacggggctttttgggtgaagccctttgcgtaggtgaagtctgtaggctcagacagttcacggtgtgtgcttaggtgagcttgggaacaggcatcccatttagatggttcgaaaagaagcatctattaaaactaaagccatcatttaatgagggtaaaagtcaaccccagccttcacacccagcaccaccagaagacccagaattctacagcctgtgaagagtcctacctttataaaaaggtttctgttcagaaaaccaaaggtttaccccaaatacagcttttgccatttaaaagactgtaagccacatatgaataccaagggagtttttttgtttctgtttttttttgaaacagggtcttaatctgtcacccaggttggagtcagcagggcaaacatagcttactgcagccttgacctgctgggcttaagcgatcctcccacatcagcctcctgagtagctgggaacacaggtgtgcaccaccatgcctgcctaattttttaaattttttgtagagatggagtctcaccatgttgcccagactgttctccaacccccgggctcaaataatccttcctcctcagcctcccacgtgctgagatttacaggtgtgagccattgtgcctggctgagtcattacactatttgtttaaatatcagtttgcaattaggaatgttatcctatagaataactcttctcattaagactgttcccctttctgcaaatgagcattacttagagcctccagtgaagctgaatgaagctctagagagatacgaacttaacgctgaagatttttttgtcttgaagcatgaagaatcaagatacctaaatactgatgatgaaaacttttaataaatgtgagcacaggcatttttaatgaaaaaggcatcatctgatataagttcaaaaacaaatgaaaaaacttagaaattaaaaaaaaaaaaagactgttcccctttgttacatcaactccagttttatgcagccatgcgatgtttagtaaacaactagatgacaatttggtcttcacaaatcccttttagtcattcacctggatagactgttcactttgatgcaagaccaggcactcatctaaactgttactagataaccagtgactggtatttgggatttttttttttaaaaaaagaagtgaactcaaacatttttatggtttttttttcagatattattgttactataaaatagggtggctaacacgtataaaaggaaattatggctcgggtttactgtaatgcatattcttaacaatttaatagaacacaactccaaggtcttgggttgcctgcaaagttaatactaacaccatgagcatcctccaccagccagctcttatccatgggtcgtactctggttcagagactttggatgggtaataacgtataaaacatgcctcttgcttgccagtgaccactgctaataataatagtagtcatcattcactggaatcctgggtttttagggtttacttggtttatttatttgcttagcttgaaggaataaaaaaaaaccttgagaggaaacaaggaggcatttcacaaaggagaaaaatatatatccctttaggaaaactgagtggctcctctgatttctttgccgctcttgtccctcagcagcacttagctgttttcttctagctggaggtgagggactgagcacaggggtggtgctcagttagtttaaagggagcttctcaccttggcgctgttcaggccttgggttggttaattctgtgtcctgtgggaattgtgggacactacactgtagtgacagtcagcagcatccctgaccttgaccactagatgccagcatcaactccctgcccccttgtcacaatcaaaagcgtctccagatgttgccagatgccctgtggaggatcagactgcccctagttcagaactactggtttaaagtaaagtgagtttcaaaggcttcgttaatttcccattttgtttaagccaaaagtagcagggttgtgattttctttttaaagttagaagagagcaggaagtaatttagtttgaaattgcattctgccatgcctttttctgggttaattgcatttttttttttttttttttttttttttttttttttttttttagatggagtcgcactctgtcgcccaggctggagtgcagtggtgcaatttcagctcactgcaacctctgcctcctgggttcaagcgattctcctgcctcagcctcccaagtagctgggattataggcgcctgccaccacacccagctaattgtttgtatttagtagagacggagattcaccatgttggtcaggctggtcttgaactcctgacctcaggtgatccactcaccacagccttccaaaatgttgggactgcaggcgtgagccaccgcgcccatccatgaattgcagttttaacatcctgtttatattgctacacatgcacttagaaacacatagaactgtccttttcttcttatgagcaagttgtcacgtggatgggttgtttgtggattctttgaggtggatgtagctgaagtgactgatgacctcagtaagttcatgtactagtctgttctcacactgctgtaaagatactacccaagactgggtaatttataaataaaaaaagaggtctaattaactcacaggtccgcatggctggggaggcgtcaggaaacttgcagtcatgtcagaaggcgaagaagaagcaggcaccttctcttcttcacaaggcagcaggagagaggagaaagagaacaggggaaactgccaaacacttttaaagcatcagatctcaagagaactccctccatatcatgagaacagattggggcaaccgcccccatgatccaatcaccaccgcctaccacgttccttctttgacacgtggagattacggtgtgagatgagatttgagtgaggacacagagccaaaccatatcagttcacattctagtaacctcaaatggagtctgaccctttgtatctttttcttcttttactggaattcttttatagctcagtgatcttggggattcattaaggatagtgaatgtttgaatataaataactaaattcctatttcctaatagttctttttatttcatgcttttggaaaacatggaaaaggaattaagggaataaataagcacacgcatggatttgaaattgtgtttattttccagtaagcgttagttaaaaaaaagaattttactgttcatcttcatctttttgtcaaataatacatacattgggattggcagcgttagccagtctatttgtcagatttagcctgttttagttaatataggggattgttgggatctcgtacttccaaggtatatggacgatatgttggtaattgtagagcactggttctcaatctcggtgtcatattagaattaactgggatctttgaaaatatccagggcccaggccacatcccagagcagttaaaccagattttcttgagtggagtccaggcatcagtactgagttcccttctcaccttactccagtgagagtgaagtttgagaaggaaccagtgccactgtttacaaataaagttttattggaacacagccatgcccattcattttacaaattgctagagactgtatggcttgcctaaaatatatatactgtttgacatttacaataaaaagtttgctgacacctgctatagactcatgatcaacatttttcaaacattttgaaaggaaggtttgtgtaaactttcatagtaaaaaaaacatccagcattttgcagagcatttaggcccaaatcctatctgttttcttgtaccctggcaaaattgaaaagcattttccttgaagaactggcttgaagatattgtcaaacctgaagtagatgtgacaaactcagcccccagagcagggaggctccattatttatattacggcttatgtcggcaccttgcttctaattcagtgttcactactcagactgtgtaattgacttaaggaagtctatggagacacaaatggcttttcaattcaaagtgtgtttgagtttttactgctgcagcagttgtagatggcaacagacccctgaaaaaaatcttttagttctggggaattttgtgtataaaaataaaaaaagaatgaaaattaaaaattgctatttacatagtttcacttttccagttcagctggaaactggatggttgtaagcaactggtaatttttttttttttttaagctggggcagtggctgacacttgtaatctcagcactttgggatgccgaggcgggcggatcacttgaggccaggaatttgagaccagcctaggcaacatggagaaaacgtctctactaaaaatacaaaaattagccggacgtggtggggcatgtctgtagagtaggctactcaggaggctgacgcaggagaatcgcttgaagccaggaagcagaggttgcagtgagccgagattgtgccattgcactccagcctgggcaacagagtgagactcggtctcaaacaattttttttaaagggtttcctttggtcttgggttctgagaggtactaagtatgagaggaaggatcacgtattctagtccctgggcaccagcaatatcagcatctccagcccagtcttaccatcaggacctgcattttaacaggaccccctggccattcatatgcgcattgagagctgctgggaatcatcaaaagatgctgcagtgctctaattgataactgggtgtgtgtagtaaacagctaccatgattgtcccttttctcttaaatggtttagtggcttcttaatgggctcttctgctgtgtggtcttatttattaggggtagccagtttttcctttttggctgttttccgagtatagcttctttaaccttctatttagtaaagatttaatgtggccaggcgcggtggctcacgcctgtaatcccagcactttgggaggccgaggcgggcagatcacgaggtcatgagatcgagaccatcctggctaacacggtaaaaccctgtctcttctaaaaatgcaaaaaattagccaggcatggtggcgggcgcctgtagtcccagctactcgggaggctgaggcaggagaatgacgtgaacctgggaggcggagcttgcaatgagccaatatcatgccactgcagtccagcctgggcgacagagtgggactctgtctcaaaaaaaaaaaaaaaaaaaaaaagatttaatgtaatggtagaaagtgaaaacggagtgattggcctagaagagacaccatttcatatacttcagaaaaacaaactagaaaggataaaggggacttacccaggtaaacttcacttgagaggaaataatcacctgtaatggtatctttgcttctccagaagaagtaatccactcatgagaacatagatttgagcttgagagcagtagagatcaaaaataaattccttgagctgctcaaagcatcaggcagaaatcagggacttagctctttctaccaaacagcaccataatacccaaagtacacttaagccagtgttagttggtgaattgtccagaatgtagatgttcatagaaaatcttgaggaagcccagtgcctaattttacactaccaggctctgtcaagttagtgctattttctttttcaagtaccatttaaaatacttgattgaaaaacatgattttgaattattttggattattttgaaattactcatatttctggacagaattggtttatcttgaacattcccttagatcgaattttgtttaaaagcgagtaccatctaaatttaagttttaaaagactgtcataaataactgaagtccagctctgttgttgccgtgaagatgtgatcatgagttgaatgctcggtgtctctaacagggtctagatgttcatggaagtgggtcttacacaatcagagtcatcagggccaggaaagtggaaatggagggggggccctttctaagccatcaagtcatatcttcttagctttgaatgagaatcaggaagccacagggaatgaactgcttcttatataaaagctatctcatggtcctaaaggcagggtctggttgccggaaaaaaatgaatgactgctgtgctcacatgcagctgccactggaggggcgcttgtgcctccttactgccttccgagttttgctctgccccatgtgtccagttagcagaagccaaatcacctccagaattcagatctcagactcctgttcttgctgcagggaacagacaccgactaacaggatccagcatggcattgtgctaatgtccacagcttcccattacacatggtttgcatgttgttttacagtatttatttatttgttttttttaatatatatatattttttagacagagtctcgctctgtcgcccaggctggagtgcagtggcgcgatctcggctcagtacaagctctgcctcccgggttcacgccattctcctgcctcagcctcccaagtagctgggaccacaggtgcccgccaccacgtctggctaattttcttgtatttttaggagagatggggtttcattgtgttagccaggatgatctcgatttcctgaccttgtgatctgcccatcttggcctcccaaagtgctgggattacagacgtgagccactgcgtccagcctatagtcattttaaatactctccttatatgaacactgtaaggtaaccaagataaaattccagttttgcacatgaagaaacatgggaagaggtctgataacttgcgcccgttcaaacaaatttgttagtgttacagcagattgtgttgtcccctctccaccaccctgttctcttttgtactggttaatcgagcaccaaatgaacagaaggaatttcaggggtgctttagaggggaccttaagatagaaagggcaccatcatagttctaggcccagtacattggaagagcatattcatggctgaggccacttccaacttagataggctattcccttaatttgctttttttttttgagacagggtctttctctgttgcccaggctggagtgcagtagtgcaagcagccacggctcactacagcctcaaactcctgggttcaagtgatcttcctacctcagcctcctgagtagctgagatctcactcgtgcactatcacacccaaacaattttttgatttttatgtagaaaagaggtttcactgtgttgccctggctggtcttgaactcctgggctcaagcgatcctcccgccctggcctcccaaggtgtcgggaacataggcatgagccactgtgcccagcctgttaccttgttttaaagaactagataattattgtactagttgtgacatgcaatgttgatctcagtatatttcttcttttttcttaagcagatgaagaacatggagaaccgccatgcaatgagctcccagtacaggatgcattcttactacccgcctccctcttacctgggccagagcgtgccccagttcttcacttttgaggatgctccctcttacccggaagccagggcgagcggtaggtgtctggtcacacagactggatttggggttgagagaggatggctatccagtattgggtcattagctgtgtctaatggcttagctgttagtaattgttggaaattttattgctgtgtgaagcttggataagtatcctttaaagaatttagttataaaatgactttgctatgcttgattcttaatatcatgttttttttcctttctggattcctagagtgacaggagtaagatgagagactctcccttggaagctaaaaatgtattttatggaggatcaatatgaaatacaggggcactttaaatgtggttcaagacctggtattttttgtgaagtgagtttctgtgcattgaaaactcctttcccaaagactttcattttaaaattgaaggcgtattcatctttttggcgaaaacaacataataaaacatttttgaatacaatagatctcagagtttatgcagtagcaatgcaaataactctgatataatggctttgaaataaaaaatgactgtttaatgaatcaaagcactttgaaatacatagtaactcgacttcaattttaacatcccccagcattttcactgtggtgagaggcaggtctttacagctgctgcgtttccagatcccgtgtttaagttctttatagttaagcatcctcttttgatgtaggaaagtgagaaacatacacaataggcagtaagtggaaatcagggcagtagagggtgtcttggaagagaaaccaatctagaagaatttactctgtgctaaataaaaggatatgttcattttctaagtaacttgactctttagagaacttagagaatgagaatcagaaccatgctttgatttccaaattcagaaccagaaagtctaaaatagctgggcaagttatgctttatttaccatattaacataaaataaaggacttctattaatatgaaatatataggtcacgggagcctatgtagtttgagctgcagagaggccgaagtacacattgttgattgcagtttcacttttattaagaatcactttccgttgggagtggacaagcacaactctgttttataagtattcatactatataatgtgtgcccataggtccttctttcatactgcttttgagtctatatatttatttggcttataagctccctaaggacaaacaacacattttctatactttcttacctgctgtgatgccttttatttatttgttggttgagtgaatgaatgaatgaatctggtattatttttaactgagtttggcctgtaagggcgtgcaagcatgaaaggtcagaatcctaactggcctgtctgcacaatttggggatgaagcagttaaaggaacatttgttaatacagaaaattaagaatgaaacccactttcaggaagaaattgcctgagcttcttacaccaggaataatggaatattttttgaagcactggcgttcttgagacaaaggtgtaaattcagagcaaggcagtaagacaaaaatataagaggcaatttattagagcagagaggagcgaatttggagaggagcggtaggcatttgaatttatggcagaaaaggaagcgactcagaaggaaagaggttacagtccaggaaagaaaaagaccagctgtactagcgctcacagggaaagaagaataggtgaataccacctacaattccttattacttttctggccatgtgtttatttgaaagagtagtgtgtgaggaggccccaggcttaacttcctggtaccctgctaacccactaacagttaagtaggaggcccaagcttcagaaacgagagctgggaagtaaaatctcagcactatctactttggaattatcttcgagaaggagtgtacaaatacgtagaaaatcaaaatcccagctaatttttaacagaaggcttaatgccttccaaatgtgtgctattttggctttttttatattgcatgaatttttacaaagcaagtgggaaggtaaaggaagcgtgtttggaggtcagtaaggacacctcaaaggtcatctcatgggacactggatcctcagttttatcagcattgacacagtggggtgttctttgagagcatgttagcccttctgggaggtggggctgaggctagagacaggaaatgatgggtggggatgcggacatcagtatattcatttgtgagatatcggcaaaggttggctcataaccagttacatgtggcagatccgtcaagtctaagttcctttggttgattgtgttaatatgtaagttattatttattctaaatagggatttctaaagaacttgaaagacagtgttttcagtaggtttaatgtcttctttaaagtcttatttaagtataaatttgcccattaaatctatgttcttcagtttctttaaaaataaatttaagcttagcttctctgtcatctaaaaaaatgaacccaagttcagtgtcttcctctgggtttgctataaagctggcaacatgaaataaatggaatgttgggcggggggaggggggcattttacagggcaagttttccttttgtcgtgttactgctttttaatgcttttctttgtaaaaggataggagccattccttctttccttatcctgaaaaacgttaagagggtaggtcagagagatggtggagtcagatcttgcaggtctttgtaagctattggaaacaattaggcttttatttcaagtgagatggggagccatagcagggttcaagcacagggtgatttgtctgtcttgtgcttttaaatgatcaccctgatgactgttttcttatagactatagggatgcaagggtggaagctgggagaccagttagaaggtgatggcagtaattctggcaaaagaagatggtggctgagtgagggtgggagcgtggcagtgatgacgggtggtcgaattctggatatattttaaagatagaaccaacaagatttgctgttggtctttggatgggacaggaagagaggagtgaaggatgactccttaatttttgacctgaccaattggtattttgattttctacgtatttgtacactcctcgaagataattccaaagtagattggggtttccaattattgaggtaaagaagactatgggaaaaataagtttgtgtgcattacgagtttaactttgcatgtgttaagtttgagatgtccatgaaccacccaagtggattgttgattaggagttggatgtgtggagtctgagggggaggggaaatatctctactggagatgaagatttgggggttcagtgcataggtttatttgaagtcaatgtgatgagatcatttggagagatgaatgtaggtggagaatataaaggaccagggactgagcctgcgtgtctccagtgtttatggccctgtagatgaggaggactagcaaggaaaagagggaggaggagcagcctgtgaggcaggagggaaactgtgtgtgagcggtgccttagaagccaaattaaaggattttaatgagagccaaagagtgctgatatgtcaaatgagatgaggactggaatcgaccatcagctgttgcaaggtggaaatgatcagtgaccttctgagtggtcactttggtgggaggtgagaaccaaagcctgcctgcgtattcaggagtgcatgggagagaagaattggtgcagtgaatacaggcagctcttcaggagttttgctgtaagaggaatagtgggatgggacgtcaacccgtggggaagtgagttcaaggaagggccttggctccttctttaaagaagagagattttataatacgcttgtatgctgatgagggcgatcccaatagagggagaatttgtggatacagggagtgtgtggagggcacaattgctgtaggggtgaccctgagcaagccaggtggggtgggaaccaagggtctgcagagtgggggccatggtctgatgtgggtctgggagtgctttgttacttgtctaagaggggagataagaaatagagaggaaacaaactttatagcaatttggtagagcagttttgtctgttgaggttgataaaatattggggcttgtattttttgtctttcatttttctagtagcctattttttattgaggtagaatccacctaacattaactattaaccataattaaagtgtacaattcagtggcatttggtacattcacagagttgggcaaccgtcacctctatctgattgcaaggcactttcatcaccccaaaaggaaaccccccatcctccctcctccagccccctggtaatcactaatctgctttctgtctctatagatttgccagttctggaatggaatctcataatatgtagccttttgtgtcttgcttcgcttagcttaaatgttttcatgattcagctacactgtcgtatagatcagtatttcattcgtttttgtggctcaatatcattccatagtatggatggatataccacattttgtttagccgttcatcagttgagggatattgggttgtttccaccttttgggtaatgtgaatagtgctgctttgaacatttgtgtacaagtctttgtttgaatgtctgatttcacttcttctgggtgtatgcctagaagtggaattgctgggtcctatggtaagtctatatgtaatttttgaggaacatgttactgtttttcacagcagctgcatcgttttatattcttaccatagtatatgagggttccagtttctccacatccttgccaacacttgttttccatttaaaaaaacagtttccagcctgagcaacatagtgagaccccatctctacaaaaaaataaaaaataaaaaattagctgggtttggtgccacccacctgtagttctgactacttgggagggtgaggcaggaagaccactagagcccaggctgcagtgagctatgatcacaccattgcactccagcctgggtgacagagcgaaaccctgagacacacactgcatccagcactgcatcacgacacagccctccagctctgtagcacaggcaggcatgcaggggtgcaatcatagctcactgtagcatcaactttccaggctcaggtaatcctcccacctcagcctcccgggtagctaggactacaggtgagcaccacaacgcccagctaatttttttttttctgtagaaacagagttttgccatattgctcaggctgtcttgaactcctgggctcaagcgatcctcccacctcggcctcccaaagtgctgggattataggtgtgagccatcttacctggccaagaaaaaagtctggggggctctagtaattcatttttattgtattttgccaaagtaccagaccacggtgggttggaaactggaaaaaaaaaagtttaaagcaggcctctcctgctccacagactgtttgaagatcacttgtctagtgcccagatggagggttggcttatataagaatgtggccacttcgtagtaacagatgcaagctgttcgggaagtggtagtgggaacagctttgaaatgatgcttccccagctggtgatgaagagacagatctccacagcagcccctgtgttttaacagatgcacctctgtctagaggtgggtggcactgcacatttgagaatagacatcgttctctgcatgttgaattcttgagtataagttgctggagtacgtggttggtcgacacctgcaaaaaggtttaggtttcagttggtgaaggtaatacacttagatatttttgtctgtttattttgtgatctcggtttaaaagttagaaatggtgccttatttcttttggttccgtctcagagtggcagcctgccgtgcaacttcagccttccttcacgtccaagctgcactcttttcaggagaaagaaacatttaaggtggtgcttacagatcatgaagtgttcatgtattactcatttaacacacagaggttgtcagcagttccgtgaagcgagttgcagagcatctacattttacccaaaggtcagatggccaccgtcagtgatgggctccatggagttgaaggcttcatgctcctctgtgatgtgtaagcagcttgcagaggcctctgtgctcccaaatacaacttttcgaatccatctggcgttggcaatgtcgtggaccagggagtctagcagtgcctgatttcactgataccataggcctctccttcaggatgaccaggactgcatgcaaaatgggtagcttgcacctcagggagtggacttgcttaatgctgcatgtcagacttggacttttaggaaaaggtcatctggctgcacctcccaagtttgcaggtgagaaaactgaggttctgctctctgttgggagcaccctgagatctacttgctcttgatccagaacgccaaaggtgccctttatgtgaggtgaggtgacattctgtgacaagcggccatgtggggtggtagagaattctgtacgtggaatctgaatgggacccatgacttagcaggttatgtggcagtaccaaatgcttccctgagagcctcgatttccttacctgctgagagagggtgaggatgttggctctgtggaggccacaccagtgaggatgaaatggtgtctgatgtgcaaacaagctcaataatcacaaaatgcaggtaaaggatggcaggtgttatcatgactttcccccattttttcctgcgagggctgtgtgggcatttcacatagctcttcttgtaggggagaacgatgcctttgaaatgttgtagagcttggctggcacgaaggagagtggggcaaagactcagagggctgcgtttgttatgtatgcatcctgccctgagctgtatttctcagccagtaggatagaaaaacatcaacccttgtctttctctgctttaaggaaagctgaatgtgttttatgcaacatttagaaaatgctgagtttaatttaaacttgacattttagaaacgacttattatttgctaaatttcaaagaaaagagaactttgtaggtaaatctgttttcgttatgtgtccattttgttctcagctttaacttggaacagagaagtaagtggggctttcagtggcaacaaggccagtgaatggaagggcattggaactatcccaggagacgaggtcttgctcaggtccccagctctggagccagtagtaagatgatcaatctcttttttttttttttttttccacctggagtctctctctgtctcccaggctggagtgcagtggcatgatctcggctgactgcaacctctgcctcccaggttcaagcaattctcctacctcagcctcctgagaagctgggattacaggggtgcaccaccacacccagctaacttttgtatttttagtagagatggggtttctacatgtcagccaggctggtctcgaactcctgacctcaagtgatctgcccgccttggcctcccacagtgctgggattacagatgtgagccactgtgcctggcctgatcaatcccttagagcttcagttacatctggaaagtggaaaacaataataacacatgtatctatttttatatatggatcacataaggaattatgtaaaagtatggcagaatctgtcatctctcatatacttgtatgtagaccttttaccgtggcttatgtatctttctgttttggcaggtgcctggcagtgggctgtacaaatgaaaatgattactgtcattaaggagggctaagcgtatgtgtatcatgattcttgaaattagctagacatcatggtctgccgagtgaggaagatggagcatactaattttaagcagataataaacatttggaaatggcagctttaaagatgtattttttaatatattacacttatgatatgtttgccaagtaaaacacaccagtgcttttcagggaatgtgaagaacaccagcaggtccctttatgcctaaagaatggtacagaagcaagctgacatgctgttggatgaggacaagcagatttctgtctttccttcaaacttctttctctttctacatacaaagagcaccccacaaggcaaactgtgggcaagattgagagctgtcgggctcctaacgtgtcctctgtgtaaagcactgccatttgacaaggcctcctccaggctgtagtctggaaatagcaagacttcccaggggcctacctcagggaggtcacacttactcatgtaaggataaggtccattcactgcagcatgttagcaagaattaccagggtgtgtgcccacacggagggtcagcttcgtactcctccaggtgcctggcatcgtgcagtgttctcagatggctcccgggatggtttgtcatttcttaaatgagtaagaaaccaactgtggaatcttttctgttcgttcctcatctacttggagttaggtattccagtgaagcattcagtgaaataaatcagacaccaacaaacatggggtactgtccccaggccacagacatcttggatttatgccatgtagaatcttccctttgcaaaacttgaattttagggacttaattatctatgtgtgactggtattttgattaagaacgcagccctgccggagggtcaggggtgcttattcaatattcacacttaacagagaggatgggtgtgcaggcagagcgccgtgacttcctctaagccttgttgctagtgtttaagaggaggagccagcctacgaactcagatccctgaattactttcctgggcgctctttcttctagtatatcctgtgtttttctcttcatttccttccttttctttttcttcccttacaaacacacgtgcagctcctccagtgtctgtaagacaatatctgaccactctgtgtataactcatttaattatctggataatgctattatccccatttgacagatgaggatattgaagcatagagacagtgcctgttaggtaggggaaaggaggggtcctgttccagtgtggcacgtggaggaactgaagctcagtgatgatgctgtttatccaaggcctcactgggctacagtctagcaccctcatgttttaagtattttcaaggaaatggtggctgtgattggggttgagagtgcacttgggaatgttctatttgcagggactaaaggcatggatgcagtttgtttggctgtaatgatgagatacctgtcttacaggtagcacatgcctgatgcagaaatgcccccatctggggttgtggttctgtagcacattactgtcacagtaaaaaaactcaaaagcaaacttaaacccttcggcatatcaggtgtggtgttctctttacattgctattcccaaagctcagtataaactttaagatacctttatgagcacagtaaagtcacttttaattttgtgattatatttgaattttccttttatttaataagagagagtcaagtggaagggttaatatttgataagggcagaaatcacaaaatttaactagtgattagctttgaaatcataagtgcaaatagaaacacaatcagctactttcaaaaatatttattctcttttttccctgtgggcatcagctgttaagtgattacatattctacttgttattttattgttaaactcctgtgactaagaggcctggcagttttcctcagataatttttgaggaagatgttatttaatcttcacctagtctgtcagcagcttatcatgagattgcttttacgactttaatttattctgtaaaagctatagattgaatacacagagcaactacacagaggttttcattttggctaaagattgcagcctagagaagacacaggtagagagagagagagagagagagagagagagaagctctggaaaccacagtttaggaatgcctaaatgctctgacatagccaggttgaacatacttactagaaaacattgcctgtctgttttcaatgctgatgttatcttcatgggattcaggtgtggcagtgagttccatccctgcctgctcagtagagggacccagctctcttgtgggtacatcacaaatcatcaagttggccagtttctgttactcatttagagaccatttgtatttgaacatcccagagaactgacgtctgtctgttgggccctccttggatgtgacactagccagttgggttagagcttccagcatcctcactcatgagatttcctcatttgaatctgacctgaatccacagggccctagcgatttttttcagggatggcgtggagtacttctggagtttattttccctgcttgcctcttcagaggcacggcccaggccaagtacaacttgaataaccttcaggaaaggtgtgctgtccttctttcggccggccgctgtctttgaaaattgcctccagagttagtgagcaggaacagttaagatttacaaacaatgatgaagcttgtcatgcatctttcaccattcatcatccaggtgccgtgcctgggcggtgaagtgttcttcataaaaaccagctcagtgtgaaatacacctcgctgcaatgtttactgctttgaagctcgtcagcggccctttatagtaaatccagattgcgatgtgacattacagtatatcattgcccggcgcggtggcgtttacactaggaatgagtgcagtgcacaccagatgaggtgtccaaattgagttatgtcagaatttggctgttatatggggatagcttttgttttctgaacactgaaagttagctttatatgtatttatatttatatataggcatatacttcccatcttgcccgtatacacggggtatacaatagatgctgaggtcaggttccaaatgcgcttcctggtgtaaagaatggtgaccagattttatgtgccttccaaattgttgtccgttgaaattggcataaatggaatctttggggggaactagagtagatggttatttcagtttagaagcagctttgattttgctatgtgtgaagtgaccatatttgccatcctttcctatgaaaacttggaacactttctcccgggagtattgtggtacattggaatgtccgtttgataggagggcaaagaggagaaacccatacaactgttgccacccattgtggagcatcttgcctgtcctgttgagcacatatgcttggggaggtctctgaagtcagtggcttatttattatttcttttagtgggtatcaaaatcctagtgctgcctagtgttatcttgaaagatgctgcttccaagagattgatggtgttttagcttaaatctgcaaaataaaagagcacactgaatttattgcatgatcaggtttatttacattcacgctaaaagtgccgatattaaaaatgagctccataaaaaaataatattcagagacagcagccggctctgcagtcccatgatcatctgcttaacacacatattttaaaattctctgttaagtatagcaggattgttaggagagtcattttgtggtctttaaacacctggctttacattgaatccagggtctctcccccatgtatacttgcataaaatctgggttagggatttcctctactttaaatgcagaggtcaacatagccttcccagccatactctctgcctcttagttgcagtgtcttcttactagagatgattaactcggccaggtctgagcttcctgaggcagcgaaagaaacaatcacaggtgtatggaacttgacctctaggggcagtagaggagccagaagctttccattggctttgactcttggagaaccagagactatacccaaatcagcccagtagttttttaccagggtgggtcggcccaacatgtacaatcactttattaagatttcgagataaaatgtaggacactcagttaaatttaagtttaagatgtacaacaacaaatgtttagtataagcatgttatgaatattttattatactaaaattatttgtttctgaaatttaaattttatttatttatttatttttatttatttatttatttatttattttgtgcccaggctggagtgcagtggtgtgatcttggctcactgcaacctccgcctcccagattcaagagattcttgtgtctcaccctcctgagtagctgggactacaggtgcatgctaccaagcctggctaattttttgtatttttagtatagatggggtttcgctatgttggccaggctggtctcaaactcctgatctcaagtgatctgcctgcctcaccctcctaaagtgttaggattacaggcatgagccaccactcccggcttaaattttagcaccctgtatttgtatttgctaaatctgacaaccttgtacttcatctgtgtcttctctgaaacaccctgggatagaaggcaaaatggaaagtgaacaaaggattgcagtaccttctctaagcatgttcagtaattttaagggtggtttcagtttttttctttttttgagatgaggatctcactatgttgcccaggctggactcgagctcctaggctcaagtgttcctcctgccttagcctccagagtatcatttttatttctacaaaaacagtacaagagggcaatgctaatcatgcttggaaagctcttattttgattgatgttgtttagtaatttcttggtgaaaagtttctggattgtagtttatccttgaacatattaacatattatttctccttctgcttgggtgatacataggtccagaaaggtcaaaagaatattctttctttctttctattatacaggctagacacattcatatatgtaaatgaaagttaatccactgctgctcagaatgaaaatggaaatttatacttttcatgcattttgttccgttgtccccctgtttgtgccaggcctaacagtgactcttaaagctgttctgcagggtcagttcctcaatatctctttccttaagtccccccaggatgtaaactgatggctcagtcagtaaacaagtgagaaattcattgagtgccagttagtgtctgggcctagcataatgctctgggagatgaaccatgagagaaggcgtggctgcagggatagtgaaaggtcagcggttttagggacacctcccttcccttcctgtctgcagaacagccttgcgtctgagcttctgtatgctgtggaatggagtagctgtgtgcccagccgtcttgactttattcaagacctggttgaagtcttcctcataaacctaagagggtgttttcttctcaaattagagaaaccaggattacagtcaaattcttgataaatgctccaaatacggagccttttccaggcacacttcacctttgttacttacatagctatagaggtaggatggagctagattgttctatttgtttgtttttttagagacagggtctctgctacccaggctagagtgcagtggcatgataatagctcattgtagccttgaactccttggctcaagtcatctgaattccttggctcaagtgatcctcctgcctcagcctctcaagtagataggactacaggtgtgcaccaccacacttggctattttttttattaaaaaaatttttttttttttgagacggagtttcgctctgtcgcccaggctggagtgcagtggtgcgatctcggctcactgcaagctccgcctctcgggttcatgccattctgcctcagcctcctgagtagctggggctacaggcgcccgccaccatgcccagcaaatcctttgtatttttagtagagacagggtttcaccatgttagccaggatggtctcgatctcctgacctcgtgatctgcctgcctcagcttcccaaagtgctgggattacagacatgagccaccgcacccggccaattttaaaaaattttttgtaggacaggttcttgctatgttgtctaggctggtctcaaactctgggcctcaagcggcctgtttcagcctccaaaagcacttggattacagacatgagccattgtgcccagccctgtttgtctttttataactgcttcattaaaatataactcatataccataaaattcatccttttaaaatgtatgattcattggattttagtatattaacaaagctatggaaccatcactgctatctaattccaaaacatttccatcatccccaaaacaatccccatattactcccatttctgcctccctcccagcccctgccaaaatactagtttactttctgtctctatgaatttgcctgttctggactttttgtataaatgggatcatagaatatgtggtcttttgtgtccgacttctttcatttagcataatattttctgggtttatccatgttgtagcatgtttcagagcttcatttctttttgtagttaaataacgttccattatatggaggggcttggtttatttttagttcaaaaactattagaggaccaagaaaaactattaaaccacaagattaccaaagtgaaatatctattctgtctcattttattaagtctccagttctttgaattcaacatacaaatgtaatgagtagaacctcttctatgcagtgagaggaatgtggtgcatatggacattgagcagtccaggctgtgttattttcccgttttgtgctaatactatttctattagtctggttgggctgctgtaacaaaaaggcacagactaggtggcccaacaacagaaatttattttcttatagtctggaggctggaagtccaagatcaaggtgctgtcagagttgctttccggtaaggcttctctcctgggttgtagactgccatcttatgtcctcacatggcttttcctctttgtgtgtgtggagatagacacagagagagaatggaatgtgagttctggtctctcttcttcttaaaaggacactagtcttagagagtatgacctcatttaaccccagttatctccctaaaggccctgtctccaaatacagtcacattgggagctaggacttcagtagttttagcacagagactacattcagtcactaacactactgaagggttttatgtctctaaatgtctcttcttgatgagatttggtgggtcggtgtgtgtaaaatgaacggagtatgttgtgtgttttcaggtcttactgcctcaattctggtctttgctgatcacttaccttcctaactctccaacacagagaccccagcccacgtcaggccctcatctgcagatcgcatccctagagccagcggtggctctcagagatagagaacgcagtggtcactcacaccccactcacgggaacacttttccagattgttgctcttcttttcctcatttaactccctagaatttcatttcatttcatttctacctctgaatttcagaaaatttctaatccatgccatctttgccttttaacaaatgctctgcataaccttaaacagtttaactctgatgtactgctaaagtgagagactttgccagttttcctggcagatacagcagaatttgggcctccacacgcagggacatgaatgagagagcagtgcgttatttcttgatgttataatgagccaatgcaatggtaacttcagagtgaactggctaacattcatgaactatctaatgtctatatagaccatccatatatgaaaaataaacttttacttttggaagcactttgacatagatcattttgttcagtcctaacaacaatcttactaagtaatgagaggtttttttccttctgacacaaactgggtgtcctacaattcaattcaattctgacactaactttctgaagttggcccagatgccacaggttaagggctcagtcccacaaaactgcccccattttaggctccagctgaaaatggggtgcccaggttatccacatttctacccagctggctacaaattaggggttcctacaatcccccttttggtccagtaaatctctataatgactcacagaactcagaaagtgctttacttactctaagcagttttttttaaataaaggatacaactcaggagcagccaaatggaagatgtgcatggggcgcggtatctccgtgctctttgagatttccaagctttcttttttttttttgagacagggttttgctctgtcacccaggctggagtgcaatggcgtgatcttggcccactgcaacctccgtctcccgggttcaaacgattctcctgcctcagcctcccgagtggctgggattacaggtgcacaccaccatgcccagcaaatttttgtatttttagtagagatggggtttcaccatgttggccaagctggtcttgaagtcctgacctcaggtgatcaatccaccctcctgggcctcccaaagtgctgggattacaggtgtgagccaccacgccccggtgagagctccaagcttttaatcaaggcttagggtctttcgggcgaccagcccccatcctgatgttatctaactgcctgccaccaagtcactttattagaataaaagaggcttctacatccttagcactcaggaaattccaagggttttaggaactctgtgccaggaacccaggacaaagaccaagtatgtttctgcgataccacaggtaggtagagcaaaaaccactgaccctattttatccataagccgatgctgaatagagagaatgggtaacaaagctaggaatggagcagggtgaccttatctctcctgaccgggtttcttcctgggacacttttcagcctcaggctgtcaaaccagcattgaacccttgtctttagcctgatgttgtagacctgcaccatccagtacagcagctaccagcacatagggttatttaaattttaattacaatggaaaatgcaattcctctgtcacaccaggcccatttcaggtgctttgtggctacaagaggctagttatatcgtattggatagtgcagaaacaatatttccatcatcataggaagttgtattcggcaactttttgggtcttttacagtgacaggaaaggacattgcagggtttaaacctgagaaaacaagtcccatatgctcacaaacaccatttaaaggtcttgacttttgtgggaacatcagcccttattctcctatcctgtcgggttgaggagctgttactgacagacttattgagtgactgctaacagaattagttgatccttggacctaacctgtgatgcacacttaagaaaaaaaaaaaaagatgatgaaagtgagtaactcagctagaacttggttgatctcagtccaagaatagtacttgcccagagtggaaaacttgtcttatggccttggagcagcatgtgagccttggagacttggcaaggatgctttcattaaaaccaaaactggggatgtagcattcatcccttatcagatagaagatgtgcacatattttctcccatttcgtgagtggcctcttcactctgttgatagtgaccagtgagtgacctttgatgcacacatatttttaatttttgatgaagcccagtttgttttgtttcttcttctgttgcctgtgcttttggtgtcatatttaagaaatcagagctggatgtgatggcatgcatctgtagtcctagctattcaggaggctgagggaggaggatcacttgagcccaggagtttgaggctgcagtgagctgtaatcacaccagcgctctccagcttgggcaaaaaaatgagaccctgtctcaaaaattaaaaaatttaaaaattttaaaaagagaagtcattgccaaatctgtgtcatattgtcttctaagcattttatagttttttagctcttaggtttaatccaggtctttgatccattttgagttaatttttgtatatggtgtaagggaagagtccagcttcattcttttgcatgtgaatatccagttttcccggcactatttgttaaacactctcctttcctccattaaatggtcttggtgccaagaggacaaagtggcaaaagaggaaagttttgacactttcgatgactgtggcccttttctgtgagcatcagagaacaccagacattgaatgttgaatcctaagcacaagcctataaaatcggcagttgttgatacaccttgatctctctggtgaatattttctcggttatcttacttttgtttgtctctcccagctgtctcaactatatctttcctacagttctgaaataaaggcatatagggtaaccagggaagggaatcctccaaaatcatttataatagaagcagtgagaatagtagtgcatttaaagactgtgggtgattttcaatttttctagttctaagtgactagtgtttttctaattgaaagtgactaatggtaatttttaaaatacccagtttttaaggatcatctgtagctgcttatatgtaagagatggtaagttccagtggaaaagcccctatatcctctagtgtcctataggaatattcctaaagaaacggactatcagagctaacagcagattggcaaacgaggggggcagatggataatgcctggctggttgcagcctgaaattgtcaatcacctcttaatgtttacaaaagtgaaaagtcaatgtgtagttgttttaatttgacacactcttaggttgagagagtgtaattgccggaggggacagttaagtggctctgctccttgtcagcctgtctgagtctgactccagtgctaagcacttttctgatgagcgatagattgggttaaatactggcgtaattgctcgcttccgcataccagtctcgcagtgccttgtactacatttctatcagcacttgcctgaggctgtgagagtttatgctgcaaagagagcccgtatgttcattttcatgaatcagtgtcgggttttgaaaagcagttgttacagcgctaaatggactgtaataaattacaccccctccagacccgttgagtaaatcagaactgtttatatccatccaagtggtcttttgagtataaatgacttttgtttacttatcaaaccaaatgtttgtctccaggaaatggaggcagatgatttgttcattttttaatcctgtgaatagcacttcactgctgtgaaaccagagaggaaattctgtgtattgttaggtagaaaagtgccacctatccccaccctcccataagtgaaatatcccaaagtcgttttcaaggctggagacactttattgtaattctgcaactctgagtagcagcctgtctctacccactacctcatatgtggcaacaatgcagagctcggaaaagcatggcttcttgtcccagtcatttctatgagaagaaagtgaattttgtaaaatacatttctctctctttggattgcttgtctccacttctttatgaaggatgtgtgttgcttgatacttatttacttgggagtcaagagagaactgttgaaatgtatgcattccttttgcaaattagacttatcagaggtctgccccttcttggtaggacatagatattgcagttttattgtagtagctctatggttatgaaatacctgcttcatatttaatactagatgaaagaactatctcctggctttcttcttggcttttttgatgggccattgtcttcttccacttaacatctcctgtgaggttattaggctatattaataatgtcttcttcaggccgggtgtggtggctcatgcctgtaatcctagaactttgggaggctgaggcaggtggatcacctgaggtcaggagttcgagaccagcctggccaacatggcgaaaccctgtctctactaaaaatacaaagaattagccaagtgtggtggcaggcgccagcaatcccagctactcgggaggctgaggcaatgagaatcgcttgaacctgggaggcggaaattgcagtgagccgagatcacaccattgcactccagcctgggcaacagagcaaaacttcatctcaaaaaaaaaaaaaaaaagtcttcttcaaggaagccctgataatcctttcttattacattttttcttactgtgttaaatatacataacataaaatgtcaaaatttgccattttaacatttttaagcatacaattcagtagcgttaaatgcattcacaatcttgtataaccatcaccactatctatttgcagaatgtttttttatcattccaaacagaaactctttacctcttaagcaataacttcccattttccatttcctcctgcccctggtaatctctcttctactttccatctttatgaatttgcctatttcaaatacctcatataaatggaatgatgccatatttgtccttttgcatctggcttatttcactaagcacggtgttttcaaggttcatccatgttgtggcatgtgtcagaccctcattcctttttatggctgaataatattgcattgcctgtgtgcgccttcttttgtttatctgttcttctgttgatgggcacttgggtttccaccctttggctactgtgaaataatgctgctgtgaagtttggtgtacaagtatctgtgtgagtacctgctttcagttcttctggatatatatctagaagtagaattgctgcgttaaatggtaattttatggttaagtttttgcagaactgccaaactggtttccacagtgtcagcatgattttacattccagtcagcagtgcatgatggttcaactttttccatatccttcccaactcttgttgttttccgtttttttgataatagccttcctaatgggtgtaaagtggaatctgatcatgagtttgatttgcgtttcactgatggctaatgatgttgagcatttttttcatgtgcttcttggccatttatgtatcgtctttggagaaatgcctgttcaagtcatttgcacatttttaaattgggttgtttggttttttgtcgttgttgtaggagttctttattatgttctggatacaaatccttttaagctatgatttccaagtattttttttcccattctgtgggttgtctttttactctctttttagtatcttttgcacaaaagttttttttttattttgataaagtccaagttatctagtttttcttttgttgcctgtgcttttggtgtcatatttaagaaaccattgtcaaatccaaggttataaagatttatttttgtttttttaagagttttatagttatagttttagctcttaagatctttcattaattttaagttgatttttgtatacaatgtaaggtaaggatctaactctattctttggtatgtggatatcccgttttcccaacattgtttattgaaaagactccttttcccagtgagtggtcttagcacacttgtcaaaaatcagttgaccgtatatttgagggtttatattgcagcttttgtagtgagttttgaaatcaggaaatgtgatccctctaattttgttctttcttttcaggttatgttggctatttgatgtgccttggaattccatatgaattttacaatgggtttttctatttatgcaaaaaacagattttgagattttgatggaaattgaattgaatctgtagattgttttgggtactattgtcatcttaacaatattaagtcttccagtccatgaacacgggatgatgtctttctatttatttaggtatttaatactttctttaagcatttttaatagttttatctgtgcctgtcacctccctggttaaatttatttctgaatattatttttgatggtattgtaaatagaatttcttaatattttgttgctagggtatagaaatacaactgatttttgtgtgttgattttatatcctgcaactttgctgaatttattagctctatcagtttttttgtggattctctagtattttctataataagtttacatcctctgtgaacaaagataattgtacttctttctttccaatttgggtgctttatttctagtctatttgctctgactagaatttacagtattgtattgaacagaggtggcacaagtgggcatcgttgtttggtttctgattttggaggaaagcattattatttcaccattgaatgtgatgtttagctctgggtttttcatatacgaccgtgatcatgttgaacactaatagcctgatttgcttgttttctggactctttaatctaaggtaatcattaatctatgaagaagtgggtggtggagttgtcaactgctcagtgatcttgtaacccacccctgccttcactggttaggttgggttgccccactccatagccttctagggctaccttaaaggtaccagtaacaccccatttatgcctgtgcatccttttcccctaagaatcctcttcgtttacacgatttagtggatcctgacctagccctgctcatcttctgtctgtcctagatagttcagcttcttcctttcaagatgcttccatcccagtgcttaccctccactctagagaccacttaccaggccactaaggacctccttttaactgtctgcttattcctgttgcacttaactcccaaattgcaccatatgctgggaacaatcttaactccctacccagtcctcctaacttccctcattcaccaagtcttcttctttaattagccgtctctaaaactcttatgtcaggatatttccaaaatgaatgacaaaaacagagttaatttaccgtggccagtcttgttttgaaatatgaaacttccccacacatgctgaaaatattttgtcctgttctctgttgtatattctttctctcgtttgttctctggactttattattcctttattggcatttaatgcacacctaagctacaaagagggctttgcattattctctgcttaactcctattttagagcatcatacaaagttatttttatcatttttaccaaaagcaatacaagctcacggggggaaaagtcaaataatgtaggagtgtacaaagtaaaaccagaaattttgtagtgaagttttatagtttctttcatatagatactacatatttttcctctccctcctctgtatgttgtagaaatagtcattaatacctataagggtggacattatactggcagaaagatttgcccaatttaaaaatgggcaaatgacttgaacaggcatttctccaaagacgatacataaatggccaagaagcacatgaaaaaaatgctcaacatcattagccatcagtgaaacgcaaatcaaactcatgatcagattccactttacacccattagaaaggctattatcaaaaaaacggaaaacaacaagagttgggaaggatatggaaaaagttgaaccatcatgcactgctgactggaatgtaaaatcatgctgacactgtggaaaccagtttggcagttctgcaaaaacttaaccataaaattaccatttaatgcagcaattctacttctagatatatatccagaagaactgaaagcaggtactcacacagatacttgtacaccaaacctcacagcagcattatttcacagtagccaaagggtggaaacccaagtgcccatcaacagaagaacagataaacaaaagaaggcacacacagacatagagaccaatagactaggatagaaagcccagaaataactcccacatgtatggtcaaatgatttttgaccagagtgctaagaacattcaatagagaacattcttaacaaatgagctaggaaaactggctatccacataaaaaaaaaatgaagttggagtcttaccttataccatatacaaaaattaactcaaaatggatcaaagacctaaatgcaggacctaaaattatgaaagtcttagaagaaaacagaggaaaagcttcattacattggatttggcgatgacttcttggatatgacattaaaggctcaggtaacaaaaggaaaaaaaaattggacttgatgttgaaaatctgtacatcaaaagacactattcaacagagttaagaggcacaaccttcagaatgggagaaaatatttgcaaatcatatgtctgataaggaattaatatccaaaatacacagagatctgctaaaactcagcaacagcaaaacaacccatttcaaaaatggccaaaggacttgaacagacatttctccaaagaagatatagtaatggctaatacgcatatgaaaggatgctcaatatctaatcattagggaatgcaaataagaatgacaatgagatactgcctcacacacattaggatggctactataaaaacaatgacaaatgttgacaaggatgtggaataattgggacccttgggcactattggtgggaatgtgaagtgctatagcctttatgcaaacagtatggtgggtcttcaaaatatgaacccaaattaccacatgatccagcaattacacttcttgatatttaccccaaagaagtgaaagcagggtccagagatatttgtacactcaatgttcacagcagcataaatgggggtcaacctaagtgtccatcaacagagggtggacaaagaaaatgtggcgcatgcatgagcgtgtgcgcacacacaccccctccccccccccacacatatgcaatggaatattaaaggaaggaaaatctgactcatgttataacatggatgaaccttgaggacattatgctaagttacatgtcgttcacaagaagacaaatactgtatgattccacatgtttaaggtacttagagtagtcaaaacatagaggcaaaaagtggagtagtggttgctgggtgttgaggggaggacagaatggagagttatcgtttttttgggtatagagttacagtttgagaacataaaaagttctggagatggagggtggtgatggttacacagcagcctgaatgaacttaattgctattgaactgtacacttaaaaaatggttaggatggtaaattttatgtttacatgtatttcaccaccaaaaaaataggaagaaaagaaaaaagtatggacattttatttatatcaagtatcttttttgcatgtatcaaaatgataacattattttctctttatttatgtagtaagtcacattgatgaatgtcctaatgtggaatgattcttatattcctggaataaatcttatctggttatgaggtattgtccttttagtacattgctggattcaggttgtttgtatttatttaggacatctgcacttatatccagaagtgagcttggctttctatcccagtttgtggtatccttgtaatgttgttatatcatggttatgtataacatgaaacagaagccatcatcttcctttattctctgggacattttaagtgacataggtatgacaacatcttggtatttgaataaaattgcccatgaccatctaggccttggtctttttggagatggggggtaaatcttttgattaacttttctgtttcttttatggtaatcttttaaaaacaagctttcttcctcagttttggcaatgtgtctttctttaaagagaaatatcaattttccttttcctttttatttgagtcagggtctcaatgtgtcacccaggctggagtgaagtggtgtgatcatggctcactgcaaccccaacctcgcaggtttagttcatcctcctgcctcagcctcctgagtagctgggactacaggcgcgtgccaccacacccagctaatttttaatattttgtagcgatggggtttagccatgttgccgaagctggtcttgaactcctgagctcaagtgatctgcttgccttggcctcccaaggttttgggattacaggtgtgagccactgtgcctggcctatttttcattttaaacttgatataaaattgcaatgatgatctctcaaatttttaaaaacactatacctgtggttctggaggtacatctcaagtttattgcttttctttttgtttattttcttgtgttcatagtcagattttccagaggttcgttggttttattggtgatttcgtagcaacatcatgagtttatttgtgcatgtgtaaattttggttgatataatttatagttgtttctaaagagacttttgaacttctttatttatttctatttttttttcaatcctcacaaaaaacactggggtgttatttaagccatctgtcgcaaagaattactcccttaaggaatgtggcaaataaatcgcagagcaggaattcaaaaccagatctgactttaaacctctgcacacccctccccccaaccctatatgatgctgcttagtgaagtatacaggatatctgtgtcttagtttgggtttcacataaaagcagaaccgaagacaataaggatttgcgttttgatagcatatcaggttgttattccaaggagtaagagtgaaggatcaggaggaggaagaaaagccaacataaaattgtgaaggcaacaggtgttagattcagggctttctgcagagttcctagagagccttccagaatcattcatctgaggataaaacagagtatttaccttcccatcggcccttatctctcaatgaggtgttgaaccccctcacttctgagttgcacctgtgtacttgaaaaacagtaacaggagccctggggcaggaagtgactcatagtctcatctccatgcaggttgctgtcacagggaggtgaggtgatgctttcacagaggcattggctggagaatgagagttggcaccaggggcaacgaggacactctctcaacaggcatgtcactggaactcacacttgacagtacatttacccaaatattttctgtgcaagtaatacacagttgtctaacacttacatcctgaatttggggtgctgataattatttttatttccttaaattctgaaggtcatggggatggtggggatatgtatgtggtccatagcgaaatggacttcttcttctgctagaagcaagaggtcagggaggagtgttggaaataacgtgttaaagatccgccagcagattacaatttactgatgaaggaccccattctcaagaggatttatttttgtaagaaaagccgcaaaagcacaatgggaaagaagttatttttatctttcttaatcaaaatacattgatttaaagaaaagatgagtttaaaggtatccttcagagtatgtggttggcttttgggcttaagcactcatttgtggccaaattcttttcccttgtgtttcttggagtggggcagcattgcataatggttgagagtactgtgtttggggtctctcagacctgggtcatcacttagtaaccatataaacttgggcaccatttgacttgggcaaatttcttcccctctctaaaccttagttttcctgactgtaagttggaggtgataggatgcatttcatttagtttttgtgtggagtaagtgaaatagtgtttctaaagggcttaacactgcacccggcacatgagtggtgttcactaatttgtagttactacctttattggttgtccaggaattccatgatctccttaattattgtgtgttcctgattttgaacctgccacagttttttgaaagatttcagtggaaagattacagtcaagagtaattccaggaaacagtatgcttagtaggattagactgttgtaatttcccctccagcatcctcacacaataagcacattcaataaacacatatacaattttcagcagctcactcccctcttgctcctccctcctttgagagaaaatgatttgataaataacatggtaaaataaaactgattttgtgtcttagtcctcctgattgtttgcattttaaaaggagatggatatttaattctgaagaaacggatctttaatggtggaatttcagatattttggtccttgcttggcaggcacattttgagaacagaatccgttgccctcatttataagtagcaacctcttttgggtaaatggtaccaagcctgattcttgctttttgaagtgctttaagttgtgtttgattccaaatactatatttgtgcacccattatgatatcaaatgcttataataaaaggttatgttgtcataaaatattactattctatggtgtttcaaacataggcactatcgtgtattttagttctgttagttacttgctttggaaagcacatgaccacctacaaagttaacaagataatttggtaaatctagttgcctaaaattaatgtcccccaaacaaccgacttaatctggggaattgtccagacctctgtcagataaagcagctgtataaaaacacattgacaataattatgaaatctactacaagttttatccacaaattagatcctttgcaaaatagcattttcaaaaagtgaaaataaagtgcttcatcttaacagtatagctagctagactctaatgtttttgtctttctttctttctttcttttttttgacatggagtcttgctctgttgcccaggctggagtccaatggctcaatctcagctcactgcaacctctgcctcccaggttcaaacgattctcctgcttcagccttttgagtagctgggattacaggtgcctgccatcacgcctggctaatttttttgtatttttagtagagacagggtttcaccatggtggccaggccggtcttgaactcgtgacctcaggtgatccaccggccttagcctcccaaagtgctgggattacaggcatgagccaccgtatctggcctgtttctgtctttcataataatttccaatcagccatttcgtactttcatcaagatgaaacttgctacactgctattttttgtatttttattcatctaaaaaatacctttaaaagcagagatttaaaagacagcagtcagaaataactggaaaactggtttttcagaacatgtttctcaatgtatagttaagacagctttatttttttttcttaaatgaacagaacactgctgtttttattctctgtagttcctgatgagttgcttttttaaaaaaaaatacacactttttttttttttttgccagttgtaatcttggcgtaatacagtgttatggcctacttttccctcattttatttattttaacagttgcctcaagagctaaactcttgatgtgtgttgttccagaccttttgctatgaaattacatgcagatatgtgtttctgtagaaatgtggtttgcttggctttttaacataaggggtgttgtagtcaatgtattgttcctcagcactttccttttttcaatcaatgcttggtcttagagatcttacatgtttagtacatgtaggtctactttattattcttaactggcacctactattccacagtttggatggagcatggtttattagttaattttcttatttattggcagtcatgttatttttctttctttcttttttttttttgatgtgacaaacaaatgctgccctctccttgtgcaattgtgctggtgtttttctggggagatgaaagcctgcaagtaaggttgtattgaatactgccaaattaaccccaagactggctgcacctggttacaatcctagcagcaatgtattcctagcaatttggtattatccaacatgtacatttttgtctattgggtggatgggaaatggagtctagtggtggtttttatttccatttccatcagagccagcatggtaagggaggtgccccatccagcatctgtgcagtgcctgaagtgccaggtaactggaccatttcatccaccgtggctctctcctccctctgcaagaaaagtacaagagtgggtcacaggtcataagacaagccccggcatagtccatctctgcctaacagccacctcacactgaatcccaatcaatctccacataaaaacgctggcttttgtacaaacagaggttccggtaaagagccttgtgactttccttccttgtagttactttctcattactaggcgatctccccaaaataaaaccagaaagcagaaggccattccaccctgcactcttgttgacatgatgtggggacaattgtgtttccacttgggctgaaaaatgtgctgcctccttggtaggaaagattggggaatacgtcctttctgtgctaatgggtgtgtacgtccaggtctgcaagtttacactggcagtagttgagattcacacaaaagagcagtgcctgacaatgcaaggactggattcacagacggtgcccatcaagataccaaagagccgataatgttaggaaattcgtcatgcagaattagctaacgatttgattttgaccagttacatgattggcagtttattatgaggcagaggctgtcattacgtcacttgaagcaactcgtctacagcagctgaaggatggaggaattgaaccctaccccatttagtggctgaattccagtaaatggaaagaacctagtccaagcttgtccatcccacaggactacagccacatgcggcccagaatgactttgaatgtggcccaacacaaatttgtaaactttcttaaaacattatgagatcgttttgggattttttttaaagctcatcagttgtcgttagtgttagtgcattttacatgtggtccaagacaattattattcttccaatgtggcccagggaagccaaaaggttgaacacccaggcctagtccattattgacagaaaatgttaatgtgtctattaaggaaggaaagctcgtaatttcttgcttcagaagtaatcactcaattctaaattatcctctcttgttttgtactccatttattctgactttgagcaggcaccaaacctttagcacttaaaagaaatggagattggcgaaatcataacaaaatgatagaatttaaattctggaagttggaggtcacggagctcaaccccttcactttatttttattttatttttttgagacagagtctgactctgttgctcaggctggaatgcagtggcgcgatctcggctcactgcagcctccgcctcccgaccaaccccttcactttagatgtggaaactgaggccccagagatgacttgcccaaggggacggtatagcccttcaagacaaatactgtctgaagtcaagttttattattgtactactaaccatttcctgtcgctggagtcatagatctcagccggagctggattctatgttagcttctttgatgaatggatttctcccaacagtgggcctggggtcagccatgctgtgtttctgttagatgttccaggagcccttgctgctgctgactgggaggtgctggagctcactggggtgaatcagttcatttttcattttctccaccttgacttcatggaaggtcacatgaggtggaattgggtaattacttatctactctgaaaacacacctgtatggatttgcacagaatgtgggcctcctgtgctgctgctttgtgctttgggaacacagtggggagcttgaggcctgtggggtggagcctgccttggttgcaacccagccccggcctgctcaggcccgcccctcctcccctctgttgaaagtgtgctttaatgaacagtttttctcatcgttatcttaaatgagatgaagggaaaagcaaagtttttatattaggaagattatttggcccattttttctcctctcctctccacagggacatgaactactgggaaaaacgagatttcttgaaaactctttgacatctgggtgtctggtagctttcaaattcccagaccctatgattccatttcagactctaccattagatgccctagagtctgtggaagtcagtatcctctccacagcctgttggaagcctctctgctggcccgggacagaccatccttcccctgcgctctgctgtgttggggcccagaaggctccgcaacaagtggttgatttaaaagaaaacctggaattttaccaagcagcttacactgtgttgactgaaacactcagaatctgccaggcagcaaacagttgagtggccacccaacactttactccacccaatcacacaatgggtccttaaagtctctccctttaaaaacaaaacaggctggcgcggtagcttatgcctgtaatcctagcacttcgggaggccaaagtggatggatcacttgaggtcaggagttcgaaaccagcctggtcaacctggtgaaactctgtctctactaaaaatacaaaataataataataataataataataataataataataataatagccgggcgtggtggtgggtgcctgtacttccaggtacttggaaagctgaagtaggagaatcacttgaatccgggaggcagaggttgtggtgagctgagatcgtgccactgtactccagcctgagcaacagagtgagactccatcttaaaaaacaaaacaaaacaaaaacacacacttgccaggtgcagtgtctcacacctgtaatcccttgaggccaggagtttaagatcagcctgggcaacaaagcctttctcttcaaaaaataaaacaattagctggcatggtgacgtatacctgtagtcctagctacttgggaggctgaggcaggaggatctcgcttgagcccaggagttcgagactgcaagccaactgtgacagccccattgcactgaagcctgggagagcaagaccctctctcggggaaaaaaaaaccccaaaaaacccacaaaaaacttttctgaagtatgattgacaataccgaaagctgttcttatttagtgtatacaacttggtgagtttggagataagtatacacccgtgacacgatcaccacaatctgtgccacaaacctacccatcacctgcaaaagtttcttactgtctgctttattattttgtttattcatgataagaacacttgacataagacctaccctcttagcaagtttttaagcataaaatacagtattgttaactgtaggcactaagctgcacagatttctaggacttatcttgtgtaactgaaactttgtaccctttaagcacttccctgttttccctttctctcaggccctgtagccaccattctactctgcttctgtgggtttggctattttagatttctcatgtaagtggaaatcacagagtacttgtccttccgtgtctggcttatttcacttagcacagtgtcctccaggttcattccgttgcaaatggtaagatttccttctttttaaggctgaataatattccactgtatgcatatagcacattgtccttattcatctgtctgtcagtggacatgtaggttgcttccatgcattccttgggtactgtgactagtgctgcagtaaatatgggtgtgcagataccttttcaagatcctgatttcaattctttgaatatacactcagaagtagcattcttggatcatacagtagtttattgaagtctcttctgcttggaaagtggaaagatgtgggaatttgggtctcttggatatctccttactcagctcatttttagaaggcaaacctgcaactcagttgatgccttagacttcaaagctgtctttttgcagcaaaatcatgattatctagagagatacttgggcaacagatttgtggatgtgaagaagaggaaagctcactgcagaggtctctctgggtcagcaggaggcagcgtgaggaacaccaccagcaagcttgttgtgatgcactgtggtctcttgtgaacagtcccacattcagatcctgagtacaaattctggctctgatactcagcagtcatgtgagcttgggcatgttaatctgagtctgtttttaaaatctgtcaagtaaggatgttaatatccacctccccaaagggtttttgtgaagatggtaaagtatagtgcctggaacatgataggggctcaacgaatgatagtaattattattaataattatgctaataaataatgtggactgaacttcatttcacaagcctgcttccccaagtcagcatttaccagctcctgccttaggctggtagatgagccttcctaagaattcctgtttcatttccccagcatctcctagccccgactcattaaagaaagcatctcactcctgcagttcaagtgaaaagcagtgtttccagaaacgactgttttcttggacttccttttattcttgctttctgtctttttctatcactttttgttactacaaaaatgtttcgtcctttattgtttcatagttgttttgatatagaaaattataagtgcttcttaaataaatggatgaccttggtttaggattataaaaagtatatcccccttactaccaggcatattagttagctaatgctaatatttgtgtcttttgccttttctctcaattttatctgattcagtattacaactagtaatatttgctaatggaaataattaaaagttcattttattaaaatttctgacaaataattaaatcctagagcctcattgaagcactagacaacatgagagttaactgctagcaaaaaataaatttattttaatatatatttttctttaaataccagtcatttctgtttggctgtaaggactacattcaagttaagctcctggaaggcagagttaaagaaaaatgattttgagattagctcactggtaaatcactttgaaaggctaagcctctggtaagctggaaacacagaccagacatggacagtaaccttaatcagcaagaatgcgtcttttctgtaaattatgaaaatttgatgtagtaaaaataaaacttgatttatccacttacctagcagtgcattctgtatactgaatggtacagatgacacttcagcaatttgccctgcccctaaagatgacatctctgcaatgtctagaagcttcctctttaaaatgaaaatatcaacaagagggttggcagcatgaagcttgcatgtacctcttgggtaaattagtttaattgaatgcttttctttgaagagctccaagcaatatacttaaagaataaaactgttctggagcagattgagggagggtataagttgtagtttgacagaaatgagaccctgggagtggaccaggggccacaggatacctaagaacagaaaagaagcacagatgtgaggaagatgcagaggaccaggcaaacacataatagagaaaaaatggcaccttcttctgattctgtttcaggtagtccctggtgccagtttgaagcacttactgattatctgctctcttcttacaggaagggaggggggccagtgtccattcaatgcctgttttgagctaaggagcttgctatgctatgtatatatttttaaaatcacaacagcctttaacattgttgttttcctttaatagatgaggaattgaggctcagagctgttaaatgattgcccagggtcccataactagtaagtgacccagccagaatgtaatcccaggtgtgtctgattacaggtgtttttcttctgagaacagagccttgtttcattcacagccatatcccctgtatctcgaacagtgctgggcacagagcagatgctcagtaaatgttctgtgaattacgtaaccaaattagcgccacagtgccttttatgcgtgagttttagttagttgtggaggtagattaagaaataaaaaggactaacagtagtcattgttttccttagagtactcggctcccaaagaggctcttccaacaccttggacgtgagataaaacatgttctaaaatttatacttttaaaattacggtgtaatcaaaaggccaggcagcccgtaaacctgagaatttgtgcaattggactaacatttctgattcccaggaagcttgcgcctaacagtggaaagcatttttacatgtaaattggtcagttttgagatgagctgataatttctgaaattagcagattacttatgcttgaaggagctgaggtcgccatttgttatctgactgctctttgccctgagcttcgaagccagccaataatgcagtgagtgctggacttccactctttttttcaaattaaagatttaattacagtcttcactgaagatgaaccaagtgtgaaaatacctgatctacttggaatgtgggatcagggaggagtgtgtgggttggagtcagtgcctgggcatttaaatactttcaacagtaacattaagggtgaaattaattatattgtgaccaaatgttggcgtgttggttaggcagagtcagtgaaatttatattctttttttgttgatcattttttaaagccgaaagggtttttttccttaggagatattctcatagcctatagacttaaatctttaagacttcaaaggttttgaaagatacacatctttgaaatgtgtagagactttctttgtggactgctacatggttattttgcatacatgctttgtgtgtccctgtgaagaatgcggatttgttcattgttggatgcagaattttatatacgtggagtcaagcttacttatcttgtttacattttcagtcaattaataatgaaagtgatctatctaaaacgtatctgacggccaccccttatctatttttctaaggtagtagctttaataagcctcctttattatggagaaaaaaaaaagtctgtgtatctttttggtcttctagctttagtcattctgatatttctgttagtgtctggagtttagttatacccatccaaggacagagtttaagggtagattcgagctgcctcattaactcgccatcattgagaaatgatctgtttcacatacatgcatttattttctaaatgacgaaaatcttctcttgcagttgtcaaaggcctctgcccccccgacctttgatgacaggaaagtttatcaagtggattcttctctctcgcctgcaggaagctgacccattcttgaggttttggattcgttgccacctctgttgttgtactccctctccactgctgcttaagctgcttcttagttttcctcgccccttccttgacgtggggccagcaatcatctcttctctcttgccagagctgcctctccaccattctttccatgcatacttacctagtgtgctgatcacgattggtctaggaaacagattggctggctttgtctcatgacagtgatctttcatttattcatcaactactatttgttgagtgctggccacatgtaagtcttttaactagtggccaccaaagggctttaaagatagaaccataacatggtccctcctctggtctgtaggggagtcattagatccataatgagagtgaaagtgatagtggcacaaggaaggtggagtactgtgggcattagagaagggggattagaggaggttggcatttgagttgagtgttaagctgtggagattggggaaagtctgtgggactggcatgaactcagcatcaaaggcaggggaccttagaggtctgtgcaggcatctggagcaggagagaggctaggacgtggcataataagcacggggagaagtgggcaatcagattgctcttgaaatgccaggctagggagcttggacctttgcagaaaccaccaaaggtgtttatttaggaaagatgtcagagacgtgcttttggaagcgtaacagccaccagggtaaagtgaagcagagagagaagggaccggatagggcaccagatgctagcagagaaggcgcgaggggatgagggctggaatttagatgaggctgtggtaggatagggtcattggaaaggaaggatatgtgtaaggagggatgtggcagagttcaagagagcaggatgcagcagctgcttagatgtgggagggaggtggagtagtcttaagcttcgagtctgagctggctagagaagagggtgtgagcccaagatccaagagatgagggagggtcaggtttgttattggaggaggagaagttggtaggttcagttttttttgtttgtttttttgttgttgttgtttgggctttattttattattattattattttttagagtcttgctctgtcgccaagctggagtgcagtagtacgatcccggctcactgtaacctgtgcctcccaggttcaagcaattctcctgcctcagcctccctagtagctgggattacaggtgcgtgccaccacgcccagataatttttgtatttttagtagagacagggtttcaccatgttggccaggctggtctcggactcctgacctcgtgatctgcctgcctcggcctcccaaagtgctgggattacaggcatgagccactccgcctggccgttcgttagctatttaaaatacagacatagtgctcagtaagaagtcagggaaagagatatacattgtgaagtcatttgcaatgaggtgatatttaaagccttgtgtgacaaaagagaacccagttcagcagttggagaatgtccgtgctcagggttggattagagaagaggtggtcagtggagtggggagggcctggagaaaggagagtactgtggcctgaggactggggaggagggagagggtagggcatgggcacttgtccagtgctcctgagagagggcaggaaagagcagggcaggccactggcattggtgaccagcaggttacatgtgagcatgaggaaagttttctgggagttcgacagtagccagtttgccagcattactgtgtaataaaatagagacaggacagtaggtcatgactaagggagagcaggaagaagggaaagaaggaaaagattagtataaaagaggcaaaaaacttggctggtgtggtggctcacgcctgtaatcccagcactttgggaggctgaagcaggtggatggcttgagcccaggagttcaagaccagcctgagcaacatggcgaaaccctgcctctactaaaaatgcaagaaattagctaggcatgatagtgcatgcctgtagtctcagctactggggaggctgaggtgggaggatcacctgagcccatgaaattgaggctgcagtaagccgtgatagtgccactgcactgtcgggctgtgggtatgaaaccctgtttcaaaaaaaagcagcagcaaaaaactaaatcctgcgtttcacacccattatgatggctgtcatttaaaaaataatcagtgaacggaaaataagcgttgctgagatgtgggtaagttggaactcttgtgcattaccagtggggatgtgaaatgatgttgtggaaacccatatggcagttctcaaaaaattaaagatggaattaccatacggtccagcagttctgctctgggtaaataccccaaagaattgaaagcagggtgtcaaagagatatttgtatacccatgttcatatcagcgttattcaaaggtggatgcaacgcaaatgaccattagtgcatggatggataaacaaaaggtgtatacgtatacaatggaatgttatttcgtctttaaaaggaaggaaattctgatgtattctacaacatggatgaaacttgagaacgttatgctaagtaaaataagccagacacaaacggacaaatactgtatgagtccatttatatgaggtacctacagtagtcaaaatcatagagccagaaagtagaatggtggttgccaggagttgaggggagaagaggatggacagttgttgtttaatgggtacagaatttcagtttgggaagatgaagaagttttggagatggatggtggcagtggttgtgaatgtacttcaaatgcatgtatttcactgaacgctacacttgaaaatggttaagggccaggtgtggtggctcatgccggtaatcccagcactttgggaagctgaggcaagaggatcacctgagcccagaagtttgaggctgcagtgagttatgattgagccattgcactccagcctgggagacagagcaagaccctgtctcaaaaaaaaaaaaaacaaaaaacaaaaaacccaaaatttaaaaggccatacagacaatttttaaatgatgaaatgataaatgttctgctatgtgtattttactacaataaaaaattaagcaaatgctggaagaagccaatttgttgaccaggggaagaaataattaaataaaaatttatctcatgctttggtaaataactgccagcctttctttccttaagttcagagcctcgctctcttgacccagtaccaacaggccctttctgggatcatctcacccagagatcataggtggttgttctgagaagccccttaagaaagtctacaattaagtttggcttcaggtgggctgcagctagggagaaaaaggaaacccttttttgttttccctttaatttttattttagattcagcgggttcatgtgcaggtttgttacgtcagcatattgcatgaagctgaggcttggggtatgaatgatcctgtcacccaggtactgagcatagtacccaacagttaatttttcaacccttgcctccccgccagtagtccccagtgttgatcgctgccatctttatgtccatacccaatggaacatcttttcttgaaggcagactaaaatacctgttgaaacatgagcatgagctcacctgtcctgaaacaattaaaaatatcataaacacctggagagaagaaggcacagtaacaataacattccatgaatgccttatattgcctacagactaaacctctttagggttaaagtcctttcttggggctaattggacagaagataccacaaaaatgttttaagaaatacatgtattaaagaattttagcaattggagtcttatgcaatgtatagaaatattatttcagaaaagcctacacagtctgtgctgttattttcttatttctcttcagccctaatgtgaaccattcctaaacagtgtgcacttggttctgtaatctgaacttaccttatcatccatgatggccgtgttatatttaggtggtaaaataacatgtgcaactttgagtaggcatgtattctcctgtctggaaatgcctaaaatgttcaatcttgattgtttttcgatccgtagatgttctatttagatgtgtcctggtatttgcttcctccttctattttagaagaaaatattgagctgagggcagtggctcgcgcctgtaatcccagcactttgggaggctgaggcaggtggatcacctgaggtcaggagttcgagaccagcctgaccaacatggcgaaacactggctctactaaaaatacaaaaattagccagatgtggtggcgggcgcctgtaatcctagctacttgggaggctgaggcatgagaatcacctgaacccgcaggcggaggttgccccgattggagattgtgccactgcattccagcttgggggatagagcgagactctgtttttaaaaaaagaagaaaaagatgaaaaatactaataatttatgaatcttaaattttcattaatgctggttataaagaaacagaaggaaatagttggcatagtatgataagccaacattgaagttttgtgtgttacatgtaatgttcaccctaaatagtattaatagttgctttttgaagaatatgagtctcccagtagtaaagagaaaataatttgctgtatgcaatcctctaccgtgctactagcatatcatttgtgccacaatatttattttcaaattataagctgcaaattctataaaattctacttgagaaatggcttgggaactttctctcatatccacttaattgcaaagtgtcagaatatttttatttttggagatggagtcttgctctgtcactgaggctggagtgcaatggcgtgatctcagcttactgcaacctccacctcctggcttcaagtgattctcctgcctcagcctcccaagtagctgggattacaggcgcacaccaccacacccagctgatttttgtatttttagtagagacagggtttcaccatgttggacaggctggtctcaaactcctgacctcaggtgatccacccgcctggacctcctaactctccgggggttacaggcgtgagccaccacgcctggtccagaatatttttaaatgaaaaactttctaaaaaccatatagctaaagatgcacatcctaagtgtaaatattttgttaaacattgtgttttattagagattatataaatctaaagtgaaaggctaactgcagtttgtggattagataggaaaccaagctcattggcgctctggatgagaaggcagtgttgacattattgtgaccagctcctctggcagtggtgttgactccaaaactgtaatcctttttcttagccttaacgagatgcccatcaaggttgggatttccatcacaccttaccctttcagactggagcatctgtgattcttctgcaaggctgctttaaaattttctcatactgcaaaatatctggacagccaacctagtttgtagagtggcaaatgtcacagcctactttatgggtttgattacttttgtatctgagaaaacagctttcccagaatcaaatgataagtctatttcagagacgactcgtagagcatcttctttgcccagcctgccttcgttactgagatgatcacgtatatatttaagtctgttttcaaatgcacttgtggtgtgtgtggccaacccagtcatggcacctatatgtggatctgagcactcatttgcattgcacagagtccctgaggaactcattaaaagctgggggcctttggcctgggctgacagggtcctggtgccaccacttgtcagagggtgtgtttgatgctgcttttccctttgcctctgtgtccaggctttgcatagagtcactatgtagtcactacaggcagaattgattcaaacacttgtactctaaactccttaaactggttttattgttgttgttgttgttttgttttgttttttgttttttgagatggagtcttgctctgttgcccaggctggagtgcagtggcactatcttggctcactgccactctgcctcctgggttgaagcgattctcctgcctcagcctcccgagtagctgggattacaggcatgtgctactatgcccggctaatttttgtatttccagtagagatggggttttgccatgttggccaggctcgtcttgagctcctgacctctggtgatccacctacctcagcctcccaaagtgctaggattacaggcgtgacccaccgcatccagccaccttaaactggttttagacttgagactgtctgccagtgcatgcatgggttagtcctgttttatggttgcagtgtgtcttgtgaaggctacattccattgtttttctcactcatgcatccattattaaacacccactatgtgctctgcactgtgctggacatggacaatggatggtagacattcgcagctcaatttccatttacccgaggtttgtcttttaccttgtggactttgtgtctttgcctccaggtggttctcctggctctttgccctagcctgattcagtggagtcggcttgcctgttggcccagcctcaggaatggttaagtgtcactgaaggcctatacatgatgccgtgaaaagcacaaacaataggctcaggttttagcttggaattcattttaactttcagtcttttggtgtgtaaagagggatgaagaaagcaattgttgactttccttcacatcagaattgaaacttgtccaagaacattcagaggtgttgggtgtgttgtcactttttttcctttctcaaccaatgtttaataaaaatcctattaatttccaatggagtacagacactcacaattctttcctggagaagagtataggcttctgccagaggagaggggacagaaaataatgagtaacaagtgtatagacctttagggtttacaaactattttgtctccttgatcctcaatgcaactttgtgagatatttattaccttcctttacaattgaggaaactgaggcacagggtgtttattgaggtgccagtgtggatggcagagctcctggtctttctggacaattctcagacggtggctgctcctggctgaggggtacgagctgggcttggcccagcctgacaggtactcctaagtgagaggagccagccagaagcaggcctccctcagccctcctgcctagcgtgcagtgtggtgggaaaacagtctcccagaaaggaggctgtgtttctgctgcctcttcgagctcaagaaagatgaagtagggtggggtggggcaggtgtagacaagggaagtggagtgggggagcagtgctgagaagtgacgctaggaacagggctcagttcagacagcatcaggtgctgagatgtggttgtcaccgggccacacgtgtgggtgaccacaggagggaacgtagcacttaatggggccccacgccttgtgtagaatcctcctaagtgctctactgtatccccaattttacacatgaggaagcagagacatggagaggttaagggacctgtccaaggtcttcaggtagtaagacagcccacctccggagcccacacctgacccctctactctgttgcattctgacccagggacagtttctggaatgcctcgttttaattccctttagtaacaacatcctgcagcaaacccacacactgggtaactctttgctcttctctcctcagaacgcaagcctcgttgtgacagggctccaggaacccagtaattgtagattaggaacagatgagacccgtacttatttggagacattgacacctgtgccatgtacttcccagagttcccaacttttaggacaaacttaggctcaaaaaccacagattcttccttcctccaaatgctagtctgaagggatggtttgcttgatcgtgggataataatgctattttctgtttggtttataaagtatgttcacagacattctggtgtttgatttgatgccagccatcttctcacctccctcctcaaaaagattgaaaaaggcagaactgatgttaacaaaggccgttcaagtgaggaataggttgttttgcctcttggatgtgaccttcaggctattacatagtaaacatgtattcctggttctctgaaaaaggcaacatgtatgtgtggcctggaataaacagaccttgtactaaatcctgatatgattctgatgcgttcaaaagcaagaatcttctcacattaagacatggagatttagacagctgacagaggaattaaggaaactaatatttgttgagtaaacattactccagtcatcttcactactatctgttattacccccttttcacagatggagaaactagggcgcaggatgcttaaacaatgtcccaggtaccagaggagttttcttaaaagtctaggtcgtgtttattttactggagagcagaggagagcaaagagttagccagtctgtggttttactgcaggatgttgttactaaagggaattaaaagccccacgatgattaggtgttaagacttaatatattttggttaaaacatagttttagagtgactttgactgtttggattgcgtgtatcaccaaatgcgacacccctggacgggactagtcaactgagtcagtaaaagtgagtcagcccctcgtgtgcacgcttgctcacctctgagagggtttaggaagagatgtcagtgggaggaaagttcccacaactgactgagtttgggggcaagggagcagtctggagcatcaccattgctgacaggcaagaagggttttttggaaggtgaggagtgaggggagaggaggtacttcaaagggtgctgagcccctatcagggtagggctgctgccatggacatgttgattattcatggctttgagacacaagttgcttgtggtgacctcctccatgaaacaagcagggaatttggggacccaccagctttctatgctgtggtccaggagggcttgggtggggtggggtggggtggaggtggcactggggacccaccagctgccatgctgtggtccaggagggcctgggtggggtggaggtggcattggagaaggaacgcctggccgtgagctaattttgcttgagtccctggttggggtataaggctgaatgcgccccttctttctcttccctttttgcataccatgttaatataaacaaaaaaggcttcttccctttgcttctcggttgaactctgtaagtgggggagtaagtttgatgggtgcattatcacttagtttcacaagcagcagggaaactaatctgcagctacagtaggaccagactgtgagcccagattctcagactcccgggccagtgctcccccaacctctgacatgctgtagaaggatgcttgcttggctctgttccttttgagagttaaaaaattggcctactattattttgtgaattgtgtgtacattatgttttacataaaatttagagggaaagaggtaatgttgcataaatatgtactttctgttaagttcacctagtttttaaagtatgctatttgccagtgcttgcaaaggttgtgatagttgtatcaacgaggaagcactgataatttacctgattccatctataggatctttcatttaatttacctgatgccatctataggttctttcatttacagtgattggccagttctctctacaatacgcaaagtgcagagctagcccccttcaaaaccgatactcgattttaaagctgataactaagatatggtgttacggaaaacacaatcctatgctccactctctcatcactactctttaattgcactcgggggaaaaacacatttaattgtttcaacgatcattactttttttttagtaaatttatagtaaatggaggagattaccaaagggctatttttttctcagcttgtggtttctaattacatcagttacagctcagccttcttcttaactagagtgcaggcatgaactggaaaagaatgagctaatccatgatagatcaggtggaataaagatctccattcatatctttaccttttatcccttgttctgagtgccaagaattaatgctatttgaaagtacaaactgaacctgccaagcttcggacagctaagataatcctaattattttaaatgttagtgagaagggcagcagttccactctggaaaagagttctattgtgaaacattaaatatatgctaagtggtattgattgcacatgattttatttccaaacactatggttatcatgaagtggaagaatttgttgtttaagaaattttcatcagcttttcatcagattctttcttatgcctacaaagtctaggaaactgaagaggccagcaattttgtttgtctgccttggcagtcagcatctagatgaagagttggtaacaactgaaaaatgccacttgtattttattttaaaatggtttcttaggagtttaatagtgtttaacatatagaggaaggaaaaatgtttttaaagcatgaatatcctgttttctcacatcactggaagagaattattcgttccagtccattgacttccaacagatcattcaagttaaaagtcaggggtctttgcaatgtcaaaagatttagcacttagagttttgtggttttttttttaagaaggttttcttttttgacagtataaatatttttcaaaaataatactcatggttagatggcatcaaaatcatcttgaagtgttttttcccctcattggtaagaatgatcctgtgtaaggttttctgtttatttttaaatcataataaaataacatcccagtagcttcggtagacaaataggcttcttgagagaaaacagatactagatttgctggttcaaacaagggtcagcctcggaggtttacccacctttcattgtaacacaaaaaaatatcagatgggcaagttttccttttttcttttccttacttttcagtctctgctgtggtgtgcagaaataatttcttctatttctgtaaatgctgggaggctatcaatgattatagggtagtataatccttaattgtttattgcctgtgaatgcttcctgcccccaaccccagtgcagctggccccaactcccttccccaagcacaagagcagtacactaacatcttcactgacggtgtgttgagcatctcaggctcaattattcttcctttcttcggggttattccccagagtggaattaccaggtcagaggggctgaacagctttatggttcttattacatgtcactagattgctgtccagagagattgaaccaatttctagtgctaccaatactatctgttcccccacagtgccactgacgctaggagttagcatttttacaaaatgacctaagacaagacttttgagttgaaattagcctggtgtagggccccttagaatcaaagagcgaaaagcatcatttagatttttgaatttttaattggtatgaaataatttacaacggtcaactattagccttctccttccaaaagtttaaggaagctgcattaaaatggaaaaggtacctctgagggacgatctttaaggatggtagtaaaagtgattttggacattagtcactaaggaaaaacacactaaatcttttcacgtacctagaactctatgaggggctatacttaaacagatactatccctaacttcaacagcctattatttaaaaacaatgctaagccttgaacaaatgtaaaaatagcatgggtttaaattttgagtggagaaacactataaacaatacggctgtttttcaaaacagggtgagttttacattttctctagagtgcagtcatgcattaaaagtatgcttggagccccgctagtccatgcaggtaatattctgcatgctttgtggccccacgtcgcaagagcactttccaagaaaatattcataaggcaagttagagcaaaagggggatattgtcaaattcctttcttttgcaaaattcccactcctccccttttcagtcccaagttggctaaatgaggagagggcatctcccggggcatctcccagtcagctgctaactggaaacaggcccagggctctgaacatgttgggagaacacatacctattcctttacaagcctctgcatcagcttggcaaaggtccgttgctttgcctccttaaactcacacagggattgggaaggttcagctgccagttctgaaatgtggggcccaggagaaggttggtgcaggggccagagcacgccagagtcagcctaatcagtacagtgctgcccttgacagcttgcacaggatccctgtgttaaacggggagagtaattctctcagtgaatggtttgagggtgaaatacctcactaaagtatgtgtgtggcatacaggtagtagtcagtaatgtttactgttcttctccatagcttctatacagagaaacttctgtcactggttgggggtggggacattaacgcacggactccaggaagctcttagtcggctctccagatctgtatagtaacaagatctcaaagcagtctgctgcctttggaaaacatttctctgtacatatatatgacaaccaggtgcatgtatacaattaataaatcaccttggatttgcatggaatttaaatgcatataacaatacaaatttagtaagatacttttatgaactgtaataagatgaaggcttcatatttcctagattcctagttttggttgctatatttatatatgcatatgcgtgcttttttgttatgaaatactacttaatgactccctttaaattaaaaaaaaatattttcctatattttaaagcttacaaacttatcctttgctttttatttaccttattaaagactaaacaaatctatcaatataaaaagtaaccacttgtcaggaaattgcctaaattgtttttcaaatttattcacttactgaattttcagatcatctctttccttcttggatattgaggtagctgtacaaaactatccatttgtctatctgtctacccatatgtcacactggaagaagggggccttctgaaagaatgtggtccagtggagtggttaagggcctgcttcttaaatcctagctctgttcttttatttctgtgtggttccactagctgcagcaaaccttttccaaacccgtaacgagtgtaaatagtgttcagttgtaaaaaggtctcttttcagcatggtaatataccttattaaattccaaacataataagtattgatggcaaacacatcaggacccagtgcagcttctactatgatttagttctctacaaatgacttcagcactcagctcccaatgcattttgctaattacatcatagatttccctattgatgaacacaagctgaattaacacaggagcactaatgtaccctttcaccattattgttgtacaagaagccgtggcagatgctggcagttagttacacaaacattagtattaacgattggccatttggaattggtgacaaactactgcccggcagaatcctgaggctgaaaccaatcaggaagttaatgaggagagaaattaccactgcagcttccccttaattacattcacactaggcaggaagggagttctgggggtggatctaaactcagctaaggttaagaaggtcagagacccttttgcttaagttttttatctactgtggctgctaaggttgcaaaagttgcttaacacattattacttttgcatccttcatatttaatgtgggttttccagtggagttttatgttcctaggtttgctttcacaatttatctgacttctattttagtgtgatgtaatttatttacttttctgtttttacaatttttctctcccatttactgtcttttactttttaaaagttatgtatgctgacatccctttcccccgtctttgtcctgttatgccaagagaaataatagtaaagttaatatgctatccacttcacctgctgtatcttgaaaaagtagggtgggttacctgtcgtggtggaaatgcatgggtggagtcttgcttgaggtaatgtgtcagatggatcacttgacaagtttcatcagcatactttgcataaaggggaggagtccggtgaagggtggaaatagtttcccaaagaggatgcagccgacttgttttgttttttaatgaacgttaaactggaactctgctatctagcttactcctttcgttaaataggtatactgtgtagaatactatttttttattctaaagaaatgctaggagttttaatgagtgtctataaaaacactttcaactcagaatagaaatggagagcgtcactttctttgttgtaacctaattgaataatgaatgtataaagaccagccacttttaacattactccctttctccctttctctctttctctctcacctcacttcgcagtattctcgccgcccagcagtcaagattctggcttggtttccctctcgagcagctctcctattagtaacaagagcacaaaggcagtgcttgaatgtgagcctgcgtc

SEQ ID NO: 3 - DNA, 729072 bp, Homo sapiens
cgaccgagctcagggcccaggctggttcatgctattcttgcttttcagaatggtatcctcgtaatgaccagctccaggggcagtagcggcttctaagggcaagccctgttgctggtagccgtaattgacattcccacaagggaagtgacgtagcctgaacagaggtacctccttcatattggcagtcagcgaagagggctctaggagcagtgaggcccccggaagtctcccagttgcaacgttaggtgggacagtacagcttccctccagccccaggttacccctgtcgtgtggctccttctttgctataggattattctttttggtgggtttctctgtaaaccaggagccgtacgttgggttccacaagctggtgggcttgtttctggatccgtggaccttgtgcaactccgaaggagggttggactgagagaatgccatattcacgtgtcccccttccacggccggccctctagggactcgaacagagatctctgcagctgtgggtttctttgcagccttgccagaggaggtggtaggcagaggtggtggggcagctgggctgcgctcctcctcccgttttgcctgttgagagaccaggagaggaggaaccccctcagggtccttgggcctcacaggcactttctcttcctcttccacaagtggaccatattctatcggcaaagcggtgttgattacatccgggtcctgccgtaggggaaattattaaaactttgaatcagagacaaaaaatgttggatctagaagataccttagagatgatgttatctaaacatattctacagatgaggaaaccaggatttattgagaatatagtaacttacaggcactggggcatacaaaatgaatgggaagtcatccttatcctcaaagaccttagaggataagcgctataatggaagtgtgtatgggtgcctgggacagagtggagcaggaaaagctttgcagaggaggagacctttggccagtttttaaagattagtggatttaaaaaaaaaattaagattattatttgtattattccagtctagttccactaaaatcgttccaactggaaaaaataaaaataaaagcctatgtgtttgacttcaagagtgatggtggggggctggggggaggaggagaggagacacatgccatgttggcctacagggtttattttttgatctcttcccagctgctttccatttccatttgggtactttacacttgattgtaagttttcctgtgccacatcatcacatgtgcaggtaccacagtgcatgtttttgtgtttgttttttagagacagtcttgctcagtcgcccaggctggggtgccatggctcaatcttggctcactgcaacctctgcctagtgggttcaagccattctcgtgcctcagcctcctgagtagctgggattacaggcatgcaccccacccccccacccccccacccccgctaatttttgtgtttttagtagagacaaggtttcattcaacatgttggccaggctggtgtcgaactcctgacctcaggtgaggcacctgcctcggcctcccagagtgctgggattacaggcattctttaactagtctggatgtgagggaccctttgcacaacccaggaaatgctgaagtgctgtgaggaaaaccatttacaaaaacaactgtgtgctagatcattttcacagtaatagactgtaacatagaagaacagaagcagctgccagaagtttagggaaaatttgtggaagaaaaattaaatttggagaaattaattaatattttatgcaaattgagaaaataccctcattacctgagtaacagaaaaacacgagtgttcgagtttaaaaaataactacctctgactcattaaaacattctttagttccctctgtgttttagtaatttctatagtgaatcaatcattttaaatatgcttgtgtaaaactgccttttaagagggatattatagactattgagaaaaatactcctaagaaggtatatatgtttaagtgggtgtattccattcagattacaacaaaataacctaatgtcattaaacagagttctctgaaagaaccttcaataacgtgatataggaagtctatagataaaaatgccagttcactcacgtgagctgaaaggaataagaggatggagtagtgaggctggaaaatgactacagtttgaaaaatgtgtctgtctttagtcacaatgaagaggaggggatttaaagaaatagtaggtaggccaggtgtggcagcactttgggaggccgaggcgggtggatcacttgaggtcaggagttcgagatcagcctgccaaaatggtgaaacaccatctctactaaaattacaaaaaaaattagctggatatggtggcacatgcctgtaatcctggtcactcaggaggctgagggaggagaatcgcttgaacccgggaggtggaggctgcagtgagccaagatggcgccactgtgctccagcccgggcagtagagcgagactgctcccaaaattaaattaaataaatagtggtttattgactcttctaaaatattctcagaattagatatcctggcagaacgagaaccaagagagagggaaagaaagtgaatacagggaagaggagagcatcggacagaacaaagccctgagcaggcgattggtgatactggcagcaaggctggccttgaaggggaggagagacgggaaggcaggtggtgagaaatggcggcagaggcagagaagtttgtatcagagacagggaggaaatgagggcattctcttatgatgatctccaccctcttggtgagggaggaagcatagctgtcggctgaaaatgagggagagaagcaaaaatttcgagtcgttattgaaggaatgggagagggatctgtagaggaacccacaggattgctagaagaatgtttgacttggacagactcttcaggccttaactcctcatctataaggtagggatattttacattccccactaaggataaaacgaaatacgcaaaaagtgatttgtgcagtatgaatgatagcaagtattattgatgatgttaaaatttctccagattactttgaaatttcattcccttaatcctcctgacatatatagttggacatataatctatcaattttatatgcaattaattacttcacatgttgttatttctccagccaggctctaaactatttgagagcagatgtgttccatacgtctgtgaagcttcaattttggctactaaaacattaggtccccagtagggacttgataaattctcgtggactggattgattccccagtttttactgtgtgtctggcactgtgctgtgtgctggtgaagttactaatatttattttacaaaatgggcaaatggagacaccagtcatttcattttagagaaaattaattttcactattttgatcataaatcttgtactctgactggcttgacctatttcatatttcggtatttgccatctttaagactgtttcatatagagtaaatgttgaccaaagggagaaaatgttttacctgggtgcagtattcaatcctctccaaaatgatggcaaagttgggcctgtcttcaggctgatgttgccagcactgagtcattatccggtatctaaaagaagaagcacattaattaaaataaggagaagcacaatgatgaaaaatatattttcttccagccccagggttgcaacgaatacgttgagggtgcgaactcgtctaggccccgtgtacttggcctatgctgccccctgctgattggtcaaggaagagtgcgcaggtgtaaaggtatctaacacagacatcctgatgtttatgttaaccacggctgctgtcactccattcctgagttaaagccactttggggacagaatattccaattatatttcccatccacgttgcttgtgggaaggaagtgaggggtgccaggcagggcaggagacattgcagggaatggaaatctttaaagtagacacagacatacggtgtagggcagcagggactgggcctgggacacacattcccagcaggagcttggggaatgtaggcctggtgagtccacagcctgtagccagacaatggatactttttctgggatggcatccttgcttttgagggcctgggagacgcatccatctcactgaagtcgcagtcacattcgcatcttggggcatattaaagggagggcagccatctgccccttcatcttaaagaagcatatgtggctctggatattttttgaaaagaaaaactgcttagtaactagcagaagtgttcctaaaagagtcatacacaggcccagggcagttcttgggtgggtccatccggcctccactggtgacaaactccagaacttcctggttgcttttgctggggtatggcatatatccaagagaaaagatttcccatagcagcactccaaaggacctgggcatgggacagaggacatggagatggatatagacacacccacccacattcacacacacacacaggcacacagacatacaatttcaacctttttttcccccattatacccttttccataacatagaactcttaaaatgtagaaaaatttaaaaaataagaaaatactacacatgatgctcccttaaaagacaacccctgttgatttttaagtcgtttctgtgctgagattttttttcacttatttgcagttatattcaatatgcaattttgaaccttgacttttctgcacatttcattatatcataaacattttccatgccagtccatttcataaataacatttggaatggctaatggctgtaaaacattccattgagtagttggtttgccttatcatttccacattgttttcagttttcaaaatatttaaaatactataatgaacatctttgtgcattttttaaaaggaagatttccttaagataaagtctctgaattactagattaggatgtccagccagctgatttcatagtctcttacagttctctgagcttcagtttcatctatcagatgcccactcatcaacttcactggcctattttaataggcaactcaaatttaacatgcccaaatggaactctttctgtacacacatcatctcctttattcttttccaactcatcagcacctctggttatacatttgctcaagcccaaaacctaggagtcatccttgattccattctcccacacccctccacttcccatccaacagtcagcagtcctataactttcaagatagatcttgaatccagataggataatctagtaattcagggtaattactgaattaaaatgtaggctaattctagtaaaataactagatcaaaagactatgaatattgacaaattcttggtgcatattatttggtttccaaatgtgttactctgttcatctaccagcaccatgtaaaagcgtggtagacacactcaccagcattgagtattcttaataataatgacaacttttgctgattttaagggaaaaaatggtagaatattttaaattatgtttattgacttgataattcacatggttggatgttttcccaagtgtttattaattcatttcacttttttttcctatgaattgcccatttttatctgctgggacaaattggtatctatcaatcaattttctttttgatttgtaggcactctttatatgtcagagatgttaaccttttataaaaaattcaaatacttttattagttgttttctttttttttttttatgtagtctcactctgttactcaggctggagtgcagtggtgccatcttggctcactgcaacctccaccttccaggttcaagtgattcgcctgcctcagcctcccaagtagctgggattacaggcgcccaccacaacacctggctaatttttgtatttttagtagagacagggtttcgtcatgttggccaggctggtcttgaactcctgatctcaggtgatccacccacctcggcctcccaaagtgctgggattacagatgtgaaacaccgcacctggccttagttgctttctaatgctactttttagcataccaaagaaagatttttatttttagatagtcaaacctatttttttaatgtcatgatttcctttattttatagttatacaatcttcccttcaccaaagattagataaatatttgctatcttcttctagttgtgtttgtttttgctctcttcttaaatctagttggaatttaatttggtgtctagtgtgaggtaaggacctaaattgatttgcttttcaaataactactcttccaacactatgcataagataatttcctccttacccattgactcacgattaaaaacaggtctgtttctggctatattttcacttcatctatttgtctgcttcttgcattgataccattctattttactttctgtgtatttgtcttaaatctgaaaaggcatttttctctatttctctttaaaaaatatttgatttctcatttgtttttttaaaagctttatgagatgaattcttcgtgttctaaaagaatcacctttgatattttgattaaaactttaaaccactacctaatgatcagctttttgacaaagactatcttttagtgtgattgtagttttctgaggttagcaaatattaccacaaaaattgtagagaacaatagttccttcatcttctaagaaacatggggtgcttttattgtcatcatctgtgtgaaatttcaaagactcttgtgagaaggattgggcaaagatattttccctatttttcaggtgagaaggttgaagcacaggttattatacaactaatccgagacagactggaatacattattagatctcttgattttgctacttacaaattgcctggcacatatattattcctttctgtttggagatctcttgattttgctacttacaaattgcctggcacatatattattcctttctgtttggtgatcttacttcccttcaaggcaaaactaactaggcaaaatcaaatgaacaagaaactggcagtaaggcctaaagaattatagctatatgttttctgtttttctagatagatataggttatagcatcctttgagagcactaatagaactgcacatgaatatttattttcttagtttagagttcaagggagcaagaagtagtattggtcatagaactttgacaattttgaataagtaggattttcatatttgcaaacaataccagatacctagttaaatttgagttccagataagcaacacatagtttttttagtatatgtatgctccaatatttatactaaaaaactatttgctgtgcatctgaaattcaatttcactgaccattttgtattttatctagaaaccctacagatgaggcaaatctatattttgtatgccagatggttctttcatcacctataagcctgccctaaacaggagcgacaaaagcccaaagctttgcaccagagcatttaaaatcaaatatacatacgtatatatgtatatatatacgtatatatatacgtatatatgtatatatatacgtatatatatgtatatacatgtatacatatatatgtgtgtatatacatatatacgtatatatatgtgtgtgtatatagatacgtatatatatgtgtatatatatatttttaaacttcactttcttttggtattaaacttgctctgcctggaatgattgatagaaataatagcaaacattattgctgattaaactgttaaacatttgaatcgatgaagataatctgataaaagattttaaaatatcaagctgttctgtatcagcctttaaaagctacatttttctccttaatcataacctgaaaggaggttatgattaaagaaaaaaaaaaacattgtggaagatggtctccaggtgtgatagaggttatgctcttaggaaaaatgggagccaaaaattaatatctttaaatgtccatccagtggattccaagatctcatacaccaagatctcatacagttctctgatctttagtttcatctatcagatgcccactcattagcttcactggcctattttaataggcaactcaaatttaacatgcccaaacggaactccttctgaacccacaccatctcctctttcattctttcccaactcagcagcacctctggttatgcatttgttcaagcccaaaacccaggagtcatccttgactccgttatcccacacccctccacttcccatccaacagtcagcagtcctgttaactctacattcaagatagatcttgaggccgggcgctgtggctcatgcctgtaatctcagcattttggggtctgaggtgggcggatcacttgaggtcaggagttcgagaccagcctggccaacgtggtgaaatcccgtctctactaaaaatacaaaaattagctgggtgtggtagcacgcgtctgtaatcccagctacttgggaggctgaagtgagaggattgtttcaacctaggaggcggaggttgcagtgagctgagatggcgccactgtactccagccggggcgacagaatgacagtctaaaaaaaaaaaaaaaaatcttgaatctgactactttgcgctacctccactgccaccaccaagccacatcgctctcctgtttctctcagctagcaatgtgcaggattttcttaactggtttctttcttcacttacccacctctagtgtaaattcagtggcagagagattttttttataaagcaaagatcatatcacactcctgcttacaacccttcaaccggcatcccatggtgtttagaataaaatccacatcccccatctgagttccaaggccgtctgtgttctgacccatcccttccacccctattggccctgggctcccttagctccgaccatcaggacttgatttcattcctcagcaagcaagctaggctccttcctgcctctggctgttcacactggcttttcctgcagtctggaaagcctttctctcagatctttccaaggcctgccctttctttcaggtattgaagttacctccggtaaggagcttccccccgcccacctttgccaaaaaaaccccagctcctcctctttctgcctgattgtcttagagcacttcctaatccttgcagctatataatttgtttaagcattccaattgtgaaacagtcaaaactttaaaaaggaacagagttatctatgtatctagatgttaatcttttgtcttattcttgtcagctctccctttctttatgaagacttagagacagaaagaccccacctccctctctctgctctcctgaagttagactgtatcctacaattgtatgtttcacatttttaaacaatgcgtgaaagcgcaaacgatactgtgttatagacattttttatattgtaaagttatacataaatgatatcctactcctttttgtaatttgctttttccccactgaacactgtttttgagatttatctatgttgatatatgtaggttgtcttcttttatactgcggaatagttttccatgatgtaagtaaaccacagttaatttttccatctcctagttgaggggtagttgggttgggttttgtttttatttttgtttttgttttgctttttctctattgtaaacaatgttgcaagtgaacatccagcgcccaagtctatttgtgtcatcttctctctaatgtatttacttaaaaataggagcgttaggtcacaggatgtgtgtgtgttcaggacaattacttaattgcttaagttattctctgtctctggatcccctgggttgctggtgctctaacttccctgcatatcagaatcatctgataaaacacagattgcagagtcccacccctagagtttctgttgtattaggcctgaggtgggggccgaggattcgcagttcccaggtggtgctgatggaccacacttagagatccactgggttaggttaaaaccaaatctcactggtgtaaaaacaacaaaggctcttgctctcattatctaatgctggtcagaaaggcagctctgactatttgtggccgcaccatcttatgacatgatctcagctccaggctttcaaaatgtggaggtttttcattcttgcattgtcttcttatgtttcctgtggtgctgttaagcaatttgatgccatttggattccttatcttttatctctattattttttactattaatttttaaattttctttgtggaagtttgcaggatctttatcaccattggcctgaggatgtgcctttttttttttttttttttttttttttgtgagacagagtcttgctctgtcgcccaggctacagtaatctcaactcactgcaacctccgcctcccaggttcaagcaattctctggcctcatcctcccaagtagctgggattacaggcacccgccaccacgcccagctaatttttgtatttttagtagagacgggtttcaccatcttggccaggctggtctcgaactcctgacctcatgatccacctgcctcggtctcccaaagtgctgggatttcaggtgtgagccactgcgcccggccgaggatatgccctttttccccatggtgattggcacttggtgaattctttcattctggaaatttatgtcctgtgctaggaaatcttgaatgattgctctgctgtctttattctcttcatttcctctgttccttctctctgggactcctattttgtcagctaaattggaccttttggtctaccccttaattttttaaataaaaaattattatattttcctatattttccatctctttttaggtttattttctggaaggtttatttagcttcacactccatccttttcattgcatttctgtcatcaaatttttaaataataagatttttttcttagaacagttcaaacttggaagaaactatgaatacacggagttctcctatacctcacacttgatccctgctactgttagcatcacactagtgcgatacacgtgttacaattaatgaaccacagttaaggcattattgactaaagcccatacttcattcagatttccttagttttcactgaatctctgttttctattccagagtcctactaggatatcgcattacatttaattgtcttgtttctttgggcttctcttgactatgacaacacctccgactttcctcgttttttatgaccttgacaggtttgagaatctggtcagggattttgtagaatattcctcaattgggatttgtctgtttttctcatgattagactgtggttacgggatgtggggaggaagaagaccacagaggtaaagtaccattttcatcacatcaggggaacatactggcaacatgacccagccctgttgttattactattattatttgagatggagtttcgctcttgtcacccaggctggagtgcagttgcacaatctcagctcactacaacctccacctcccaggttcaagcatttctcctgcctcagcctcctgagtagctgggtttacaggggcctaccaccatgcccagctaaattttgtgtttttagtagagatgtgtttcaccatgttggcaaggctagtctcgaacttctgacctcaggtgatccgcccaccttggcctcccaaagagctgggattacaggcatgagctactgtgcttggcccctagacttatcactattgaggttgaccttgagcacctggctgaggtcgttatttgtcaggtctctccactgtgaagtttctcttttcccctctgacccagccctgtactctttggaagaaagtgagaacacgcagcccacacaggcttcagggtagccatgcctatctccttgaggccacctcttatcacacttggatttccttatcctcctaagagtattgtttaaaataaccttttgtcctccatttatggttgcaatagtttttctgatcttttggaggatattatagttttttagaaagttttcctaaactttctacatgtttcttcaagttcctttttatatgtgtgttttcttcagattagaatattttcttaaatgtttgttgattcttggctgtctgttcatattttaagactgggatattaagaagccagtagaaagttctgtgtaacacattggctggtgggtagcttgcttgcttgtttcactagctgtaattttctgtgactgttgtaaaaaacaaaaccaaccaaccaaccaaacaaccacatgcttggtggcttaaaacaacataagttcattctctgacagttctgaaggccggacatctgaaactggtatcacaggactgaaatcaaggcatcagcagggctgtgtcccttctggaggctctaggggataatctgttccctccttcttctggcttctggtggctgcgggacctccttgacttggggccgcatctccagtctcagcctctgtgctcacactccctcttcttttgtgtgtgtgaaatctcctggtccttctctcttataaggatacttgcgatggcatttagggcccacctagatgatccaggacagctgccccactctagtatcctcaacttcatcacatctgcaaagacccattttccttataaggcaacaattctgggcccctgggattaggacctgataccctcgggcggccattactcagcccactgcacctgtgccccacttggcagtactgtatctgtaattttctcttcatcggtcctccaaagagaaattctctgatgatctgcccagttgccagtattcttggtgctgaggggccagtgggggccaggaccagggagacttcagttcagtctcttcagagagagagcccaagtcttgtgctgatggtagataagggacagccagcaagcttcaggggtgaggggctcagccacaggatttacttattccttaaacagacctttcatgaattttcctgtttgctatacctccccttcttttcttcctccctccctccctttcttctctctcctctcttctctgcccctcccttctacctcctctcccctccctttctttctttctctctctcgttccctccctccctctctctccccctctcttgcttgcccaggctggagtggagtggcatgatcatagctcactgcagccttgacttcctgggctctagtgaacctcccatccaagcttccagagtagctgggaccacatgcgtgcaccaccacacctggctaattttaaaatttatggtagagatggggccttgctatgctacccaggctggtcttgaactcctgggctcgagcagtcctccagcttcagcctcccaaagtattgggattacaggcatgagcaaccgtgcctggcctacacccctactttcaatttctggacctttctggggctctcaggcagagggaaccagccctgtttctggatctggacttggtttagagatccattttctaatcttctcagtaaggtaccacttgttcatgacttcccagtttccaaaattttgtcattgttgtgttcttgcagggtttaatgcaactaaaagactccctttattggtgtgtgtgtgtgtgtgtgtgtgtatgtatgtgtactttgtgaggggcatgtgttcaatctgccatttaaaattacatgtggctgttaatgtgtggtcccagccagcaatggcagcatcactctgggacttgttagaaatgcaaattctcagctagatcccagaccttctgaatcataaattcccagggtagggtccaataatctgaattttaacaagtctttatgaattctgatagatgctcacgtttgagaaccactgttgtcgggtgtattgattcttctcttttccctccctactaacacacgggctcccggcttagagtatagagtcctttggcccaggagcaccaccttatggctgcagggatacctggaggatgatggctgacttaccatgtgtctgttttagaagtgaatattccttccatgaaggcctctgggggcatccacttaactggcagcatggcacagcctccctttctatagtagctcgccctgtggggaaggagaggaaaaccaaactaggatctggagatggcattaagcatctgccctgctgggaaagttgagaaagtggcaacaatatagtctacccattaaaggtctgaaattaaccatgagtccttggcggttcaggaggagagcaggggcacacagatcatttagttaagaactttggtgtcatttaatagaagacaaaacaaaccacgagaggcatgagaggaatgatctatgcaatgactaagatacctgctagcagatgtttagctttctctgttgggttttgtttattatagctcacaatgaataacattactccaaccttataagtatagtgtgtttctgatgatctgcagtaatgcaagatccaaaatgggagaactgagagcagggcttgtgtcttaatcattttggatcctctgacactcacacagcatttagttcagtataggcaatcaaccagtaatctagacagctgtgtggatgctgcctcccatgacacacccagacaaaagaacacagggctaggtgtggagttggcttacaaggtagatgagttaatttattagttttcatcagtaatgtcattaatgcaactcactgctaaaaaccaataaattaactcatctgcctgttaggccaattgcatgtctagcctggtgttctcctgtgtgagtgtgttacaggaagcagcttcctgccagctgtcgacattaattaattacctcaataaataagtactgaatatttagtatgtatcaggtactctgccatgtgctgaggacataaataggtcagtctctctctcccaaggatattgtttagtggaagaaatggatatatatgcattgcaatatagaaaacacagtaatgcaggtatgtgcaaggctcagtgacacaaatgaagaattgattcattctacttgaggcaggggtagggaaagcttcacagaagggcactgatggagctgaggagaaaagacgctctcccagaagaccattcctgacccgtgccattgtacaaagtgcagagtaggtggggaatgaaggactgtaggtaacttagggtggttgaagcctggagctgggagctgtcagagctgagcctgggaaggaaaagtcagataacagagggctcgaggagtcatgctgcagcatttgtatttgaaatgagaggcagtcccagggtattctgaggagggagaggaaggaacgctgagcttgtgggtagtgttagaaggcgaagtggagcagaggagaggagtgcgacggatagcagtggtagacactccagagacgtctttactacatcttccacatgctgctgccccgtggtaacatgatggcctcagcatgctcacccctgtggggactgttaccatgtttgatggaggccttcaggggtggtgtctggatcagtctcacttattccccaaagagttaaagctccatataacgattgctcctctctctacccctgtgagttagggaaggggtcatcctgtgcaaggagggacttgctgagctcacatagcaagtcagtgttgtaaataatcagggaaaaaaaggaactagaggctaggaagagaagagtgagaaaaagtacaattaaagtagtattagcttttaaaactgaaaaaaaaaataatttttaaaatgtagtcttgaaaatgtgacagggaaaaaaaaaataaggctgcgctaagtactgatgggttctgcgctatactccacatctcctggggtggctaaagctgagcaatgagccaggccctgcatcctgcccgacctgggatgcagatgcctgcggtgttagaagccatagccacttagaattcctgagtactgaggagttgaggaagttcaataaagctcactttgaaggtctttccacatcaagtatccaagttatcccatgtctcagagcatggccagattacagttggaaccgatggacaacctaattaagaacttggtgttggctgggcatggaggctcacacctgtaatcccagcactttgggaagctgaggcgggcagatcacctgaggttgggagtttgaggccagcctgaccaacatggagaaacctcgtctctactaaaaatacaaaaaattagccaggcatggtggtgcatgcctgtaatcccagctactcgagaagctgaggcaggaaaatcgcttgaacccgggaggcagaggttgtggtgagccgagttcgtgccatggcactccagcctgggcaacaagagcgaaactccgtctcaaaaaaaaaaaaaaaaaaaaagcttggtgtcaattactgcaggaagtgtgatcccagatttaggccttcgggcatggtcactaattaaggtttcccatagcctgaaaaggaacttagtgaaattttaggtagaaagttgacagggtaccaggagatgatgtaagggacaagcagccacaccccattcttgaggggctgaggtggaagagacaggcccggaggggtgaggcagtctttactcacctgtagatgtctcgggccatcccgaagtctccaatcttggccactcttccagggcctggacaggtcaagaggcagtttctggcagcaatgtctctgggaagaaaggaaatgcatttcctaattttatccctaggaagatgagtgtacaacggccatcactaggattttatctccaagctgaagtttaaatagttccttcccttccctatatttcctttagtatagtatacttcagtgtgagagaaacagccttaacaattctaggcctcacaactaagagagaaatggaaaaggattaggggaaatgattaaaaatgtttaatggggcaaccataatgaaatgcatcatactaggaactaggatttattagccttttactaggtgctaagtgttgttgtaagtgcttcatatctaactctcacaacaaccttataagacacaaggtgctattactgtcctcattttattttttaaaaagtaagctaaaagtagataacatagggccataaggaatgctatctggccttaggcagatttggtacaaaccacgggctggtttctgccagttgtttgaaaaagtgttttagaacagcatgacttccctgaaatcaaattcaagtagattaagatattcacaaatatttctagttttttgttttgttttgagacagagtcttgctctgttacccaggctggagtgcagtggtgcgatcttggctcactgcaacctctgcctcccgggttcaagcaattctcctatttcagcctcccaagtagctggggttacaggcatgcagcaccacacctggctaattttttgtatttttagtagagacagggtttcaccaagttggccaggctggtcttgaactcctgacctcaggtgatccacctgcctcggcctcccaaagttattattattaatttttaaaataagccattatggttcttttgtccatgattttatctaaagcccttgctaagctacatggctgaagaatcgcttcttccaggtgataaagttgtcatctctgctgttgactatagatgacctgctttcctgtagcctgcctctgaggcatggtcaaccgctgtccaagactcatcagcttctactctctgcttaccattctggtcatgcatgtaggaatgaaggatacagccagaagaagtctgggatgggtctctaataatattaaggtcctgtgcaggaaaaaacaagatgtacttagggagcacagctgctgttttcatgttcaactggtttcatgatggttctgatcctaggttgagaaaggacttagagaatcaactggctactaggatactatttaaaaaaaaggatcttgattggggatcatgactgagggtacaagaataacgggttcaggtaggagattcatgttgttaatgctgctgacctgatccagaaggtttaagttgaattttgaggtggtgtataaaatgcccccataaaaccataaaagcataacacatatgacatcaaaaagaaagaaaaatagttggctgtatagccgttaattctcaagagaaatatagcaaagtagaccaggaacaatatttatggctccagaaaagtctttacactgatgtgtatggaatggttgttttaaaaagtgatcgtgaatttaatggcaagaaggtaaatgcagtacatagaatacatcaagagttgggagagtgacacgtcatttatgaaatggcaataaaccatgtccaaaggaaaaagatccaatttttttaaaaaaatggaagcatgtggatctggtgaggaagttccactctgaattccaaaagcgtaaaagtatacatgtgtggaagtccatgaatcttaagagcagataaagggtggagggagagagagaattcgaggcaactctgttgtgggtatgtaccacagacctcttagctagttagaacatgtaaaagacgttttttccatacagatgaccaaattgccccagaaggacagtttctgccagaagttttcttttgcttaaaacagatcatctgataccttcttgatttggtgtttgacaatttaatttcttaaaaaggagaaaagagcaataaatgattactctgggatctaattctaaccttcagtaactatttccagatatggaagtgacaggagtcttgagggaatgtaatcctgttaacatcatagcaacagagcattgggtatcatcaaaatgtcttgtggctgtaggaaaggagatgtcaaaaggtcagaggacaaatggaaatgatccctcagccagagaatctgtatgctatggtgaccaacgtgggcagagataaaaaacaaaagacaagtagaaaagatcccagtgctaagtgaaggaagacatctggccaccaggtgacgcgggttgctctcataggagtctagacttaaagcacatggacaaagatggaaagatgactctaaccaaggacgacttcaaaaggagcacagcttggtcttgactgagcaatggaatggcaaagcccagagctgagatttatggaaagttctgggtacaatgcaaaggacaagaacaggactggggagcggggaaagggctgaaaaactaccttaaaaaaaagaacagaactgatagactcttagaaggagcagatggtaaagctaggcccagctcctttttggcttccattatttctatgaagcagtatgacctgcaagttggaaagggttagaagctggagggagaactgaaggctaaaaggatgaagtgacaggaagaggataagctcttctgagagttgactgcctcatgttaggagtgactttggaacttaggcaagtgtacttcctgacctctcatttccccatttttattagggagaaagcataacttgttatatatttgcatgattttctatttctttgttttttctttttttttctttgagatgcagttttgctcttgttgcccaggctggagtgcaatggcacgatctcagctcactgcaacctccacctcctgggttcaagtgattctcctgcctcacctcccgagtagctgggattataggcgtcccccaccatgcctggctaattttgtatttttagtagacatggggttgctccatgttggtcaggctggtctcgaactcccaacctcatgtgattctcccgcctcagcctcccaaagtgctgggattacaggcatgatacttttctatttctaagctcttacaacatctctcattttctcttttgtacttacatattttaattattatgaacatgccttaaactcttagaagacatgtgttaataaattattgtgagttcaccaggttattatttactacattagaggcaaatcattaaggaagagctttgcaaagagcctgatgatctgttttacttttctgatttcaagctgtcagctgagaaagtcatcagctttcacaaggaaagacatacatgatatatgatgttcacagcatgatgtcccagtctatacagcttttaaacacaagaatgattgtaatagaagaaactaagtatagaagcaatgaaaatcatctttatgcttcatttcagagtattttagaaaaaattaatgtatccaacaaacattgtgtctatgccaagtatacaaagatgactaaaacagcatccttgcctataagccacccattgtcaaaaatgcaattccttaacttccccataaggagcccagttttctatggcagggggaagccttaaagtgatataggacttgaacattcaagatacaggcaggggtcctcacaggaggttaagaataacttataggtctccagccctggcgaggatattttatgacacttgttttatgtaaggggcaagtgaatccctgatagaataagttaccatctcaaagacaaagctgaaggggccaggagccatcgctcatgcctgaaatcctagcatttcaggaggccaaggtgggaggattactggagcccagaaattcgagaccagcctgggcaacaaagtgagaccctgtctctcacaaaaaaacaataaaacaaagctgaatcatcctacatccaaatggctctggagggagacctagtattctgctctgaagggggaaatgtgagcccttgagatctgcggggaagcacacagatcagcgacaggatgacaggaagagcacagtcactttgactcaccggtggatgaagtggttttcctccaaatactgacagccacaggcaatgtcccgagccacgtgcagaaggtccagcatggccagggaggagggctggctctgtggggagacagaagcgggccactgacgaggagcttgtcagtgagaggagggaaatctgaaatgctggcttccagtgctcacaaggaggcagaccgtgaacatgcagctacaccaggggcctcggccctggctgcacattagaaatcacctggaggcatttgaaagaatttggatgcctgggccccaacccagacctctctgggtgggcatagtatttgtacatttgaagtcttcccaggtaatatgatgccagcgtgcagcgaaggctcggaacacccagactccgggaagctaggttggagcaggtgttctttcccttttaatttattgtgcacattctctcaccccaatcttcataagcatttgaatacccccaatttataaacaagtttgtgaggaaaccacaggggaataggggagttttaaaaatcctcgatttaaatgtcttaaaatatttcttaaaactaattttcttcaagcagatccagcgctaaaattgattgaaaaagaaaagcttttgggaaatgctgggcaattatgagctatctcaagcttttccgcatgaggtctctttcattcaaaaggagatgtcacctccctacccctctggggacatctcatcttggcttcctggacagccttgctgagcacaatgaagcctttccagaaggcgacatcccatcttggcctctcttttaattcctaaatccctgacgtgtgcggcagctcagcttcatgcagtgtccgagtcactgtgttgttccatgttgatttcaccatttccccaagtcacggtgatgaagttccagagacagggatctcaccctcccacagcacccagcacaatgctggacacacactgggggttcagtgagtgttgcgtggctgattggttgattatagctgcaggccaggatttacctggaggagtatgattcacatacctccccaagaaagcacacgcaggtagggggtcaaatcaatcccctttagggccgccccaagaaaggtgtttgtttaagctggtgactcttgagcacctgggcaaactccctgcaggaaattcatgcttgtagctctcctattttgctcttcttttgaagggtgggctgaggactgggctctttagtcctgaggtgcccacagggaagtcacccagccaggcggcagcggtggaaccaggtggggtctgggtgcaggcttagcctgctggaggtttttctctgccatagatcagggcctccccaggactccctggagcaatggcctgggtctggaggaggtagacagagtcttgcttctctaggccgtgcttcagttcttggggagacaactgagagtggatagttcccctaccggtgccttacatgccccagagcacatacatgatctgctgtgtggtaggtagggaagagaaggtgatctccatattaacgatgagaaggctgaggactcagagaggctacctgactcaccccaggtcacacagctaataagcgtggagccaaagctgcccggagatgggctttaaggatctgggttgggagaggcatcctccctcttccctgggatccaaggagttaaaatggaagagagagtgcctgaagggggttggagcgtatgtatgtgactacagtgcccaatgcacaccaaatgcagaatacagcacccacaaacggcaaacaccacacttcagtggcccatcgagctgacccgggctccaccctgctggcctcttccaggccatgtagtctggggctggctgctcagcctctcagagccagtttcatctgtgacagtggcgtgggactgtcggtctccctgggttgtcaggagcacccacgccagcagcctcgggcagtgcctcatcaggggacccgaggtattgaggggtttccacatgggagaccagggggactcagaaaatggctccttgtgtttggcttatccagaggcctcgttaggggcagagggggtacctctgcacaggcgggcagcagagactctgatcattcccatcaagcagcactcatgcctgcatcatccctcctgcggcaaagagttggaatcaggattttatccccatctgccgctggagtgcagcacttcctcggacccagctgttcttctcatggccatggtcgtgggccttgctgcaggtgctccccatggtgggtttgcaggatggaagagcgaaatatctttttgctcttcaggagcatgctctctgtccctaccagaggaggccctggccctagctgtgctagggccttgaggaagattttcttcctaccagtctctttgtgtcttagcatccatcactcaggatgcgagggccatagatgtctcggaagccccaggagcctggagcgctgtggggactaaatctctctgggcattaactcacgggctaggctgttatggccccctgtccttggctgctcagagcagattaactgctccactaatcagtgtgcacagggcagacagtcagcaagcgtgggttatggggggtgtctggtgtgtacgtgtctgtggtgtgcgtgtgtattgtgtatatgtgcgtatggtgtgtgtgttttgtgtatgtgttgtgtatatgtggggtgtatggtgtgtgtggtggatgtctgtggtgtgtatatgtgtttgtgttttgtgtacgtgtgtggtttgtgtaggatgtgtgaggtgtgtgtggtgtgtatgtgtgggggtgtatgtggcatatatgtgtgtggtgtgtatatgtgcagtatatatggtgtgtgttgtatgtgtgtggtgtgtgcgtggcatgtgtgattggttgtgagtatatgtggtatatgtctttatggtgtgtggggggtgtgtgtgtggcatgtgatgtgtgtgtggtgtgtgcgtggtgtgtgtgtggcatgtgaggtgtgtgtggtgtgtgcgtgagtgtatgtggtatgtgtctgggggcatgtgtgtggtgtgtgttgtatgtgtatgtgtagtgtatgtaagtggtatatgtctatgtggtgtgtctgtggggggggggcgtgtgtggtgtgtgtgtgtgtgtgtgtagtgtatgtgttgtgtatatgtctgtgtgttgtgtacatgtgtggtgttttgtgtgtgttgcatgttgcatagatgtgttttatgtctgtagtgtgtgatgtacgtgtgtggtgtgttttttgtgtggtgcatgtctgtggtgtgtgtgatgtgtgtatatatgcatgtggtgtgtgttttttgtgtgtagcatgtgttgtgcgtgtgtggtgtgtgtctgggaggggctgtgtgcatgggtggggtggggtgggaggagctgtggacattggcaaacccgatgctgaatctagactcgcagagcattgccagccagtgcaccctgggaccaagtgattttttcatctgtacccatgcatttcgtttccacaacaggcacggctgacctgggcatccactctgtctaccgcgtctgcacatccgttctgtcatttcatgtttgcacagatgttgtctgaggccagagccttttatcccatctcaaagggtctttgatcctgatctaaggtctgtggagccactgagctacagagctggcaggaagtgaggacagagacctctgattctgcacctcaagcctggttcctgcacacagtaggtcatcagggaacccctgggagtatcaggagtatcagggtgattccaacaagcgaatcaggtggaattcaggcctctgaagtccaagtttcagaatctggaggcacacctccgcctactttctcttcatggcacatgtttctccatccctcatgtcccttggccgattcaccctcctttatcctgtgtaggatttactgatattagtcctgtctgtctgctggaaatcacattcctttctcacagtccactgaatcctcatcttacaaagttggattttgtggccccgagaatccatgcaggaagcccagctaagccccagggaagctgctgccacaaacacatctgcattggtggctctagagggccacaattggacatttgaaatcggccaaggatcccaggaaggacagctcacctgggcctggtgggtgtatgggaggcggggaggaccatgactggggtgctgcctgggtgtgcctggttggcaacgagagccacacagaggaaaagcggggccaagggttgaaagagcagattgggtgagggtgggactctggccctgagaagtggctcttccaaggacaggccccctccccgttctgggggtccctcaggtagtgcctgctgttagagggtagaacttggggacaggctcctgttctgactctccgagggtggcactctggggtgggggtagtgagagagagagaatgatctgcctttccttgctggactatgttctttgtaataatattggaatcatctttcatcatcaaaggagagagatgcctttgtctttgagagagggagagagaaagggggaggggagagagggagagatagagacacaccactcctcactcctgccatctcctgcccccgaagtccttgaacttgccaagtgctgggctcccagactccctttgcaaagtccctctcctttgcatgcatacaactttctctccttaagcctcaggaaggtccagtgggagaaccagggctgtgcctcttcccaaagtgtgatgccacgtgtcccccactgacagcagtgctgctgagaatctcagggcatgagggccaaaggctctgccttcctaggtggtggtgggaaagccagtgaatctgatgcctgtaccatggcagagatgcctggatgcctggcagtgttggctctaaggacacaacctcatcttgatagtttacagcttcccagaggggaccactggataagcagtaagttggagagggcactgaatcaagagtcacaaggcctgagttctagtcccagctcttccacttcctgtgtggccatggcaagtcccgtaatctctctgggccaccgttttctcatccatagaattggggagagacctgcattgtctgttcatagggtggtgttgagaaatgtgaaaggtctgaggaggatgccagctgatgagggctcttatgagacagacaggtgtagtctttatctccctgctccctgcccagtcctcctgccaggtatgctcaggtgcacacaaattcctcttctcaaggggtaagacagtattcttcttagatactgagatgcgtcacccagtggctaaggtgaaggtattttacatggatcctgactgaaggtggagatcagaatagctatgaccttgcagggcttccatcaccactttgagtccctttgagcagtgtggtcaggttgggctttctggaaccactggctgtcagtcttccctcctttcctgggagcgggagggtggccgctgcttttactgtgcaagtcttccttgtgatccccatagtacagtggttcgttgaggaagcctggatcctaaccttggggcctgctcagctccagttcctggtatccggggcctgctgaagacctgcagacccaagcatgggcagctgggctctgggtctgcccagggtgctatgtttaataatttagaaccacctttgagatgttctagtccaatcctcagatctcacctgtgaggatacccaggttaaaggtttaagactgccctaaactacacgggtgtctaatggccaagttggagctggagcttgggattcctgggtccaccctgggtatcttcacttcccaagctctgttaaccataagatgtgtgtagcaccttcctaaatatacggttggaatgtccaggtattattatccctacttgagacgtgaggactgtgggctctgaatgagtagctgcagagtgacctgcccaggtcagttgcttgagtagttacatggctgtcatgaaagttctcctctgtgtttgtctctagtttggttttccagagtcagcaggccatgagaatggatccaggctatagaatgtggatatggtttggatttgtgtccctgcccaaatcttacgttgaattgtaatccctagtgttggaggaggggcctggtgggaggtgattggaccatgggtggatttcccccttgctattctcatgatagtgagtgagttctcatgagacctggttgtttaaaagtgtacagcgcttcccccttcattctgctcctgccatgtaagacgtgcctccttccccttcaccttctgcaatgattgtaagtttcctgaggcctccccaaccatgcttcctgtacagcctgcagaactatgagccacttaaatctcttttctttgtaaattactcagagtcaggtagttcttatataaatgcaagaatggactaatacaaatgcattgcaggagccttgcacaagctccttggggctggggctcagccatcatctacctctatcttctgtccattctcttccagccagtcagtcacccccctgtccaagcctaaagttgacaccctgggttccatcgaggaacttgctacccaggctgcccactcttgctccttccatccttgctcctgtccttggcacaacaactgcagcaaagactggttctcactcaccgggcgagggcgggtctctcggaggaaggacttgaggtctccccccgccatgagctccagcaggatgaaccggggcagggattgcaggctcaccccaatgcagcgaacaatgttctggtggttgaatttgctgcagagcagagagggatgtaaccaaaattaactgagctgagtctgggcaaatcttaaactgggaggaacaggatacaaagttacattttcagcagctacaatgtataaaggcattctgtaaacatgggcagcaggggtcccgggctgagcctaaacccagaatcttgctggtgagcaggtgggaagaaccacagcaggctccacaggagttccatttgcaggagagtggctggagctgtgaggatgttgctcaggcacttgggtgaggaagtgtctcagggggcaggagagtgtctttctcagatactggtgcgtggactgggtgctagaattcatggtcgatttctcccaggaaggcctcaggcagaaggtgaagcaaaacaactgcttccaagagagactgggtgagacttgccaagtgacagcgtgtgaaacagagccagcaaaaggggatggcctcacgagtctatcagtttcccgtggattcctcatgggagggaccaagacttgggttttcttgttaacatgatccctttaggacacacagggcagtagggcctaggaattccacatgggccaacatgcatgtgtgtgcatacacacatgtacacacagccccccaagtgttgaaagactgggtgattagacaccaacataataatggttagttaccaccaagtagtgagatttgagtgatatgggtcttcttcaatataatctcatacttgccaagttttattcataatcaggaattatatgtatcatcagaaaataaatgttattttgtgtgtcctcctgtggttccagacctcacagccatatcactcacactgcctggccttgttacccctgccacttccaccaaggggacatcccagtctgcccccacctgtcaggacgttcagagtcttcccagtgtgacagggggccatgagcccccacctgatcttgaggtcaaatatctgccccctccttgaggggatctgctgtcacagcggacgccctcaggagccataggcactgagactctcagcttaaatccagatcttggagcctcaagtcaaaaggtgcagccagctgagactcagccctgctgatgggagcctaggatggggtggcctcccatcatattagaagcacaattactgggattggtgaagggtcttggagggagattatatcttgtactgtcaaagtctagcatgctccatttcttaagaaaaagtgagggaagaagaaccagtggataacagcagggatactggttgcagacagtgacatcggtgggattattaggccacacagactttgtttctgaaacaaccatcaagggttgttccattctggtaagaagtgtctagaatgtttgggagtctcctactggagaaaaggggacatgctagggacaacacgatttcccttggagatatcgatctgttagaaacctctccaggttctttgggggcagaggggagttggggtgagggtgtctctctgtggctttacctgatgatcagggcttccatgaggaaatccagttcgtcctgttcagagcacacttcaggcagcgtctgggcagagaaggggagggtggggaggaggaggaggctgtgagctgagaactgcagcctacagagtccgcaagccaagggcaggctcaagagtgagccacttcttaccttcacagccacttgcagggggcttgggtcgttgggcattccggacacctggccttcatacacctccccaaaggcgccatggcccagacccctgtgcaaaggagaagacaagaggagacagagtcaaacaggccacaataatgaggcagctgggggtcctgagcctgggcgtcacatttagtggacaaacacgagaggcgggggtaacatacacactcaggagtaataccctcaacatggctttgctatgcaatctcgggcttccagttcttcacctgaaaactggtaagaaggattccaaccagggactcatgacaatggtcaaatgtttattcattcaatcagtagttattgagtctctgatatttgccagggacacaggggtgcataagccatggcttttccccgggggaggttcatgctccttggggagagacagatcactgtgggtactggctggggagtatttccagtgagtgacagaggaaggcgcagttgctctagatgctcagaggaggggccctttgctcccctgctcccctggagggaaggggagccaggtagacttggagagagcacatctgaatgaattttgaggagagccctggttctcctctcattgtataaactccataaactatgggagttaatgtaagccaacatacatggccctgaatgtcaaggcttgtcctcctaggagggctaggggtgcccatagggagggctctgccggccttttgtggctagaggagtctgcggtgctgtgataacattcagcccctacactgcacccctctcctcccaggacggcagcagggcgctcaccgaatgagggtgatgtttttccgcggcacctccttcaggtcactgatggaggaggtcttgccagcaaagcagtagttggggttgtagtcggtcatgatggtcgaggtgcggagcttgctcagcttgtactcagggctctgcagctccatctgcatggcttgcagctcctggtgcttccggcggtacactgcaggtgggtggtcagctgcaacatggcctggcagcctggcccttgaagcactacacaggccacttcctacaggaagcctccctggatctccatatcctcccctgagctctgaacctttccatcatacttagaaatactaataaaatgattaaagaaggtgtgtctttaattgaagcatgatttaaagtaaatgcaaagctaaaaatcagatatatggaaaataattatttgtattatatagggcagagtcatgttagtctggttcctccaagaagcagactggagatgggattagacccaatatggtctgcagattttattagaagaaatgcccatgagaggaaatggggagggagccagggaaggctgggtgaaccagcagactgtgttgcaagtataaccccacgtgaacgagggagggagggaaggttgggtggaagcaccctgggtgccatggagcctaaggaagtttcagcaaggccctaaggggttctggagccaaagtcagtcatcagaggagtcccatgactcccaggaattggcctgccttagtatttctgctgtgctcagccattgggtagggcagcttcagtgcaatcacagcagtggatttgagggtgcagctgggatcttggtcagttgtgtttcctatagttggagaactgccaagccacagagttggagaagagccacatcatgaaaagatctctgaattggtgtctggggatctgtgctctaattccgcctcttgttacttacaagctgagccatgaggaccaggtcacaggacctctttggactgcagtttccctctctgtaggcagggatggtaactcctgccctgtttccctaaccactgccactccccaccctctagggttgtcaatgaaatgaattcaccaacataaaatggttttgaaaaatcctaaagagctctaccaatgtgagtgaccattatcactcctacatgtgaggatgttctggaaggcaaactccatggaagccagaacaaaattgtgattcagtgggtagattctgtgtgtaaagcccagccccccaacacatgggccagggcaaatgagtcacccgctatgtgctcagttccctcctctatgcaatggaccgaccgtgatcagattagggttacctgaggatcgaatgaattgaaatgtgtaaattgccgagcacgtagtaaccatgcaacaagtgttagctcctattatcctgtccctttgagggatggcaccatatggggacacagtgtgtgctgccatctcccttctaccggcagatccctttgcctgcaggggcctggcctgcgagggctctcaagagcctttccctctgcccttttcaagcctctgcccatctgtcctgggcatgtctctgccagcagtaagagctggttgggaccacactgagttctctgtgacctgcaggtcagctcaccttggctcacaggctgaacagaaatatactcagaaaccgattttcctatctctctgcctggagggtggtggagggctggtttggggaagagtgggctagtgcattacatagggtgggagccaaacaggagctgcgccggtggaagcatgtgggagctagaagtgacgtctaggggtgggggcgagctttcaccatcgtgatggacactgaaggagctccccaccccctgatcagccaggaggatacacacggggctgaggtgcagaatcaggggctcctcagggaactgcagctgctctggtggggggaaggttgggagcttccgttttggcttggcctgggctgccctaatcaccaccccacccaattccagggactagcataacgaagtgacaccttggcacctgtggcacagcctgagacactattcagtcctgccttcctgcccccttgggagtccctggggctctgtgcactcaccaatcatgatgccggagaaagccaggaccagggcggccacgagggcagaggtcaccacagagaggatcagcgagagtggcaggtgtggctccggggtgggtgacactggaagacaggtcccactggggtattgacaaccacaccaggtctcctttgagttggtcccaagtcagaaataacctcccccactgagacaaaaactacttgctccttcccatcgctggagaccttgtcacacttttcttttcaggggaccatgagcaggaccagactcatcccgatttgacaggcttttagcagtagcttttgggtgaagggaaatttaacagggatgaatatcagtggcgggatgttggtttgaaacatgagctgcacaactatggggtgaggatggaaggtgaaacgaaagtggatctggaagagatgtgggggccgcaggtgaccaaacaacagggtgcgctgtaagtaacaccctctgaggctaagttacttccttgtggccctgaggcactgggctcacagtggggaggggtcctgtgccctctgctggccagaccacacggaggtatcgtgcttggtactggacactacatttcaaaagggacatcgatagtggaacacatgcagaagagggacactggtggggcgggggaagagacacaaaactgcatcttgtatgaactgctgcaaacaaatgggttatttagtctgaagaagagttaaaggaggaggatggggccaggtgcggtggctcacacctgtaatcccagcactttgggaggccgaggcgggtgaatcacctgaggtcaggagtttgagaccagcctggccaaaaggtgaaaccctgtctctactgaaaatatgaaaattagcctggcatggtggtgggcgcctgtagtcccagctactcaggaggctgaggcagaagaattgtttgaacctgggaagcggaggttgcagtgagccgagaccacaccattgcattccagcctgggcaacaacagtgaaactccgcctcaaaaaaaaaaaaaaaaaaaaaaaagaggaggagaatgggagcactgtcttcaaacactgcacatgcacagctgctgctgtaaggaaacctaggagaggaaggttaaggcaacaggtccccagctctgaaactgcccaagggaacagagaaccttaggagcagtaagatccctgtcactgggcatgtttaagtggaggcaggatggccccttggtgggggtggtagagggcttattctatagtagaggatttttaagactccttcaggagccatgacccacctttcacacagtggtcagagcactcgagctgtggcaggtaggggagggacagaaagtttacaaaaccgaatccagggtgttctggaacccagaaaccatttgtggtcatgggccaaatctcaggctatgggcccctctgcctcccctggccctgcccccttaccaatgcaggagacgccatcctcagccagcaccgtcccgtggtcacagaagcagatgaccttgtggctttcagggtccatgtgacattcgtctacctcacagtgactgcagtttagataatgcttaatattcacttccccgtggccttccatcactagtgacaaggagggagggtcagtcttgggccgagcctgcctccccactcccagcctcagtactatgtctccaggtggtcactgtgggtgctctggtggtccctgttcctaggtcccatagccactggaagcacaactgtgtagaagagtcttcctgtgcatatagagagtgcagcggaggcagcgggcatgggtgtctatggatgtttgcttttgagtcagtggtggagagaagcccacgcacatgatctttaggttggctggtgcaggtattgggctattactgttacatttcctaggattctgcctctgcattcatattaaagcacacatcctgacttctggaaaatgtggtgacctgcgccataggaagcttgcctgccagggacccataattgtgcctctgtatcctggatacaggtcagagactctgaggttttagcttggtgggaggactgacctaagcaagtttgttctgctgcctggcagagaagctaccttttaaagctggggtgtacaggatgcccagtggactgatgaaggaaaccccatcttccccatccatttcggggtcattgtttgaggctgcattgccgcctgagtagcaaaccagagcagagtttaacatggggggtgggtgccaaaatcttaacacacacacacgtcagtggggcatgcagctctggccaaagttagggggtcactggggacctcaggggcagggatgcggggagggaagggaggctcagggcacagaggctgcatgtgggatttggctcagtagatgctgggtgtgtggctaatttcccctcaggtccaggccagctcccactctgccggtggcccactaagaagtggttaatgtgagcaagagtccaaaaagttctagtctttccaggctgggatatgcccatggtgcctctcccaggactggtcaggatggtagcactgaagagttgctcttcagccccattgggtcagggttggggtgtggcgggctgtgcggattgcgggaaatgagcccctgtgccctgaggctcccgtccctcctttcatctggggctgggctatctttgggctcccccctcgggctcctcccacccacccagcttggaaaagaagagcatgtggttaacacaagcatcttacacacagcgtcaatgcaaaacacagacacgaacaccacagagcatgcatgcattcgtcctaatctgtggggagcggggagccatcgtctcccagcctctcagcttcagaaggctctgctgactgtgctctgaagcccagacgaggcagctggggtcaatgggcagctgcttgctgaagggctgggctaagcctgcctgcagttgccctcgggaatagctcccatcagcaggcacagcggcgcctttcaggaagctggtgggctgaggtagggagcaggagtaaggagtccatgaaaccacaaaccagccccttcaggagctggcttggccaggccatccaagggaggctgggggagtccttatgggtgactcagagactagtctggcaagccaaagcctctttatcatcgactttgggggacatcaagaatcacatgggatcttgatgctgtcgctgaggaagcctggaggcagggtgctggctcgaaagccagcaccctgcctctggctggtccaggcaggtcgagagggaggcgtgcagtcacatcacagtccacacttgggcaggccaggggagggcaggggagggcagggcagggaggtgaggagcctaggactaagcagggagggagtgacaccttgaacacgaatcatctttacctatatatcctccgcctcctccacctgaggagcacccccctccaccccctccgaaaccccctcttgtctcccacccccacttcttcatggcctgggggcaggaatgtcctccggtggcaccctcctgcaaagattttccggcccagagcaaggaagtgttatcattccagccacctccaccacctgcgggaagagatagggaacctgcgtgaggatgctggcaaggttcaattagccatgctggccagagaagcaggatgcaggacgccttggagggcgcccgcaccagctccagctcccggggcccatcttcagtggggcctgggggcttcagatccacactaggaaaaccaggaggctgcttgccctaggagacctgtttggccacagctgagtacacccagatgagagcgtgccttgtacccctgcttcctgccagtactctctggctcaaaagcaggggctgtgcttggttaaggatggggggacgtgggcagacaggcagcatggcgactaaactcgttcctctatcttctcttcatgtcagccaagccccgtagcactggaccttcgtttcattaactgcctcccgtcctaacgagaaaagggactcaccagtctttgagcagccacatgtcaaaaccttgcactaaagttccttgcaggaatcctggactaggctgaccagagagcccgttgctgtctgtgaaaccctggggaagaacgccccattctgagcctgtgtttcctcacctgtggcttggggataataagacccacctgatggggttgatgttccgctcaaaggagacagtgagtgtacgaaatgctccacaaactgccaggggtggggagcgtcaggggctcgagaggcagaacacacgcgtgcagacagcctcacacctgggctcagcctgcttagaggttctccagggccaggcgctcaggaactgctccaaggtcaggagcagaagccctggtgggtggacgataccctggcaacaaaggcagcctcagggctgtgcttcccaatgcctggggctgctttgggctcttacaaaggaagctatctacagagccgaggttgaatgtagccacaggttgaccacaagaaatctcttctgctaacctttgagattccaggatatcccctatgcctactgttccataggacatttgaatagacatctacagttgtccctcagtatctgtggaggttccaggatccctccatcacaccaaaataaatgtccctttatataaagtggcatagtatttgcacattctcctataaaaaaatcatctctagattacatataatacccaatacagggtaaatcctatgtaatagttattgtattatttagggaataagtctgtacatgttcagtaaagacacaatcatctttttttttttttttgagtatttttgatctgtggttggttgaatcccacgaacgcagaactgatggataggaaagggtggaggtattctaaaaaccctaaaaccctttctgctgcagcagatgatgcatgctggggacctggaaattgatggtggaaggcagaaacagcagtgtgtgtgtctgccggaaccctacgggtgaaccggcctggcagggtttctggaagcacttgtggcccagattctttgggacccagagggacctgtaggtgggatgactgtcttgctagaaagaggaagccaggttttgaaaatgaagctgaggtcaggaacaagcttgaatctagaatggggacaagcagagctgaggcgaggccatcaggcaagctggggggactttgttagccatgaaacctccaggggtgggtgttgagcttgggtttgtttcgctgtcctcccttctgctctcaggggagggtgtgggcctgtcaaggctgttgtcatgtggcagagagaaggccccttaggcgcgttaggggccagaagttggcgctggtgtttgtgcacggctgtgagtaagcgcgtaataaataaatcagaacgagatggacggagaccatgcgctgtgctttcatcctgctcagcccccagctgaggaggtttctgacccccatacccgttctgcagccttcgagcaaatgtgtggaaaggaaaataacccatatcaaaatcagaacaacggtgttttaaaaatacgaattgagtctggccaggcgtggtggctcacgcctgtaatcccagcactttgggaggccgaggcaggtgggtcacctgaggtcaggagattgagaccagcctgaccaacatggagaaaccacgtctctactaaaaatacaaaaattagctgggcgtggtggcgtgtgcctgtaatcccagctactcgggaggctgaggcaggagaatcgcttgaacctgcaagtcagaggtggcatgagccgagaccgtgccactgcactccagcctggtgacagagcgagactccgtctcaaaaacaaaaaacaaaaaacaaaaattgtctctatcactaaacagctcggccctgttgagaaaaaaaaagtcatcatgccttggtgagcccattggctctcctgtaaaacaggaatggtatctgcctggaaacctgcaggttgttttgacagcacatgtgcaacagaggcagaggtgcttcagggtttctcgggtgctgggcctcggtgctgcaaacgtcactggagatcctcagggtggacccatgactgtttctactcttctattctagccgtctctcaattgagagacagtttgcacatttgttttaattaatcccaaatcttaaatgccttctaagatcctcccacagtctgattgtgtggaaaagaaaatacaaaaaggaattgcattttctgtctttaggggtggctgactttagaggaatcagggaattgacactctcttccctgcctgtctcacatttctgtgcttctggctcccattaatgagggaggagagctcagccgtggagagtcaagtaagagattttccagcggggatacgcttgggtctggcagcccagggcctggaggtctgtaccatgggggtctaggaggcctgacattgcccagatttttttcacctgctcatatcctaactggggggcccatctgcccctggaggaagaaggaatctcagggggaggctctaacaattgcagggagggccagctggctgattgacggctgctccctgcctcactttctcagtgaccttctacaagtccaagctccaggtcagcaagatggcctgcagggctcccagggtgctgcctgccctccctccctggatatcggtaccaatattcagagctcctagcatcccaggtgccagtgactaagatgccctcaggcatgcgatggcatcggggcccagctgaaggcctgggagaggttctgggagagggcacgcttgcagcgctttacctgcggctccggaattgccgtttagccctagaaccgaggagttattctccagtctctctgggtggaacgtgtctgtcttggccccgtaggccctgccaccacctccggctgcaatgatcaggggcaccggcactccatccttcatctgaccaggggagacattcagacattgagaaaccgagctgtgcttccccctggagcccctaagctctggtaaattcaacctgactgagggtttgctgttttggggtgacctggtgacctctcagtggtctgaggtggtttgcgggctctgaacccttgttacaatagcccatcggctccgccagcttctctatcagtcagggttcaaccagagaagcaagacctatataccaagagcaaaatatagataccaggaggtgggggttgatcttagaggctgcttcctctacttcctctagcccctttcctgaagctccttagactggcctcagaggtctggatgctggtgattagaagcaggtctctctatgctctctctccctcattcttaggggtctctggctctgacccccaaagattcaaggttaagccctcagcatcacagtcctgtgggaggacctagcaggtggcctctgtcttcagtttctggcctggctgtgatgatgtcagcaaagtccaccttagggcagagagctggtccaggagggcacagtgggactctctgaaagtaggatggcaaaggctgtgcatggtgaaattgggctgatgtatcagtaagagaagagttctaccctttcctggacagacagactctatatctctctggatctcagtctgctcatctttattttttaattcttttgttggttttagagacagggtcttgctctattgctcaggctgaagttcaatggcgtgatgacagctcattgtagccttgaactcctgggttcaaatgatcctcctgcctcagcctcccaagtagctaggactacaggtgcaagccaccaaaactggctaatttttaaattttttttggtagagacaacgttttggtatgttgcccaagctgatcgtgaattcctgacctcaagtgatcctcctgccttggcctcccaaaatactaggattacaggaatgagccactgtacctggccctgctcatctttacacggggataagagcatctgaggtgtttctatcccagggctgtcatgaggctctgacattgcagatgcacaggaacctggtggaaatctggcagcacacaccataccttaaatacgtaggtggctccaccccctcctcctccgcctcctgcccactcatgcacgcttctgttcacacggatttcttcttctatcacattgttctctccaatgcagactttctggattaactggtttgtctgtagaaacaaaaagcacgttaggtttgtggccaaaccagagttctccactttgcagcagacagaacttctatgcttaaaaacaggatctgactctctctcaaaaaacttacagttgagttgaggaggcagaaaaatataccaataactgtcactctgggcagtgttagggaaggaccacaaggatagcttagacagaaaatgctaggagaaactgggagagagagagcaaggttttattgctgtgaggactgcttgtaggaggcggcttttagttgagccttgaaggatagggagtttttttttgtttgtttttgtttttttcacagagagtggggcaaagttatgtcattccaagagcagagagtggcatgagcccagagggaagtgggtgagtggggtgcgtgggggaaaagcacaagggtctctttggcccagaagtctatcaggacagagagattgtccaggacctgtttcgatcctgtgggatgaagagatccaagaaagaatgggaaaggtcctatgtggtgagatggggctggagggagcgtaaattaggtgggtagagagaattaaacggaacagtgtgatcatggctagaggccttgaaggcactgcaaggagtggacttcattctctatgagagccgttctctcactgagagccatcgaggttttctgagaagtcacagttctgaagcatcaggaggagagaaaaaaaccagcaagaggccagactcaagttttattcccagttcttctctgggaagatcagttctcccttttggacatctcattcctcctagctaatgttccattttttccctccggaatccctggcacacccctctgcttgccttgtagagtgagccctgcaatcaggtagtctggattctccacccaccctgggaaactgtgacaggggccctcgatctctgatcttccagtgtggctgcgaatgaagacaacacaggtcgttgtggcatttactgagcgtagtacaagtactaccctcaggcatctagtggagcgcctcacacatggtgggaactgagtaaatggctgctgttcttatctgtttgtttttgccatcttactccgtgcaatggcacgaccttggcccactgcaacttctgcctcccaagcagctgggactacaggtgcacaccaccatgccccgctaatttttgtatttttagtagaggaggggttttgccatgttggccaggctggtcttgaacgcctgacctcaggtgatccgcctgccttggcctcccaaagtgctgggattacaggcgtgagccaccgtgcccagccagctgctgttctaatttagattcacttctgggcccacatatgctcctggttggggctcaggtattagagagtccccaggattgtgctggagatttctgtaacagaatcctggaatccctgaagaagtaggatggtgcttcaaaaacagccacgcctgcttgtcggccaccacagctcagacgaattcttcaaacatcagcctgaccttggaggaaagtgacttttctttcacttaatagaaaaaaagccagtaaaacatcacatttccatcgatgctgcttcgtaaccagctagtggatgcagccattcttcttgagccacttcttacgctaaagcgctcaggggtgccggcaatgagtactacagaaatttccagataaatagccgagatgcagtttgtttcatggaattttggatttaacgatggaaataatttgatatttcttagagtggatctagtgtgggtggaaggctctgaattgctattgtagagagctggcatttcccatatgtatgtgcagctatgtcctggcctggggggagactcctgggaggagaccctgctcactgccacctggcacaggcgtgagttgcagggaatgtgccctgagggttggccctggggatgggtctgagggatgtgagctgtcagctgggcagagcacaggattcagggtccaatctgggttctttcttttgagacagggtctcactctgtcactcaggctggagtgcagtggcatgatcatagctcactgtagccacgaactcctgggctcaagtaatcatcctgccttagtctccagagtagctgggactacaggcacaagctaccaggctcgactttttttttttttttttttttttttttttttttaagaaacagggtcttgctatgttgcccagactggtctctgactcctggctttaagtagttctcttgcctcagccgcctgagtagctgggagtacaggtacgaaataccatgcttgactaatttttgtatttttttttttttttagatacagggtcttgctgtgttgcccaggctagtcactaactaagcgattctcctgactcagccttctcaaagtgctgggattacgggcatgagccatcacaccctgctcagtctgggttcttgacagctctgttggagatttgctgggctatacttggtgaggcaccccgcctccctggacttgcctcctcatctggagatggaggggctgcccagtctgaaccagtggtgctgagaaggtccaccccgtcggcctctgctccatctcccctcttggcttgcgggcagcagtgggacctccacccctaggtgatgccctcccctcatgaacagatccagagattgctgggatggggaggagacagcagtggggcttgaggatgggctttcctgtagttagagccaatttctttaaccaatatttattgagtacctactttgtgccatccctgttacaggaacttgggatatattggtgaacaagagaaagatcttttctgacccatgctcatcccccgcacccctgcttctgatgtctcctttagatcaggtgggggtggggagcggtcaaggctcttgctggaccagtagcagcatttggaggagctgccgccctttcctcacatgacttccaggactccccatcctcttgcatcctctcctacctccctggttcctcttctttgtcccgctttgctggttcctcttcttttcctgacctctaaatgttgagggtcccttaagctcggtcttcacattcttctctatccgtattgcatcctaggcaatctcatcctgtctcaaatttatgctaatttctccaatatttatatccccagcctggacctctctcctgaactctagcggcctgtctcccatcgtccacctgtctgcctgtggctgtctaccaggcctctacaactcagcatgtctgatattgaactcctgatcttgcccccagatttgctccttccacagtgttccctaactcaggtgatggcagctcccttcttccagtggctcaggcacaatttttggagtcatccttgactcttttctttctcttaatttctcattcaatctggcagaaaatccttttggatttgactttcaaattacacccagaattcaaccacttttcatcccctccactgttacaatcctagtctaagccatcatcatctcttgccaggattaatgccatagcccttgaattcattgtcttgacccttcccttgtgtccatagattcttctatggtagattcttcacattgcagccagagtgagctttttaacacacataccacattatgtcaccatttgcctcaaaaccctcctatggctccaacatgccttaaagtggcctgatccagccctattacctctgccttatctcttacctacccttcctttggctccctctcctccagcccgagtgttccttgagcatcgatgaacctctgggacatggcctttgctggggtcactgtttccccagatatttccccctccctctcctcagatgtaagttccttgagagcaaagatctttcttttgttcaccaatatatcccaagttcctgtaacagggatggcattaagtaggtactcaataaatattggttaaataaatttgaatgaattgagtgctgtctggattgtgggctggctcttcacaatatttgccttgcaggggatggtaatggtggaatttaacatttagaacagacttggcttcctaggggacatttggaagtgtctggaggcttttgtgattgtcatttctgggggctgttactggcaccaagtgagtaaaggataaggatgctgctaaacatcctgtaatacacaggacagatccccgcccctagccacaaagaattacctgctccaaaatgccaataatgccactgttgagaaagcctgatttagactcatgccaccaggcgaggtttgggaggcactggagaagcaaagacggagggctgtgtatgtgcacatgtgctgtgtttgggggtggggtggaggattctagcagctggagcccatttccagcacaggagctccagtgtggccgggtacatagaagggcaactccccgctgcccccatagatgtgcagttgaaccagcaaagctgccacatccggcagtttaattattttttatttattaatctttttgcgacagagttttgctctgttgcccaggctggagtgcagtggtgcgatcttggctcactgcaacctctgcctcctgggttcaagtgattctcgtgcctcagcctcctgagtagctgggactacaggtgtgcaccaccgcacctggctaatttttgtatttttagtatatacatggtttcgctgtgttggccaggctggtctcgaacttctgacctcaagtgatcctcccgctttggccttccaacttgctgggattacaggcatgaaccaccgcacccggcccctgcagtttaattcttagagtccacttcattatcttgagaattgtgtctagacaccattttttctgcctagtgagaactggagatggaggtagtgcctgacaaccgccatttttccccctttccaagtgcctcctcagaggtggagatgtgaagccacagcgaagaccagtcactctccccacatgcccctgctatgccttgcccaaccagcagagtgagctgccctctgttcctggcccagaatcgcctcctcctgcctgcttgggaacttcctgtgcatccacaaagtttgagagctagtagattgattaataaaaatgataaagtgcagcaaccccgaggaacaactagatttcaattgaatttttaaaaaagacgcggtcccgtgaaaagacataactgattacagtccaatcaagtgaaagtcccttgcagaagataatgcaatctttctgcttagatgaaggaattacattagcactcaataaattcccgtgaaaattatagcagcctgtaatttaatggcttaatatattatattaggttggaaagtcccaattatagttgctaaataaaagttggagttgagacattttttatgcaaaaggttgcacttgctaagcttactcctgtcgtttcaccttaaccccgaaggagcagaagggaaaaactgaactttacttttcatgcttcctcagctcctagcccagggcctggctcttaggagccctgaatttattttgtggaagtaaactgctttctcggtagcccctcttcccatatctctctgccaaggatgttctcaaataagtttctggagaaggagctgggggtcctgggtgctagaacatagctgtctgctttggccccttttcccaagcaaaagctgtgcttcaggtgagggagggggggagcctggcccaaccaggagattcacctggcagggtgctgagttcctgctaggatggccagctctgccaggtcctgcctccccctagcacaggcaagaggtgaaccactggggtgctgggagtttgcaaagctgctgtttaattactctttgctgtctcattctcctggtatgaacttccaggaggagggtgttgagtgttggtgcctccaagaggccttcccggggcctgacagagtgcagacgagaaacccctgctctgggcacttacactggggcaggcgtcctctccctgctgcccaaccaggatgtacagcatgtcatccttctccaggttgaagatgcccagcacagacacgccgtgggaccgcatcatggtgttcttcccgcctttcccgccagcagctccgtagcccgagatgctgcaatgggacaaagaacgttggctcccgctgtggtatgaagactgtcccccttcctgccaacccagcagcttccagtgggctaagcacatcgccatcgtggtctgagggttctcccccatatcagtccctgcagaaagggattcttctcccccacttcaggaaaggacgatcaagtttagagagggacagggagttgcctcagtcacagaactaagaaggtgaaagactagtaaagggtgcaagagagaaagagaggaaaagggcagggaggagggagggaagaagggagagaaggaggggagagagagagggaaacagcagagagagagagagagagagagagagagaggagactatatgaatgtggcatattggggtgatggctttctgaatacctaggatttcctcattatggttttctctccttgtcccagatcaatggactcatgtgaccttagacaagtaacttccctattcctcatctatactatggggataataagtgaacttgcctcctagcctacatgtgctatgaggattaaagaaattaagacatgtggtcttagaattgtggctgacatgtaataagcactcaattagtattagttaattattattattattaatgacggtagtagccataattgacttggtacaaagttgtaaagtctccccatggggtctggaaacaaggaggttcctcacagaatgactgaggagagcagtgtatatgagccgactgtctattcccatctcactggtaactcctcctggagaaatatgtgtgcaaacaaacaacccatcatgatgaaaataaaaacagagtgtggggatgggagatgatttctgctgcctcttaggttgctgcaatgaagtcaagcaaggatggggagaaaagaactctcttctgaaccatatcagaagagcggcatgtcttgaagacagctaacgcaccagctaacaaatgtgtccccagggaccagctgccagggtatgggactcggcagactttcacatccatgtgtattcagatccaaggtcttttacaaaaaaccaggaagagatgcaaggcagttttgcccatgtgcacatagtagctcctttatctacagttccaggaaatgtcccttcttccaagtgtgtgaggggcctcccggagctctcacaaggcagagcccacggcccttctgcagaggctgtttgcgaacatggcaggcaaggaactgaggtcttcatggaatgcaaatggagaatctagtgcccattgccctggtgagtgcctgggcattgatgggagtttattgaatgttgggagcggtgtaaggcgttgtgaacctgagatagctccaggctcttcaagagctcacaaagaaactgaggagacgatcttcatgatgaaaagagaagtctcaccatagggtggctatgttgaggaggcaaagtggagtgctcccgggctccctgatcaggtggggccatttcctgcccctgtgccctctctgagccccagcccctttcctagtaagagaagaatcattttcattccaaacaacatgatagtccaacaaaaggagctcatgggtgaaagccccggggaagctgcaaatctctggccaaaataagggtcgtcaggtgcttagggccaggagggagatgggggattgcgacaggtggttgtggggtgtggtgatggggtgaggaaggctgatgttggcttcacatggagcttgcagatgggtagggctctgagacaagcagaaagaggtggtgggaattggggcttgtgtgaacggaagtgaagaagcagggagcctcaagtatgtctggctgcagcaggtggatggagggggaagctgagggctgtaggtttggagagggctgtgggctgattaccagcatcctccaatgtgccaggcacaatgcatgctcacaggcacacggcatcacccaatagccataaacggcaaatgttattaatctcatttgacaaatgaggaaactgaggctcagagggactaagtaactcatctgaggccacacagccagtcagtggctggctatggtccaaacccttgcacatcccctcttagaggtcatttcctccccaatgtgctgctgggatgcacaaagagaggggtctgagaagctatttgcccctcctaattcccagactctcagccaaacactccctcctgatccatgagaaatggacaaggtgataacaataattaaaaggctgagaaaaaggaaggcttattggtgaaaggtaagaggaagcagcattatttagctcagtgaacctgggcaggggacgatgtggcggcttcctgtagtctagggacagcagtgtggatgggccccaactctgtcctgctcactgccccaggtttctgagtcctggtcaggctgcataaaaaagtcatctccacctgaagatgtggtttgcttggaaaacttcagcccaggacaaagtcctcatcctacccactcctgctgtggttgagaggtaagcgtcatgctgcccattccttttggcatcatttgcatagtcatttgcatcaaccatgcattatgaatcattctgaactctttcgtatgtttaaatttagccaaattattatattttagacgttgtttgttcctgactccttttacccttcctaagccttctttgctatttttctcaccccgctcccctcaaccacatctgagagccagccccatctatgtcttgacctagttcttgatggtggggtgggatggaaaaagcccagggctccaagtcatctgctggttcttgtccccgttcttctggctgtgtgacctgaggcaacatggtcaatttctcagagcctcaacgtccactactgaggaagaaaatgaagacaagaacccctgctctcatgggcatacaaagcgaatttgagaagactgcaaacccatgcaaagcacaaggcgagacccggggctggggtcagctctctagattccaaagtagacagcagagcttggcaagcaggtttctgtggctgggttgtactttcctgggtggtggcctcagccccacatttccaacccagacaaggggctggcttaaagtcagggggagcaggcagctgcctacctgaaataattgcaggagtcctagaaggagtagctccctcatcagtcccctgaagcctgaaattccaccattagagcttcactcctctggaagcttctagttgctactacaggactgattgccttaggagtgggatgtgccacaggtagaaaagcaagggcttgaatgcagacagacctggatccagatcccagctctgccactcagggccaggagtaggttgagcccggcgaggtgcctccctcccagggaggaccttgcactcgactgaccccaagaagaagcacctccttaaattttctgcccaaggtgctttgcttacctctccccagtcctggccctgccagtgttactcactagctgtgagaccttgggtgattatttacccccgctctgagcccagattcctcatgtataaaaaggggataataatacctaccttggaaggctgttatgataattaaatgagatgatgcttataagggacctacttcagagcccagagggtagccagtgagtgacaaatggcagctgctgtcatcatgtgcccccatgggtgagcctgtccactccttttccgggggtgacttctgggaggcagaaggggaccaagtgggcgaaccagggcatggccaagggggcttggggtcaaggctgttcagtttcacccagggcccacctctgtgtaaagcacagggcagccttagctcttctgaagacccctgcaccctgtgaatcacgttacacaaactcatgctatgataatagcctcagcctgtctctctgaagctttcttcccatcccttgtaaacaatttatttctgatggttgagaaacaacaagaaattaatatacctgccactcaagtggggaaaatgacttgcagtgattccaatttactggaaattacaagatactgctctcaatgagctgatgctgtaattttttgttttttcctcatctaaatccatgtcccctggtcagaagagatgtttattgggtttgtgttttgtattagaaactgttacctgatgtaattgagttgtgaatcttttttaaataaagaattagcagcaaatcaaagaggctgcctgccggatcctgaaatgagagcacagctggtgtgtagcacatccacagtgtccacacacacggggggatcttgcgggagagagtggactgccgctcagaaaaacagaagcaccccattcctttccggcacaccctctggaggagcggcagagtggcatcctgctctgggctctgcctttaactccccgtgggatcctgggcaaggcccttttctcccgtttctcagtttcctcatttgtgaaatcaggatggtgaggtctgtcctacccaccctgcagggttattgtgatgacacatgacgcgtgtgagtgtggacggagcttggtcagcgggagatttctgatcaggtatatagttgtattatccagataggagtcagggttgaagggcccaattgtggaggcaggtgcttctcagtggggccggcccaggttccactcctgttgcatcagtgagcaaggttcatggtctgtttctcccttagcaccttcctggccagtgtagccctaagtgccttgaaacacctgagcttgcagggacctcagtgacctcgctctatagcccctcgctctgcagatggagcctgtggagaggagggaagacaactttctaagtcacatggagcatcggtggtggaggttgaactcaaacttaattctgcctgcagcccatccatcttttcctaattcctccatctctgacattccctggtctgtgccctttatagcgatggctatccatacaattactttggcaattaatcatgcctgtgatatctctcctactattgtctagaacctgactggcattgtggactgttattaaacttttctgtcctgtggtctttccagagactgtgaggctccagagtctcaggcctttctaccagtctagtcagtgcctggaacacagtagggctccatggctcagtgcctggcacacagtaggagtgttatggctcagtgcctgacacgtggtaggactccatgggacagtgcccttcacacagttggggctgtatggctcactgccctgcacacagtaggggctccatggctcagtgccctgcacacagttggagcggtatggctcagtgccctgcacacagcaaggtttcatggctcagtgccctgcacacagtaggggctttatggctcagtgtcctgcacatagtaggggctccatggctcagtgccctgcacacagtaggggctttatggctcaatgccctgcacacagcagggctccatggctcagtgccctgcacacagtaggggctccatggctcagtgccctgcacacagtaggggctccatggctcagtgccctgcacacagtaggggctccatggctcagtgccctgcacgtagtaggggctccatggctcagtgccctgcacgtagtaggggctccatggctcagtgccctgcacacagtaggggctttatgactcagtgccctgcacatagtaggggctccatgtctcagtgccctgcacaaagtagggctttatggctcaatgccctgcacacagcagggctccatggctcagtgccctgcacacagtaggggctttatggctcagtgccctgcacatagtaggggctccatggctcagtgccctgcacacagtaggggctttatggctcaatgccctgcacacagcagggctccatggctcagtgccctgcacactaagggctttatggctcagtgccctgcacacagtaggggctccatagctcagtgccctgcacatagtaggggctctatggctcagtgccttgcacacagttggggctccatggctcagtgccctgcacacagtagggcttcatggctatttgtggagttgaatgatggcgttgtccggctgcacacgctggtgccccaggtgaggaaatgagtgtcattgacagagaccatcaggaacagctgtggcccaaggtcagttggctccagctgggacctggggcctcttgtccattatgtctgaagagcaggtgagctgtgggacgactgccttcgggagctatgggccatgcttgacaaatggtgttatatacgatctgtgtgtgtatggtagtgggtggggaggagatgggggcaggactgcgggctgagaaggatgctggtcctagacaggtaggaaggcaggcaggctggagggggagagagggaagaaggaggaaagaagtcagggagagagagggggcgggctgggctgagtgctggcgcctctgcctgtggcaggccacccgtgggctctcactgagtcccccaacagccctctcagagctgggctgtgccatcatctgtctccattttatgacaacacgaggatgctgtccccctccccagcacaaaccccataatccacgttcttctcatggcactgcagtggcctcccactctcccatccgctccagccacccaccctctagacaccatggttactcagcaccacggcccagaggcctcctgatcagggcccctctcgctgctgccctggccttgcctgttctcagccaagctcgtgggagagtggctgcgctcctttgtcctcgcttcctcagtccatgccagagcgtggatgtagtcccagcgttgcacccgaccccacattcactcagtcctcaacttacgctgatcccacctcctgagcacctctgggcctgtcccctgcacctgaccctcccctgccatctttcccctgtcctggctcagtccttttgaccatggcctgagtgacagtgactcccttccaactgctctccccacctccaggccgtttctctcacttccaccctcatgctttcaccagggggagcgagaggccttttggggggtaacactgcagccccaggacctggccctgctgcctccagcctcggctccccgaggccagccttgcccgacttctcatcggcagtaccgacttcttgtgctcaccgcaggctctggccacccgcttttttgtagacaatgcttagggccttcgaacttaacccaggtgcccctctcctggcagaagccattcacaagctcagctgagtgcagcgcctttcccccggcctccgcggcagcgccttttaccccggcctccgcggcagcgcctttcccccggcctccgcggcagcgccttgtggaaacctccactgtagttctccctacaccccacggagatgcctgtgcacacaccaccaccaccactggcagcagggcctctggggcagggctggatcttcatcacctttgcacacttggtgtcaggcacagcatcctaattggtgcttactatgggtcactgagatctgcagagcagggggagaatgaagcccaggaacctggacacacagactgcatcagctctcagaggaaggggtaagtccagggcagggaaggcaggacatggtgggtggaggagatgggggttccagggttgcacccaagcccccatgccagcctgctgtcttctcctgcctgccccgcacccccttcctctccctctttctgggcctcttcctttgtggaggtgggcaaagctgtagagggtgggaggtgggcccaggataagttaccagctaagagtgggggtgtttccaactgtgtacatcctggaggaggccccaggcaatggtggcccccccttggcatgaagttggggcttggtagcattcgctcccttcccttcacctccccagcagtgggcagagaagtcagtggagccgtcccagtgccaggcctcggtggcagccatgcctccaggatgggtgggttcgttagggctcggctcccacctttctgtttccaagcacctttttctcacgtcctctggtgcatcttgtgtttttttcaacagatgaactgcacttattaaatagtaataattactatggagaaaaagtctttcagagaaaggttgctgacttctcagtcatattctgacttggggacattttgaagtggtctaaaaatcaaatcattaactgtctgcttcttagattactaagttatgtgaccaatagactcaggtcatctaagacctgagtctcttccaaggccaaggaggaggtgagggtcaggaatatctgttagagcctttatttggttaaaatataagtattcaaaaacaacagtgactggccgggtgtggtggctcacatctataatcccagcactttgggaggtcaaggcaggaggatcacttgaggccaggagttagagaccagcctggccaacatggtgaaaccccgtctctactaaaaatacaaaaattagctcatgcctgtaattgcagctactcgagaggctgaggcaggggaattgcttgaacctgggaggcggaagttgcagtgagctgaggtggcaccactgcaccccagcctgggcaacagagcgcgactctgtctcaaaaacagcagtgacaaaaaccccaactgagcggcttttggttttggttcttccattttgatatggtcctatcttaggccagaccaaaatgcctcctttactaatttggacacttcgaaatgtcctgcttcaacagaggcaaaatcgccagacagtgctggggcccggagctggcctcagtctcaatatttcaaagagatgagtggagacagctttctgattttggctgggattctatgaatgcactgtggaaataatgtggcacttcatgcagatcagaaacctgactcgacttagatatggctgtgattaataataaatgggaaaatgaattaattattatttaataagtgtagttcatctggcagtccaaatttttcagaatacagggctcatctgaggaagtcagagaaaagtctttggagacaggaaaagtcagaaactaccgcgtatggggtcggcgtgttcttggaaacactgcctgcctgctgcctgctgctgcatagcagcattgcttcagctgatttctccacccatgggccagggagcacccaccacgtgtaagcattgtgccaggcactatatgtcacctttacagcccctgccacttacagatgggaaaacagagtctcaagagattagctgacctgtgcaagtttggaagtgagcttgattcacactgtctcgggggaacacagcccaagagaatccccattcaagggatctcctgagagtttgtccccctctgtgggacagggagcaggggaattctggccaagctggcattggagttgccctgggcaggggtaggacaatgggctccgctgggggcttactgttgggtttcctgtgcgcctcccagcgcctctgctttcttcttcatattgctttttgtatacggggtgtgttgcccaatatcccttcaggaggctgggcccctctcatagcctctcatttccagaggcttccaggaggtgggtggtgggtgattcctatgccctccttcctttcctgtcccttctgccctctgcatgcctcccagagtccaggcatgggctttagtagaaacaacacagactttgagccagagcaccctgggtttgaatcccagctccatcactgattgtgcagccttacatgtgttgctaagctcctccgactccagagttctcccttggaaacatgggaacaccaataataatgctacccaccctatgctcatacaggagcaacacctgtgggtccttagcaagcattcctctcctcctctccaggagtcctttcctccccgccctgggccccacggaggcttggctcagcaggaaggggaggtctggcttgcttggtgtagcagggccaggggtggtccggtgtcttccgggatatttactgggggtgtgtgggcactgtagcagctaatctgattgtagccaaatctcgttatagcatttctgcccggagtgccatttaaaaagcacttagggctgtccccgtaacacatttaccctgaggccccagggatggggctgccacaagaaatgttaacctggagagagaaaacagggcaacttgagaagtccctctccttcccaggaggcccaggatgttgtggatcccggaggctgcggggagaggaggcgagctcatttcctattgtttcagccctgggggacactgttcccacaaggcatagtggttttgctttccttttaacctgccctgccatgctccatggtggagccacgggaggccctgccccagaactctggaggtggaggctgcttctggatgtgtaactgtggggaggctcctgactctctgagcctcagtgtcctcatttgtaaaacgaggatggcagcactggccttgcctagtcatagagctcgtttgggggccacccaggtttatttaagtccaagacttgatcgagctcagaggttctaaaaggctgcattgacaccacccgagaacttgttagaaatgtcagttctcagcccccactccagacctgcagaaccagatgctgcaggagggggtcttgcaatcagggtctccaccagccctccagtcttaccattagcttcattcaatgccatggcctcaaagtggccaagtggagctggatctcgttccagcctggctctgctctaagggaatactgggggctggggtagggttggggctgggaggagcgttccagaacagtttgctctcttaccaacagtgaaggcccaggaaaggaggcgcaaggataagagcatcagctttcaggtgcattgtgcttctgtttcccaaacattttacatgcatgcctcatttgaagagcattaagcaatattcaatgaacaggccaccataattatccttattagcaataattctgaagctagctcatgcatgcatatcacctccacgaacagcctgtgagtttcttgaggacaaaggacacatcttcttttgttgccatatttcactctcccaaatctccccatctccaacctttataccccctatgggcctgagtctgttgcctttgaaccttgacatgcctgggcaccccaggaacatgcacccataggcaagactccaggcttcttcggaaggggtggtctgcccctcccctccccctcttccatacgcacctgtaggtgtcggtggctggcaccttccagatctggatgcctttcagggggccctcgctccccacctccacgctcaggttggagttctggtaggcgttgttgcactgtgcctgggtggggccatggggcccgctggccccacatgtggtgaacagccaatgaactgtggcacaagaggagaggcagtcactcatgtggccaggccctccctcctccaggggcctccctgggtggcctctgagatatctgctccatggccccaaaccctccatccaagatggcaccaaggtcagggcaagaaacaccaatcagccatcgaactggaaacttccacagaaagcctactatgtgccagaccctgagtcagagacaaagatggggcagacttaagatggaccctggccttaagcagcttacaggctactatgagagacccaaagggaggccaggacagcaagaatagcaagccacaggagggcccagccaacactgcgctaggggagttccaggaaggggagaaggcccctgcaggtgggacaggcgtaggcagtagctgggtcctctcccagtctctcaccgagcctagcacggtgctgggcaaacaacaggtgctcaatctgtgctatagttgactgcaactaacctgctcccaaaggctcagcattgcctataggagcctcttagcttggagacaattgaaaaagagaattgaaagctcggtgatgctacattggctcagggacccaggctggtggtgggagcaggaagccctgcactccctggccatggcttggcctgcctgtcagacgctccctaacagacctgcagcaaggcagggctcaggctccttattaaaaccagcttgcatttggaaatgcaacgaagacagctttcaggctctccaagcaacagagtataaaaaatggaaaaacaggtcaactttgtctttggtgcatgctcctccttttcccagctccccctcacccattcctggtgttctgtgtcccacccaacgtccctaggtggctttctgggggcaacacaggaacactcagcacaaactgcacccccccaccccccgcgggccatttcctttcaaactttctatctttgagccagaccaaaccttggggagttgtcagatctcatgttggccaaaattctaacatttttacaacctataaaaacttttaaaaaggtgttgttgataaactacttttacttaaaatacaaaaatctcataagattgcagaaattcccttaaaagagagattaagttctagtctaaggaaaatgatggaaacattaatttgggcatgcataattttgctaagacattaaagtgaaaacattttgaagactgcactaatttaattacgtaaatgtgaaaggttaacttgggttgccgattataagcaatagattgagactgccatgggcagggttgctaatctgaaaactgggccagttgtcgtgggtttttgtcatgctgccctggcccagaggctgggaggtggaagttctgggtggggttctaatgcatatgctactcagcacggagtcctcaacacttttctgggcttcatttatttatttatttatttattttttgcaaaggaagatgtttatttctatttggtttcaggatggtcatttcaggggctagaaggtaatggagccattcactttgggtgtgaatggctgattgttagtttcctgattttttatttatttttttttagacacagggtctcactcttgctcaggctgagggtagtggtacaatcatggcttcctgcagcctcgaatttctgggctgaaacaatcttcctgccttagcctcctgagtagctgggactacagacctaccccaccaagcccagctaatttttaaaactttttgttgagatgggggtctcactctctcacccaggctggagtgcagagacacaatcatagctcactgcagtcttgaagtcctgagctcaagcgatcctcctgcctcagcctcccaaaatactgggattatgggcatgaattaccatgcccatcctctatttttattataaagagggcaaacctgctaattcagactctttatagaatgcatttttggcagagctagtttgaccagctgcccttttactcactcctgtgcccaaaatatatgtgtgggctgtgctacgtcaccacacgaggggtgatgtggaaagaacacaggctttgaaatcagcatgaacaccagggtttgggggcagcttcatcatttattgattaggggatcttgatctagttcctttgtctgtaaaagaggctggattgacatattaaaagaagcaaaggggtaggaaatttcgctgctaagtcccaaactctaaacatgtgagtgtgtccttgactcctgcctgtacccaaggctggtgctgtcctggacagcaggacatgtggccaggggagttgctgtgaatatggatcccgtgccaacagcacctgggaatttaaagtcagtgggttggggaggagggatgggggcagggagaaaaataaaaccccagaaaagaagttgtgaaatccactcctctccttatctatagttccttgaaacctgttctgcagacccaggctttccttacagcaagcagcctgggtgtgggggtggccttatcaatcacagggcagaagcgtggcagtttatttagttaattcaaccctgaaaatgaaagaatacatatatctatattagatagatagatagatagatagatagatagatagatagatagatagataggtagatagctgtggtttggctgtgtccccaccgaaatctcatcttgaattgtagttcccataattcccatgtgtcatgggagggaccagatggagataattgaatcatggggtaagttttccccatcctgttctcatgatagtgagttagttctcacaagatccgatggctttgtaaggggcttcccccttcactgggcactcattcttctccttcctgccatcatgtgaagaacatgtttgcttccccttctgccataagtgtaagtttcctgaggcctctccagccatgctgaactgtgagtcagttaaacctctttcctttataaattagccagtctcaggcatgtctttattagcagcatgagaatggactaatacatatatgaatacatattctctctctctctctatatatatatatgaatacatatatgtgtgtgtgtgtattcttctcaatagagtgctagggaagacatctaaaggtatgggcttggcacactacctgagcatctcaccttcagtgggaaccacttcagcctaggttagtttattctgagggttctgaaatattcccagagatgctgggcttctacttctggcaaggtgagacatctggtgagggaggaagaagggcttaggctttggattcagataggctgtgttctcattctggatgtctctgctggccagctgtgagacataaggtagattgtacaacctctctaagcctcagtttttaaaatgtgaacaattggagactgtaagacataccacctagactttctgtgagaattagacgatgacctaggcaaagtgcttagtacaacattcagcattagagatgcacaatgactacagtttaaaacgtgtgtaactttgcattcaagttttcactgtgggaagcagatatccaatctcaaaatttatgtcctccatttcataaaggagggactccagggtcatttctcaataaaagggacctgtactttcccaattcagtggacatacattagtctccagtggtttccatacacaaaattttgttttgattttcagtgatttcagacggatgggcctagagagggaacgctttctaaagtggattctgtgggaagagaggatttgccatcctgtgtcagacccatgatttatcttgccagaattctgttgctcccagcagccttcaaggcatggtggtcctcgctgccttggatggctctgaccctcataaatctgcccagagttgcttggaatcaatttatgattcccaccagcactgcctctgggggtgtggagtttctgagtgtattgctcattgtgcgagggctgtcctgcttctcatgtgtgggctgctccagcttcatctgctggttccctttgttcatactgtctgcaatcctgtagtcatcagagaatgtcacagcacagtgggaccttggcaatctctgaattcagtgttttccaaaccacctgaggacctttcacatacagattctagggacctggagattcaaatttagtagatcctgggtggggatgagaaggcaatacttgaaacatttaaaaagcattctcaagagaatctaatactcgatgagacttgtacattagtcttctgcacctcattgtccaggtggagaaacagcattttagggagaagtgacttttctgagcctatcagtattggagaaggaaccaaaattgagggttcctccttctcggtccaagggtcctttgggggtgattaaaccgttcccagatttctgccttgaagacttccaagccttgtcagattgtccctacataagtcccggacccaccttgtctttttcagaaccttacttaataccagagtctgattttcatgattgacccaccagagctgtgggtacctgtgactttgcataaggggactcttgttattctgttttatctatagtgtctctctgaagctgctccatacactattgacctctcttagctgtgcactggactgaggcttgctggggacagactctaattatttccacatccttgcccaaggggtaggctcttgcttcaagcaggaagaatctggcaggtacttcaggtagggtagacatgagatcagctctacgctaagacaggttgagtcagaaccatgagaagacaggcagatgctaggttgattttcaaaagtgttgctgaagtggaaggcaatgggcaccactttgtggatcaaagtgagcaggtctaaaaccagagaggcaagagagttagcaagagtggttccaggggacaggaggagtcaaggtgagccttgatccccaggtagaagctgtgtgcttcctgacttgttttgtccttcttcctgggtaaggagttggggtgggaggctgcacctcaggcacctgagaggtaatctccactcacaaaaggggtgaaaacctctcagtgtttactgtgcacctaatataggccagtcactgcgctttcacacatgcaggaaatgccgttatgcttgctgcaactttgtagtgctgcgagtggagttacagtgttccctccaaaaatcaggacattcaagttcagaggagttgagtggctggtctgcagcatacgaagtagataactggtctagccaggaactaaatgtagatcttctgagtccaagttcaaggcttgaaaaggggctcagctccccaggaaatctctagggaacacttttgagtgttttttttttttcttttgaaatccctgagcctggggctcagttctagccaggacagaccatatgaaggttgctcaggcccaaagagtaggcaggccactatgaggggacaggtgagagtatggtcactatactgaggtgagtggaccctccatcccagaaagtcctgcagtggcccccgcagtcgcttagcctagtggagcatgggctgtgcaggatcaaaggtgtcagccaatgagagaaggtgctcaggttgaggctctggtccccagagaggacatgggagcaaggcagtgtcataagggaaacctagtaactggagtgtttataaggtcaggaagcagagagagactgtgtcataagcaacaggacaaaaatcccagtttttggagagaagatcaaggtcacagtgagactagcagtgaggctggcttgatgctgagcagacaatctaaaggtccccatatctcccctgctgagggtctgccttggtctctgaagccctatggagctgtaggatgatcaaatggtccccagggaggatctgggatggggggcagaggagggacgtcacctgcctctttcctcttctctcaaacaaacaaacctattctattaatactcatttatgaaagaaaaaaaaaaagaactgccttatctcattcttacacataccccatactgaaaacatagtttaatactcattcatatctaaactgtataaagaacccacaaatatcaaaatactgattggttatagacagttgagtacagaaaagtctattaagcactgggtttcattttaagcacattgtagcaccctccaagaagaaacaaatcaattagtaataaacagtacatcgctaaaaaaaaaataggctagacaatgattgtcctggttttattactgttgctaaacaatctcatctgctgaattcaatgcaaagaaataaagcataatacaaaggaaagttctcgatcgtcactattaatcacaacagtaaggatctgcctcagtttggaggcctgtgtgtattgtaccacggaagagcgctcaatgcttcatgtggatcatttgtacaatttttattcagatccatagcattgaatttcatccacatccactgactgaactaaatgccatggatgctgtggcatacagagccattttgatgggcaccctaggtcccagtaaataaaaatcatgaccaaaatccaggcaaatataataattcatccatttctttttgagacatagtcttgctctatcaccgaggctggagtacagtagcatgatcttggctcactgcaacctccatctcctgggctcaagcgatcctaccacctcagactccagagtagctgggaccacaggcacatgccaccatgctcagctaaattttaaattttctgtagagatgaggtctcactatattacccaggctggtcttgaactcatgggctcaagtgatccatggcctcccaaagtggtgtcattacaggcaaaagccatcacgcctggcctccatattttctcgttttgaagaaactgggctatttgactgcagcatttcccagattctgaattttgctgactccttctccatggggcagttcaacatgttctctgtcctgcaaattgccaactagatccttttgcaagactacaggtcatgttctttcatcaggagatactttgtgtctgattattgctctcttttatcatgttagcacttatcaaacaaagctcaatgcttagaaccatttatttattgcaagttgcaaaataatgttattctacttatttacctctttcctcatacattagttggaatatatttataaaaagatgttcccccaatctactatttgggttactgagtaatatggttcatgtagaaaatgcagaataaatgctgaattatttctccttatgtatacatttcaagatactgaattggttctctatcatcctctgaagctggccaattaactgtttgtacattattatgaatccatgaatttaaacatatttttcagttttaattattcacaattactattctctgaaagctcaaatgatcacgtctttggtcagtggtagcctcccaggtccttttgacatgacgctagtagacttttaaagcttctttgctatatgatatgacaaaatacttcttctccagacctggaatcaaccgtttcctcaaaagccctgatttctcttagtaggaaaaggtattttaagtacatattctgggtgctatggaagctttttgctactgggttggtgattgtctatttttttgagtgaacagagctaggaaatatatatgtgcatgcatatatgtatatcagtataaacatacatctatatgaaatacacatacatatgtatatcacaaggtacatcatgagttcatattgatatttccaactcaaattcaggacgacaggactttttatttaacctcgtgtatatcatatctgcatttcttttttcacactgagaaccatgtctctcagaaacacatgtgatagttgaattagaatatattgtaattattcatttactttacctctccttacacacagtattagagtcacaatctttactactaccaccataattaatataaaaattgagagcattcaacttttttttgtatatgttctttccattctcctgtgattttgtgtactgtactacacatagctgccccgggcagatagccattacatatgcttctctttcctctttatcccttacttcgtcatagttctgtaagtatttatatttattgctcacaccagtcattatgttgctatttctgtagtcattttcgttgtccgaagcttgttttaaagtaaattccttagagaggggtcactggagaaatattccttgaattatttgagtgttgataatatatttttccctagagtatcttaaagatgctactcattttcttgttatataaagtgttgctgtcaaaaactgataattttaaatttccttctctaataagtcacttgctattttgcttaggtgtccaaagtaatttttttctttctatttaaagtccagcaattttactagaatacacattggtaccgctcattctgggttaatattcttaggtatacagtgtgctcttttaacaagtagcttcaataaggatattttcctggagttatacttttaagtattttgttttgttctagttattcggttttcttcgtcaggtctttcaattatttctatgttggatcttcatgtatattctagtaaagttgccggactttaaaataaaaagaaaaaaatactttgggcacctaagcaaaatagcaaatgacttattagagaaggaaatttagaattatcagagtttttgacagcaacactttatataacaagaaaatagagtctttgatgtgtgtcatctttttcattttaaaaaatttcctctttttaacttctatttcttataaggcataaactgttgtgtttgttggctttttgttccttcccttaatagattagccttcatttttgaaaatagtttttcttttattgcaaattctttgctgagttctagcaccacatttctgtttttcttacaatgacttacgttatttttcatgtcttgtattattgtttttgtgtcttttagctcattttaaaacagaaggttagattctgactcatccaataagcacgtctttctggcatgattttgctttctgtaggcgtgttattccgccctctgtatcctgtttttgttttcttattttaattttgaatgatatttgatcttgatgctcttctgttatgtatttttatgtgagattagttttcctggatttttagggttcaggagcttttttatttcacagaactccctctactcctttttttaatacagtgttcaaaaatatggcagtttggccaggtgtggtgactcatgcctgtaatcccagcactttgggaggctgaggcaggtggatcacctgaggtcaggagttcaagaccagactggccaacgtggtaaaaccgtctctactgaaaatacaaatattagccaggtatggtggtgggtgcctatgtcccagctacttgggaggctgaggcaggtgaatcacctgaagccaggaggctgaggttgcagcgagctcagatcatgccactgcactccagcttgggtgacagagggagactctgcctcaaaaacaaaacaaaacaaaaaaaaaaacaacaacaaaaaaacgcagtttgctttctgaggtttctgactgtttctttccttcacttttatctggacattctcttatttattctctattatccctttcctactcaatattgattttatccccagaactttcttctccaagtgggccctttcctgcaatgacgtttgctggccaggctgctccagcgccttcagatctgactgtggtactcctggtcccctgcactgggcaaagccgctcccactttcagaagctgctctcagactggctttctgtaatttctagcaactatctcttggctacttaggggttctcctgttctcaggcctgtttctttcctgtcttatatcttgtacagatgctgataccatgcaggtcttgtggttgttggtgctttgacctatctcacttgcattttgaagttttaggggaatgccttattttcaaattttgctgtcaatattgttcatgggttttcagttttgatatatgggtgttctgtgcttatgtagggatttggaaagattaaaaaaaaaaaactatgctgttaccaccatcactgccctcttcccagaatcctagaaacattttttaaatgtagaaatcatttgagctcatttgctatggtgagcccctgtatgccatttatctggtcagagccctcacctgcatttctcttcctgggctgcaggtttgttttttcagatttcacctcagggacatctccaatgaccatggtctagaacctgccgtttcattatgctctgcctattttcgatacagctcactaagtataatttaaccttttcttgatagtgcttcccagacttaatgagttgtttagggctatttgactcttcactaaatggcctcaggcataaatattttatagtgactctgtctctgctggcaggtgtctctcggtactgcagcatgtccacccgtgtttaatcttactttacctctaagatcaggtgagggcatgagagtggccctacccctcttcatgtatcaggctaaggggcagttaactgcagaaaatctttatgtcacagttttggaacgtatttatattttggcatttatatttggtggatggtggaaggtattggaagtctaacttcagataaaaggatggtatcatgattctgaatgaacagggttgagaatgttgaggccttcaatttcaatggacaatttatggtacatttctcctccagtaagcctagctccttacaaccacgataggtcagtagatagggaagggagaagaactgtgacttttgtctcataagtcatgcaatcatgtagaaaagttaagcaattggccagtgattgcaaagtaaacctggggctaagtgaggaggggcacatcaccttccctctttctacaacacgaactgttttcagttgatgaattttccatgctgttcttccagcttgtttctcagaccgaatttatttgcgtgtatgtgcatgcacaggtacacacatgtgtgtgcttatacacatacatgcacatatgcttgcatgtgcacctgtgagcgcctgcccatgtgtgcctgtgtatacacacccaccccgttcattcaggcaaagctttctctgtggttctttgtgtatgatgagaagttaggggtggtaacaacaacaatgatcacaccagccctgtcttttactagaaatgctcacacacatgatctcatttttactgttacactgttgtttccttgctccagacacagtttctctagacaggcagagtgcctgataatgctgaagtatcccatggaacaaagaccagaggcccatctccctccctgcggaaggcagacaccccttcttggagagggacttccgagtgagcttgcccccatcaacagggcagcaagctggggctgtctagataaaagctgctttcagggctgaattgccctaagcagctctgacacccagtgatctgcaggagattttaatggctcctgtgatggctgctgtattgtgttcgcagccaccccctgctccccaagggaaagtcaggaacacaagggagaagagaaaggtcacaggaaaaacactaccctgaaagcagagctgtaaaaattaagttaagggaggcctcagggctaatttggttatttctaacttggcttcgggccagagtggggccaataaagtgtttgatatcacatgggtgctgtggactcagccatctgcaggttacgcataatggatttggttttgaggcttaagtgggaagtggttggtggtttaaataccagctctgccacactcaagcccaaagggtcatggacttctgccttgtccattcttgtctgcggataggagagatttaatctagtgcatcaccataggggttatgtgattaggacttgcggcctcctgttgtaaggttcactagcatctaagagagaggcaaacgtgtgggaagccccagcccctcactctattctaagtcattcctgctcattgtttggttctaactcatgatgactgaaatctctacaaggcccttggaattgtaacacttccgacagatgagcagacggaggtgcaggcagcccaactggcttggggatttggagctagaaaggtgtcccgacttctgggtctaggtcccagatcctctaaaataaattggaggactgagacgcatatgagaagatatgagatccaaatttcaggggcagaaaagaaagcagtggggaagcattaggaccaaatactagaccaagaagagaaggcaaagtgtgtaagactagaggactagagaaaagaagggaagggatgcttcccctcctatttttgtctgcaatgcagtcatggtggctggagttgcagcagccattttgtaaccatgaggcaacaagcatgaagaaaaggccaagaggatctcagagatgtgagtcttgacattatcaggcactggataatgacagtagtcacttctagggccactgaattaacatcagcagtcatctataaaatagtttttgttgtaggactggactaatccttgggctcccagccattggctggatcctacttcaacctcaatggagcctcctagaatcaagatctcccagctacttgcaatgaaacaccactgaacagagaatcctgctgctgtctctcaaacagcaatgccagcctggattggaaccaactttttcgtgcttcttcagagttgactgcacgtggccttctgcctgacttcttcgatgaagagccaggcaccctggtcactcccccggcccagtctggtcagccaaggcatgctcccctactccacccaccctctgctgtgtctcagtgcacttcaccgtcaaggccttcagagctttgggtgttgcaaggatgttgtggaaggccttgaagatttccctaggccacaccagcctagagtaagaagtagcatcttaatattagtagccagtagcattttcctgattctgctcccacgtccttgaaggaacctgaagtttttttccctcgatacttcattgttagggcccacattcacacacatgtgtgcttggccaccaccacccctgtccccttgacctgctttactattttcacggcatatcactttgaaatgatgctgtctatacactagtttgctttctgcactagcacatatactccataagagtagggcttgtctgttttgttcactgctttgtgtccagggcctaaaacagcactagtcacagagagggtggttaataaatctttgttatgtgaaaaacaaaaccaaagcaaaatgaaatagaaacaacagagtagcccaaatgccatctccaaacccacctgagtggtcagaaggaggtggtcatgcatgccaggggtacagtgagtgggtgctgggacacttttggccctttggggctcctgttttagtgttagaatgtttaagatggacaaaccagagtggttttgttagtgtaagtggacgtttgctgaaagccattttgttttgtctcttacgcatgattggaaggggttgggcttctgaggagctggcgcacactctcacatactcactcgaacacacacaattgcgcacaccagcccacactcatacatgcatgcatacacatatccaaaatgcagggtgccctgttttttttttgttgttgttgtttcttttttgagacagagtcttgccctgtcacccaggctggagtacagtggtgagatcttagctcactgcaacctctgcttcctgggttcaagtgattctcgtgccttggcctctcaagtagctgagattacaggcacataccaccacaccggctaatttttgtatttctgtagagacagggtttcaccatgttggccaggctggtcttgaactccggacctcaagtgatctgcccaccttggcttcccaaagtgctgggattacaggcatgagccactgtgcctggccgagccctgtgtttttaagaaaacacgtgagtcctactccttagcagcgtggccactcccctaatcccatgtctgacgaaatggattggctggtagactgaatggtctagttagtaggatcacgatcataaagccagctgaggggaaagaaatagtcctcttttccaggaaactattttgacgctcagggagtttttctgattctcagttaggttgctggacaaccacacactaagccttgttttctttctttttaacatttttcctagaatatgatcattgttagatctgccaatcacttactaaaaaataataaaaattagatgactacaatttgctcttatcttattatgaagacactgttaatattcaccataaaaacaaatcagagctgggcgtggtggctcatgcctgtaatctcagcactttgggaggcctaggcgagtggatcacctgaggtcagaagttcaagaccagcctggccaacatggtgaaaccccgtctctactaaaaatgcaaaaattagctgggtgtggtggcaggtgcctgtaatcccagctacttgggaggctgaggcagaattgcttgaacccaggaggtggaggttgcagtgagccaagatcacggcactgcactccagcctgggtgacaagagcgaaactccatctcaaaaaacaaaacaaaacaaaacaaaaaccccaaaacaaacaaacaaagcatctccaatttaatcacttcaaatttgtttaaaagaattttcgtgaacaaggttttgacgcatccattgttttcaagatcttgataagctttagaagactaaagatcctcttttaaattctacggatgagaggatttttcgggcaatcctctataccccacacaaatcatttatttcccccaaggggagtttgagggctttacctgaaaactgatgagcaattaggttgggggaatttactgaatgagaggacacaaaattcaagatattaacctcccctccagatacatatttatgtgtatacataagagtgtgcagctcatagaatttcgtgtatacacaaaagtgtgcacaactcatagaaggaggtggactgtaaatgcactgaatatttatagaaggcaacacatgaggggtgagtgaattggcccatctttttgcttacatatatatttaataataatgttaattacaatgtcacaacagcattttatatcagcatattgttttgtacctttgaaagcctgatagaaatgatctcatttgctcagtacaatagccagctctgagaaagaactgtggcaggtaattaatatccctacttgatggatgaggaaacggggcccagaatctttgactctcctgaagttgcatggccagaaccttggtctctgggattctatgccaattcacttactgtcttgctattgcctggcactcagtaggtgcttcgtgactatttaagcatctgtagaatattgaatacatagtcttgagattgatcctaggaattctgcccatcagaatccccactgggctcccagagcttcctggtgaatgttcgtctccagcatggagaagccactacaggcaggctctaagatggcctcagtggtctccagcttctgataatcacacccttgtgtaacctcctccctttgagtataggtgagatctgtgaattgcttctaaccaacagaatatggcacagatggtgagatgtcgttttcttgcttataaaattataatttctgtattactagaagactctctctctctctctctccccaccccaccccctcgtccccacactagctttaaaaaagtaagctgccatactggggagaaaccaaggttggcctccagccagttaggaagtgaggccctcagtccagtaaccctccaagaactgccaaccaccatatgagtttggcagtgaacccttccccagtagagctttcagatgagaccccagtcctggctgacaccctaactgcaaccttacgagagactatgaagtggaggacccagttgagctgtgtctgatttcctgacctgcagaaactggtataataaatgtgtgttgttatagccactgtgtttacggtcatttgttacaacacaatagataactatccaggcaccccaaatcccctgctgcacagctggtacacactttggcctcctcatcttttgtgtaagcacccagcagggagggcactggctgggctgagttctgccctgtgccctctctctcctccctgactccatgatagctaaggcaattccacctcttgtttcttttcctctcaataggagaggggcaagctgggaagaccaccttttgtgatcaagagttagcattttaacctttttactcctagattcactgtccacctccaggcccggatgaattaaaaaaaatgtttttctttgtccaaaaccactgaagctttgctgcaacaagcagagagctaaataggctctgagaagatgcagagctgttttacaggcagaagcagcaagtctgagagaagaatgataaaaaagcagtcttcccaaacaagtacttaatgcacttgccctgatggaggggcctttgtgttctgttagtcttcaagctaaatgatcttaatcaaggcatactgagcccagagttcctggatcatttattgtctctcacttatgcaagctttcactgaaacaaatgagaaaaaacaacatgttttctcaggccagccaggagagagaaaggcaatggttcctgtctgctgcttagaagggcaacagtatcgactttatgtggaagcattttgtcagcagctttgccataattccaacccccacctagcattagactggaggttcatgaggcatctttgagtctgtcagagctgggtgagtctgtgctatttcttaaggagggcctgagtttgggaagttctgaaataatagtgttgatgcctttctatctcacaggacacattttgaaaatgatgattagttcagaataatttgcaatgcaccatctagggcaaggtcaagtgagggcacctgtcctggttctagaggtgatcagaatcagaagtctctcttgtgctgggatagtagtggcttcatactgggcttatgcagacgaagctttgggtaatcatttttcaagagaacactttggctcgttcacagcctcagagccccaggcccctgcatagggtttggcacagagcaggcacccagtacatgcttgttaaattgaactatatgagttgttagtccctaggcttgggattcagggaaagcaatgatgttgtctgcattgggcgctgagttgaatctcccgagtggaaagaaaacagctgatttggatgcagcaagagcttctcccttatgctggtcagcaattgggcagtatttagtattgttcctaacaggcatgggcttagagttggaaagactttggattgagccggcttgactttgaaccctggccctgcatttgattagtgggtcaagtcacataatctttctgatcctctgtttcctcaattgtaaaatgggaagaaaatgatggctcaggtagctccgtatgtgtcaggcacctctctaagccctggatacatataaacgtatgtgatccttgcatcaaacctaagcgctgtaagcattgataatctaagcaccattttttgatgcaaggaaacaaaggcacagacagcagaagggaggtgcttagagtgagtggcatagctggggtttggacacaggtagtctgtgctcttaaaaaagatgctatattgcttcctgatagtgacatctccctcagggagtctgtgagaatcaaatgaaagagacactgaatgagcttagtgactgtcaccctgtgttcagatggaaggaggtggctgacaaatggcggaacacactctgggaagctctattgctgatgggtgcttggccttcagcccagcctccagttccaccctgtcaccgtcaccaggtccctggagaagtgctttctcaccatcaagccaaccctggtgttcactgatgtccacctcttggggatgctgactggctctccagcgtgaaagcctcttccactggaagagactcattagcgttggtaatgggatcatgaatcacaaattagttctttgccacctctcttcctggagcacagctgtgcttgctccagggaagggagacacacccaaatgaatagtgacattctaattgggagggcgccgaacgtgctgcgatgactggggtcccaagagccttgttaaggctggtacttcctgcgtcatcactagtgtgcttgctataaataggtgataatctaaaattagcgagataatctaaaataagcaagaacacagagcatgaggttaatcagcagggcagctgagcagggaaatgaccagtgtctcaagcggctccaagggttctaactacggtcccatgcctgccaccccttaatgaacagtccccccccagctgaatgggtgctaacagaagtgccttccaagtgcaccagtgaaggctggggagcatggaggaatgccaattagctgcaattatcagctttcttacatgtgcgtgggaacactgcctgcctggggcaccgtcttgaatgttagtgaagatgcagatgtgctctgttgaaacgaaaactaacataagaagccagatccctctggaagacctattcagtaatgaaagagagatccctcttgaagacctattcagtaatgaaagagagatccctctcgaagacctattcaataatgaaagagagatccctcttgaagatctattcagtaatgaaagagagatccctctcgaagacctattcaataatgggattcctaaaagatttctttatcacaactttgaccttctaaatgttatctggcttagaaattttcactttctgcatgatttttaagaaacatgatcatttgccttttacacaagttgtctaacttagtgcaagttagttcacctctctggacctcatctgttaaagggggatactatgatagcaccaagagctcagcacagtcctggcacacagcagtgcttggtgaatcgcagttaggattgctgcgtgaagagggaatgtgatgcaaagcctttgctttgggccaggctccttgtctgtaggtcaggatgcagtcccgggttcctaaacttttttgctaatcaaactttccttgagggatggttaaaaatgtggattttgacttcctgctcccagacattcggattccataggttgacaggggcccaagaatctgcatttttaacaagcagcacttgcagacaccaggggacccagatgctgatgatttgaggacacacttggagaaacctggggctgaatctagttccttggctggccagctcactgctgcacttgtgagtcctggattgcgtctgtaactggggatttctggggaaagctgttaatgatgccattaacacaagagtctatctgagttccctccagagggaacttcctgcttcctgctctgacttgtctctggacttctcacatcttggacctcccaccttcaaggctgggatgcaatgatgagctgtggctaaagagaggaacttggcttcctccctgtccccagcatgggattttctgcagggctagcaaggaagaggccaggatttttcggaactggattagaatacattattgattcaggaacggagtgactctgaagggaagaggcctcctctattggggtgtgctactgaagtaggcttggccggacctgccgggcctgagtgcagcaggctctgaggggaacaaagacccctatcgagtggaaagacagggtctgagggaggatgcaggcctgtggagcctgccttccaaggatgccgtcatccccagaagggcgtacttggaacataatggctctagctacaaattctattaactctaatagttgttctgtggtgaatggataatgcatttagcagaaatagacccaatcaatttatatgaaacatataaaactttctcattggaattggcatctgttcttgaatcaggagcgtgtgtgaaagtggacagcctgtcaccctcacttctgggcacattagcagtgccatgggttaattggagatatgggccaaataaagccatggctccctgatggtatcgcccttcaacccttggaatcttggagctggaaacgggaagggacttggacactgtctacttctaaccttgattttttaaaaaattgcagtctctctgcccttgtctgtgttcacattaacccccctcatctgcagacttgccccgatgggaggacctgcagaggcagaatggccccacgcccacggcttgccagtgcaaccagccagggcccagtgggggtgttctctcttttagtccagtgcttttcccatgacactatatagttttaattgcttttatcccccctttggcgagagatgtgtatgcagaaaatggcagacctacctctcaccaaatagctagaggcaaggctgtggttttgatgccaaggctccatagttagggttgtggagttgggcccaaagtttgggcgggttctcccattagctgagctgattcccttagactcgccctgcacagacagcctctgagctccaaggagaaggatagaggggtagggaggttgaggaagggtccttgggccctggggggcctgcttgtcccaatctgggctttttagggaaagagtgtggcagagcctgactgttcctcctcactgctaacattcattactgccagagagagacagtcacagggaggggaaagagatagaaagagagagagagagaaggagggagtcgggtgagggagagagagagagagagagagagagaagaacctggctctgcagccccgtggtcacattaccccaatcatttggttagtgtaattgtatgtgcaaagctgacaaatgtaatttccctggacttaatacttgccccattttctctttcagcatcttcatctgattagctaaagtgactcagagtcttccgagaatgctgcatgaagcacctggacaggattttcccagcctggaaacttgagcggctcagctctgctccatgggcctggaggtgaagaacctcccagatccaaggagtcaggctgagtccctcatcagaagggagggctgctgtggggagtgaggaatgtttagggaagcttagaagtgttgtcagtaactgttctcaaaagaccccaaagggcctttgcgtttctagttctctaaagcctgcccggaggagagttgaaatgccaccaaccacctcgttccagcccagcagaaactgacagctttgaactttggaaagaaaaatcttattatcctgtctcctcgattgtttgtcagaaggttgggagctgatttgtttactgttcgttcagggcctcttggctggaactcttccctgctcttttccatttttagtgtttatctccgattggagactttgatacctagaagtagcttagttgggtgaaagaatgtggactccaggttgacttcctggccctactgccttccagccttggggcccttaaattcttccataccattttactcatccctataatggtaaaaacagcaactgtccctgggcctgtgtgaggacaagctgttgtgtgaaataacctaggctatgggaccacgctctatgatctttcctttcctttccttccccctctggcctatccctctgtccttcttcagggggcctcccaggtagaagctctgagcttgggctttgcaaacatgccctgctgcctcgtaggccactctcctcccatggcccagaagctccagaatggcaagaattggctcagccctgtccctgttgtaaccatgcaccgtgctgggcacgtgtctgctgggtgattattactgactgggtgtggccttggcctctgcctccatgagtctgcctggacccataggcactacctcagtattgctctgagactggggttgagaatgaggggtcaagtttctcagtggggagacttgtgttccagctgctgtctcctccagcctgtaattttatttagaggtggtgggggagtcatcgccacgtgtgagccactggtgatttcattagtctgagtggccattgggcaggcccttactgagtaaccttttagggacagtgggagttatgtggcaataaactcaggagttgagcagggtggatggctgtttcctaaatgctggctgcagggggctggctgctgacacctgagatccaagctcaggcatccagccacccactagtcaatagatgtttctggagtctctgctgtgtaatcagtgctgttgattaggctgggcagggggctatggctatgtttacttagcacactaaaaggggaagtctggcttcttccctccatttataaatttatacatttcctgaatttataacagggaggtggtagttgaccaagagccaaggagagagtggaggtgaatcactgggcctggggggtagggcactgaatggagaagttagaaggctgcctctatcaggtgagacattggcatgaactgggaggtgagggggaaagcagagagagctgcagttttgtaggacgggctcccctctgtgtgggaatatacaaaggtctttcatggttctagttaaaggggaagggagggatgatgcgaaaagtaactaactctttctcctgggtctggcagctggattagatcaggcaggaatcaggaaggggtgacggttagccctggggcagcttttcatgggacagaaaggaaaggactccttcaaagacaaagccatgctaatgtctagttcacatgttgagagcagatgtggcaaaggtatggacctcattttttgtactttgtgccaaaaaaggatttcacattataagttgaaattagagatttatcattgatctgttattattttgataaagacttatcttttataggaaaaagagtgtgggtagactgtgtgttgtacacttgtttctccaggctatacatagcagaagacacctcacaggcccaggcaccagtgcctgcctgggaaaatcccttggctggctggcatggggctggggcagccttagtcagcttctgcggggctaggttcacagccgctggtctaatagaagagtggtggagaagtcacacctgtggtttataaccagaggctgacgagttctgctgaagtggcaaggggccatgagaagtcttggcttggggtatgctgaatagaacagctttggagggatctgagctctgggggaactgtgttgaaaggaagctttgggggctttacccatgatggggtagcctacctttgtgcaacagataaccttggccaggcccagccctctttataaggaggagaaatcttacagtaagctttgctttgttcagtaaggcggcagtgaattcaaagcagagttggggaaaaaaatgccagcttggttctctcctttgggtggggcctaggtattccctaggcatagaggaagctgctcctttgtacaacctccagaggtttcctttgctcaggcaatatgagaaccagacagcttccccttggaccccatagtcagagtgtaggtgatactccttctaaagactgtttcattctttcagcacagctccccaccctaaagacagcaccaatctttcttctgccttttgcaacaagaagttactgtgctcacatttgtgagctgaacccttacctgtagggtcaaagatgggggtctgtcttggtgaattttccccgggtttcagctccttgtttgggtttctctcaaacaggtttcttgatttgggtgctgtattctgcaggatcttgtcctctccgctaactgcaatagagaagaccccacgggctgagttaggtgagggttgatttcagggtgagagatgatttcacactgagggaggtgggagagacagtcaggcttaggctgaggaggggacaatgaggccatgggccatgggggttgggggacagagtgctggggtcagagtgaactcactggtgaggtagcagtccaggctgatggagatattgtcaaaagccacgatggctctggatccttgtccccaccatgcgaccatctgcagccagaacctgtacacatcaagaggaatgtgtgtgaggagcaaactggggggtcttgtcttaggattcagcatccagcaggtgtgtgctgatcacctggctcagaatgtgagtttgaaaaaggctcgctaatcccagagcagtggcgagagaagagcagtcagctccccctacttctgcaatgcagagcacttccccttccgaactatcgctccgtactgttaatggctgacacactggtccttaaatccagcctggagtttggggcctgggaccaggactccctgataatctgaggagaaatcttttgctttctgggtgtgcaggatgcttggaaatgggaagaaatctgacagtaactgcttcgttcagtaaacggggagtgatttcaaggcactgagttggggaaaaaaataccagcttgggtgtcctgtttgggtgaactgaacaggagaaatgggtaggtctgacattcagccagtggggcttaagtcattattaaaatattaaaatgcttctgtaccagccaataaagaaccacagttccaccagttccccttgcttgttgcttcaggcaactggctccttccctgctgccccgacccctcaatttcccaattaaccagcacccatagggtttatccattgattagcccagcaggggtctcaagcatcctgggtttcatccagcatcactggaggttgcctgcctggtggttaaatattaagcgacttgactatcacccctggaagtgttgtaaccaacacaggggtcataaaagtgttaacaacaaacccattaagatattgtttctttcccccaccctttcatatccttggagggccaggttctcagactgtggccagggaaggccttacagtgacataaacaggaaagtacttttggtttgtttgtttcctgggaaatcatcccatggaaggctagcagagtcagctggccctttcctgctctaagtgaaggtttcctgagaaccttaaaatcctttcctaccctccagaacgtcaatccagaatgacatgcagaacagggcgtggtctctggcatgggtatgaaaacaccaagagaaagaagtcatacccatccattggtgactgggcaaactccatatggtacagccatatgatgggacgccagtcaatggtcaaaaatggacccggagacgtgctataaaatggatggacctcaaagacgtgatgctaagttaaagaagccagacagtaggtgaaagaccgcctattgaatgattccattgatagaaaatgtctagaaaaggtaaatctgtggggccagaaagcagattagtggttgtctggggctgggagtgggcacaggattgaccgcagactagcacctaggctttttttggggtgatgaaaatgctcagaaacgggattgtggtgctctctccacagctctataaatctgttggaagtcactgacttgtacacttaaagtgggtgcattttatgatatataaattacagtctgataaaggtgttagaaaaaaaggagagagaggaagagagagggaacccaggccacagggcattggccacatagggtgtcaagagcagaaaaccagagcagggtggcactggcaacatggagagaacagggcctgcagggtacaacaaggacaagaaatgggatgtcaacagtgggaggaaagatgcagaggaagagatatggaaagaaagggcatttgctcatatggatttgcagtgaggcagcaaagctttagccagtgggtaaactacagcaggggttggaagctcccgttgcgcctgtgtgcagatgatctctgatcaacgtgtagaagatgctggcttgttagatgctggcttggttattcctggccagagaacaattactgtttccatggagcaaagccttgaatcccaaaacttttatccgaataactgtgatcgattatgcttaactgaactactccatacatttatctgtgctttcaaccatcttgtgagatctggtcattcagaaacaatcctttctgtctgaaagtcacaattacaggacccaaatctggtttgattctaaagaagaaatgcccaaatctgttgtagccgtggccagcatcactggggttggcccttcaggccatattccccatgaagaagtctccatgctaccctcagtcaggatagtgtgtgctggtggttgggtgtggaaggagaagtgcctgatggagaaccttcaaatcctgttctgggtggcttgggcatgccagatgagtgtgcaagaggggatggacagcacaaggaccctcagcccctgccactctggcactggggtgtatgcctctgagaggcatctctcattccaaccttgatacacacctatttttgtttcctgtaaagctattacatataggtctatggggcattctaagagaaatcgacatgaacgctgcattcaagttacttattgtccagtgtgaagatgaagtgtgtgtaccttggtgtggaataaagtagaaggaggtcaatgcttcataaaggtgcagatacagcagtgtgcgagctcagaggaagggggaattacaccagggtggggagagcaggagggcttcacagagaagacagtatttaagttggttttgaatgcagggaagggcttgaggatgtgggtgtgggagtgcagtgcagggaggagatgtctggagcagaggaactggtgtgagggccatgtgggcagggataggacctgtcctgctggggagcaaggagtgaggaaggaggtaaagatggtgtggacctctgaacagagatcaggcaaggaggttctgccattatttcagggaaaatggagagccactggaggtttctaacaggacagtggcaagatcaaagacctcttagaggataattgtgatgggagtagtaagcaggatggggaccaggagaggaggcagaggcaggggagacagcatgagaggcatttctgcacacatctcacacgccttcatcaggtttctctacaaatcttggcaaggttatagccacgatttccgtggggtctccccatgggaaacagtccatagatgagtttctggcttgagcctctgtaaccctggacaaagcccaagcctgggatctcaactggaaaaccagggccctaatactgctgtcttgttaaagcaggtgcaacccttaggaaaatgctgcttccaggtagcaagaaaacaggcacttagagtgacagagagggtgaatagaaggactcaggttccctgtgggagcatcaggaaggcacagctgcctggctcgcctgcacatcagggggtgagtgcccccacagggcacatttctccaccaggtcatcatctcctaatctgtcattcacaggaccaggggccaagccaggccctggtttcaatgctgagctatatgaggggtgtaccttccaggaggccagaggggcttgagcgagtaaatgacatgtgtgtgcctggggggggggacagaatcgcggctatcctctaaatgggtgctccctgggaagctgcatgtctccctgcccctctctgtgccttccttccttattactaagagattagatctgcgaagtctctcacagccactgggcctcttagcatggatgggatgatgccggctgaggctggaatggtttctaaatagaagagtttctaaagtgctctgcgcggcgacagcagtggcagctgctgcttaaaagagtttgattgacactgtgaattgcacatattttgagtcaggaacacgcacaaccatcaggaagattcaatcagatggcaatatggaaccaggcagtgctgcctctgtccacccggggccacccacacatgggtgcctctgtccatccatgggccaaccctcccccatggctccagcccccagaggctgcagggaagggacagtgggacaaaggtgggacaaaggtgagctgctgaaggatgggtggagggtggggcaggagcagaggccgtctaggaatggggtctgtgggtggtaggtgatgggcagtcagcaggtagagcagcaccaatctaggaggctcttttctgtggatgtgctggcccagagacagagtgggcatcaggaccacccagattcaggtttccctactttcgaaggtgcctggttgtgtgtctttacctgataggtgaagaagaggttgcttctggcaccgcttactgtctccttgctggagatgggaaaggcttcctcaaggctctcgcagtctcctggttctacccactcctttccgtgagtcccccagaagtacagctaccatgtcactctccagagtcagctatggcctcaggtctggagttctaccacttactagctgggccactttgggattgagggaaagttctggcatgtaccaggtggaccaccatgggactgagggaaagttctggtatgtatcaggtagaccactctgggactaagggaaagttctggtatgtaccaggtagactaccaagggactgagggaaaattctgttatataccaggtagacctgacacttagttgggacctgacacactctgggactgagcaagagtcctggcatgtaccaggtggactgctgtggggctgtgggaaagttctatcatgtatgaggtggcccactctgggactgagggaaagttctagtatgtaccatgtagaccactctgggactgaggggaggttatggtatatacagatggactactctgggactgagggaacgttttagtgtctaccaggtagtccattctgggattgagtgaaagttttagtatgtaccatgtagaccactctgggactgaggggaggttatggtatatgccaggtgtaccactctgggactgagggaaggttctggtatgtaccaggtggaccactctgggatgggaggaaagttctagaatgtacccggtggaccactctgggaccgggggttagttctagtatgtaccaggtggtccattctgggactgacggaaagttctagtatgtaccaggtagaacactgtgggactgaggggaggttgtggtatatacagatggaccactctgggattcagggaaagttctagtatgtaccaggtggaccactctgggactgagggaaagttctagaatgtaccaggtagcccactctgggaccaagggaaagttctagtatgtaccaggtggtccattctgggattgagggaaagttctggcatgtatcaggtggaccctcttggactgagggagaaaattctagtgtttaccaagtagaccactctgggactgaggggaggttatggtatgtgccaggtataccactctgggactgagggaaggttctggtatgtaccaggtggaccactctgggactgaggggaggttgtggcatatgccaggtgtaccactctgggactgagggaaggttctggtatgtaccaggtgaaccactctcggaccgagggaaagttctagtatgtaccaggtgatccattctgggattgaagaaaagttctggcatgtaccaggtagaccactgtgggactgaggaaaagttctagtatgtaccaggtggtccattctaggattgaaggaaagttctggcatgtagaccactctgggactgagggaaggttctgacatataccagatgagccaccctgggtttggctgaaagaaagcaaggaccctgacacatcactgccaagactgcgagggacaggccatcctagagaacatagttactcctctgccccactttgaaacctcagctctggatggggaaaggaggctgggttccccaggatagaagaggcttccccttcctctctgtgggcagcctggtcaaggagaagggaagcgttagccctttggggttccttccactctctcaccaatctgtgttgcctaagaacgtggcaggggagtctcctctctttcccagtgcttagcagcagagattttgctcctgacccttcatagttcgtacctgctcagctctttctgtttcttcaaagaggacacttttgattgcatgggttgttgttgctttttcttttcttttttccagccggtggagtttggaacttgttattaaaacagacttggctagagatcttggttggaggctggctttgcataaagaatgcattcgccctgactcttctcattcagctctacagagacgccttttgaaaacagactcagcggggatctgggaggtggccatctgggcagtgggccaagtctggaagggcagcttcagaattgggcgcctcggagactcatcgggcagatctctgcctgagaaatgccgatgctgctcacgtacgactcagaaaatgtaccatctcattcaggcaacagactgttaatggacagcgaatataatgccttatttgccaccctgccagccttagggattgacaaacctaattaagttcacttaatgattttaagtagctgacagaaaggtttgtgtctgatgtggatggagggaatggcgaagctttggagggcagagcaggatggagtggctggactgggtagaaggcatttgccagctgggcaccatgtctcacattccttccttggccatttagtgggctcggaagaagggagtgtcctgcatccctttttgctgctggtgcttgtctgggccctggctgcttaggatagagctggcaggtactgtagaggaaaaacactttctccaatttctcgctgcacagttaatttgctctgcaaaagtcttctaaaatgggctgtcatgaagcttgggtcgcagtaggcatatctattagaataatatatgtgaagaaaaagccctgccacatccctcctattatctgtataatggacttcagctctaagatgaagatgggagctgatggaccgctttggattcctgggaccatccttggccatgtcaaacgcaatcatggctaggaatgtgtgtcttggctctaggagtctttaacttctgcacagtaaactggagatgagctggacattcaaggccatactcaggagttgggaacatacccctcctggctccatcccactcttagaagtaatttaccacctcctgccttggtttcccctctaggcataacgacaccaggagcatgagtaaaagtcaacacagagcttccagggctttcaagggccatagagatctttcacaatgagtctggcttggtgaggaagcccttctagaaataagagagaaaatgaattttcagccaggctgagcaagcatggagaatcactcagacccttccacattctcagtttgaggcttccaggcattctgtgctcactttcgggggctcagcctaaaggctcctggctccctcctgtgctctggtgtgtcaccaactggaaaggcctgctgcaaggatgttccaccacagcagatggagacccatctctggcaagttcctgtttttctttcattctcgaaatctgtgtagtgtatgttgagctctgctgggccctgggttttgatgaggaaagacattgcttcctggagccatggtccagcaagcgaggggcctgtgcacaaaaatactcgacctacagtcaaatgccaagtgccctagggaaggattcaagtgcctcttgggcccctgccattcttttgacttgtgtggttgcaatggagatagtagcggatgtgggatgagagctcaggcctcttgcatccctggccaattttcccatcatctcttgcagaaccatccaacttgtcgaatctcatttagtctcatatgtactccgtaccatcggaaaagtagagcaagctccttgggatgactgggggcatgagggctgtctggagctagaaaggcccgccatccattcttcttggagggacagggatgtctgctccccgtttcttggaacacacaaacatttcctctgtcctctgttgctgtgttggcttgcggcttggggagctgacatggtaccgagatggcagcactgacaatggcgagaagacccagaaaaagggtggtttctacctctcttctcgcctgaccaaaagcatctttatgagagtaaattagaagtcttttctgcttggtgaggactagtttcaaaaagtagagtggagtgaagactgggtctatatagttggtggggccctgggcaagttgccaaaacttttaaggtgccatcttggtttttaaaagaatctatgtaagatgtgtttttttcccccaacaatggaaccctttgtttagcatgagatgctaatttattgctcctgttttatattatatgtttactagtaacatgtgcttcctcaagcagtgccacaaatgacatctctccccctctttctttgagcagagattatctgcgcaggtactgtaaatcacatacttgtgcctatagctaggagtgtagagatgtgtaagacgtggaccttgctcccgaggatttcagtcagtgatgtgattcacgttatttactgaccgggaattgctgaagtctcttttagttgtgccccctatagagctagaagctactcaagctggaaaaacattgcatctggacaatgagagagaagtcaagaaagacttaaaataatgaaaagtcttggagaatggtagaactatgggcgaaactctcactaggcagtggggtgtgctggtgggagcaatgtggaaggtgtgggtgggacaccagtcaggcagctggaaacccaggtgtggaacccaggtggacataaagatatttgagtcatctgcatagaggtaagggtggaagttatgagcattgatgaggttcctggcgcgggggtgggggcagcatagatagaactggattctttgcttcaaatattggaagctcaattatctcctaaattgcaggctttgtgtttagggaaagaaggggctgagaacacagggctacattttccgagacattaagaattatgaaaaacatacacatctgttgacttgtaagccaagctgtggatgttaccaagaaaatcttgagcagattcgaacatcctgttattttaaagaggttcacttagtgccattttgagcaactgcctcctaaaccaagctcatgggccggatctgtctcactgctttgcactcttgattgtggaaacttagcaatcaaaagcaacaacttgtcccaaacgtcacagtaaatcagcgttagaaataagatttaaagctcagaattgctaatctactccttgctccaatgatctgggatattttctgagaaagaaacagggccagatccttccagaattatgaatgtttgatttctatatatcaatgcctggttgcacatcgtgtgctgagccaccggccgcatctcttctcctcttcttgaacggctgaagctgctcacgtacagctcagaaaatgcacaatctcgttcaggcaacaggctgtcgatggacagtgaatatattgccttatttgctaccctgccaaccttagggattgacaaacctaattaagttcacttaataattttaagtagcccatgtctacttaagttcgcccaaggctgtcctgagccagtggtgccatttggaagacagcagaggaagaaggttcttctcctccaggttctttcttcacgctttctgagcttcacactgaggctccaatcacttgccactgggcccctcaaaagaccttccaatatcccccatgctctgtgcttcccgccctccagcctatctccgtgctcagtggctttcttattttttcttcttttttgagacagagtctagctctgccacccaggctggagtgcagtggtgtgatcttggcttactgcaacctccactttccaggttcaattcttgtgccttagcttcccgagtagctgggattacaggtacgccaccttgcccagctaattttttatatttttagtagagatggggtttcactatgttggccaggagccaacatatgtcttgagcttctggcctcaagtgttctgcccactttggcctcccaaagtgctgggtttacaggtgtgagccatggtgcctggccctcagtggctctttttttttttggaatggagtctctttctgtcgcccaggctggaatgcagtggtgcgatttcagctccctgcaatctccgcctcccaggttcaagtgattctccagcctcagcctcccaaggaactggaattacaggtgcatgccaccatgtccagttaatttttgtatttttagtaaagacggggttttaccatgttggccaggctggtcttgaactcctgacctcaagtgatctgcctgccttggcctcccaaagtgctgggattacagttatgagccaccgcacctggccttcagtggctgtttattacctgtattcctaaatccaaaacacctggcctaatattcacactcactctctcccaaaaagatttctcaggattctctgacacaaccaggttggctgttcttgaacccacaaaaaacatttctgcatctccaagcctctgctttccctgaaggccttctctggaatgccttgtcccttttccatttctctaagacttaaattttcctcaagcaccagtttataaaaagctcattttctccgtgatggttcatctgactgctcctgtatctggacgtcaatgcacctgctgaaccctggtcatgatctgttggaacctgcagggtgcctgtgtgctactgtttgcctgtggaggtcctgtgatctggcaagagctgatcaaacatccttttccatcctctgtgcttgatggaggcttaatatatgtttgccgacaatgtgtcagccaatgacatttctccagtcacttcttgattccctgtcttgcccagatccagatacctggatctgccattatataccagtgacttccaaatgtggttacgcatgaaagtcaactggggaactttaaaaaatacagattcctggtcccaatatgtcatctgtgaatcagaatctttgtgtatgagatctggggctctgaaagaaaaaaatacgttttccaggtgatcataatgttcatccaagtttggaaaccatcgtcctacactgtcctgctagttttaagccttttcaaaagcactttctcttgtttatttatttattttttgtttttagaaatgacaaattcgggggtggggggaaattctgaggtggtttctgccagaaagtaagattttgctgcatcataaaaatttgggaatgaaacattcataccttagaatagaacctggaattgatttcagccttgagttatgaggctttgtggagaagaagcgtgatcaatgctcagcatagctaaatgaagaagagacattctcaagtgacactctgatagatggccagacatgagagctatattccttgacttagtctgtgacacaccatctcatttttttttttttttcaaatctaactcacttcttttatttgggcacacagctagactacattccccagcaccctttgcagtaggtgtggccatgtgactttttttacattataaaatgttttattaatgaaaacaagctttgagaaacatggtgcattgcaaaagctaagaaactcatccacagaaccttgaacgcttcttgtgtgcaccatgtattctagagtttttccaagtcacatttaatgttatcagttttgagttactaaattcagaggagtcttatttctcactgcttgaatttttaggaaatacgacgaaagcacattgtaaaccactaatatttacaatagtcaaaaatgagctcataataaaatacatttaggccatgtttcaaagaatacttaacaggtcaacatcattctgcgttactgttggccttgtgtcttacacacaatagatgcctaacatctaatgaccaagaccttcaactgaattatgtaaccattttctttgattcttacatgtgccaattttagacagaaaccttaaatgatgatacagaagccacagtatgatattacaggtagtgtggtaattctaaccctgaaaaaaaatcccaatgactgaaaatttttgtttcctaggtacgaagcataaaaaccagcccagataaggcaaacaaaaagtcagtaaggaaatccaaagagagcagatggcaaaggaggcaatgtgagcggagcagaagtgatgattcataaaaatcttcctgttcaaggcttcctaagctctttgcccaccgactggctgaatggaaaggattccaaggccagaggaaaggcccacccttttctctggccttggaatcctttccattcagggaaggaaaagggtggaaggggcctggatccctgaatgatcaggtggaaggccacccaccaaccagcatgcttatttttaatttcacacgagcaggaaataacatttcttttgtttacagctcctggagtggagatgtaatgttacttcaggtagtgtcaccccctctcacatacatgtggcacatacctaggtactcaggtgtgttcagtgcacctggcattgttgggttgatgactaacacactcatgggggtgggagggatgggtgaacttggtccttgactggctgcaggaatctgcagtattcttccttcacagctatagccttcccctctgcagcacactcctgcactactccaggactagggacaggtctgagtagggcagggggcataaaggagcttggcccagggctcgggatgcagatgcagctctcctgtgctaatgtgctatttgcataggctttaggctcattgaccgggtttctgtcatgttctggaggcctggggcctcgtcttgtcctggtttttcacttgggtcctgaccacacacccatatccctctctggatgactgatctggcaccccagtctgtgcctggtgtgctcctacaagtcagagtcctttctttggctcttaactgcatggctgggccctgcaggtacaggctgacctcttcacggctgacagggtcttcaggtggcccaggcctaggcgccatagcacagttctttcatatcagctgctgatgtgtgataacacctgctgcctgttgtcactgagattcatggaaaaaattttttgaccatgaaagcatggtgtttggaaaagggtgagtgtttgagctagaaaactgtgccttgaactgggtgcggtggctcatgcctgtaatcccagcactttgggaggctgaggcgggcagatcacttgagctcaggagttcaagacaagcctggccaacatggtgaaatcccatctctactaaaaaatacaaaaattagccaggcgtggtggtggatgcctgtaagcccagctacttgggaggctgaggcaggagaatcgcttgaacccaggaggtggaggttgcaatgagctgagatggtgccactgcactccagcctgggcgacagagggagactccttctcaaaaaaataaataaataaataaataaataaataaataaataaataaataaaagaaaattgtgttttgaatcctgactcttctgcttcttagttgtgtgcctctggacagattatttaaactactctgagtcacagtttctcattgataaactaaggtcattaaaatctgacttataatgatgaagataaacgggcacagatgcttggttcagtgagaatgccatccctcttctcctgtcctcgatcattatggccccaagaggcacaggccatgggctccaggtgggaccccagccctgccaaagtcccctcagccttgcaggctgctgatgaagccagggactctgctcccacgtcccttatcatcaaggtaaggagaataaagcatggtgtgcacttgaagtgttttgaaccccttggggaaagacttgatgggtttagtcaatgtaatttaccctgcatggcttataattgcctctgagaccaccattttctcccagttcaaagaactgactcagcctaatgccaataagcatgtcaatgtccccagcccctgtagcttcgggaagggacacttgtgctgccacagcaggtcatgagtagagagcaccttttattttcttcactcaccatgtgaacgaatcggttttgcctaagtgtatatatatatatggcatcagggcaattcaactcccctcgcgagaggcaggtgagacattcctctcccttctgccccatttccaactttggagcctgcaggtctactctggggtaagttcctggcatgtgtctgctgagagtggatgagcaaatgcatgtctacctggggtggtagtcattgctctctgcttctattcgtgtgggaatgcccagcagagggaggactcaccactggcaaccagacaggtgcctgttgggaagcaaggagccccaacagctggggctttactgggctccttctgctccagctcccaggactcgtgttctgtgatgccgtggtcttgtcttcccgccagcctccctaattagatggagattgagagctggggctgtattgcttgtctgggtgtgcccatcacctggcacccaacactgcagtaaatgttggtggacataatgcctcaggggattttggaggtttgtacatttcatgcttggaaaccttcacaggatgctgtctcgtgaagtgaaaggaggggaggaaggacctccacagaggggcctctatgtttaatggcaagttcttaaacccctctgggcctctgtcttttcagctgaaattagggaatgacatctaccctagctgctcagatgcgagcctgagtgagaaccttgtgttgtgaaggagccaagcaccctggaagggggcacagggctgccgtggatggggagatgtgggcagagtgaggaggcgcaggagctgctgggactgtcagccagcttgtccagcagagggtcagtaggcgagtgatgtctgctcctcctcataggcatccctttttcctgaggtggagttagaggcggagcagttacagatgaaaatgctcctaggaggggcagacaggcaggaggacaagagcagatgtggggggcacccctgggccatgtgctcctaaagatgaagcagggctctatttagcacagtgtaccaaccttgtggctggggtctcctgttgatccttacagcagtgaactttattctcaatgaaagggcgatttgttaaatgtacagtataactaaaggttatttttatgccttggttagacttggtacatgaatagatatgcaaattaaaaatgcctatcagagactgtgctccagtgctggggaggaaacacatggtgtggggatagtcaaaggcatgccggagtgggaggcacctggagaggggacacaatggcctggaaggataaggggagactccagctgtgagcctgagaggagaggcaggcaggcaggggccgtgcggggaatggtctgcagcaggaggtggtggtgggaattgctaggatgaatttcaggagctggttgaagcaaagggaaagcagtaaactaatgtgaaatggataagagatgtggcctaaaaataaccaagaacctaaatattttgttagtaacaatggctattgaccaggtgcgatggctcctgcctgttatcccagcagtttgggaggcccaggcaagaggatcacttgaggccaggagttcaagatcagcctaggcaacatagcaagaccctgtctgtacaatttttttttttaattagctgggcatggtggtgcacgcctgtagttctagctactagggaggctgtggcaggaggattgcttgagctcaggagtttgacactgcagtgagctgtgatcatgccactgcactccagcctgggtgacagagtgaggccttgtctctaaaaattaaattaaaaaattaaaaaacaacaacaatggctactgtttttcaagtttctgctacatgccaagccccatgcatcacttcctcaggcagtacataggaggcagaccagcctaaagtttaagggaaaattatttaacctccatagccctcagatttctcatattaaaaaggggattaattataatatctaccccaaggggttgttttaaggatgaaattagataatgcatgttaagtacttgttacatgactggcaggcagtaagcactcaacaaacgctagctctaatcatcatttataactcttaaatggctttatcaggatgctgtgattcaattaacagaaatgtgaattaagcagaatttttttaggggtgtgtctagacctgcaaactgaggcttaccggaaatctctggatttccactcactgaaatctactatttctctacacagataagaacaagtaataaaagacgctcttcaatgcctttctcatcacagaaagatgctacacaaagggagagtgttgttattgacagcatcccacataaaatgagaattctgtcggtgataaaaattgaatagaaaaaaaatcttggctctatggagtttctggtctaaatgcatgaagacataactctcagtttaacccatctcatttgaaagatgcattggtgaaacacaccacttgtcgtttaggacaaaggattgcaaagggaacaggaaatctaaatatctccagaaggaacaatttttcttgttagactatgtatgtagtgtacggctaaaagcctttataatgatagtgctgaggaatggagcctgcacaggtgtgataagttgtgtactttatatttgactgtacaattgcagtgatttgtgggacatgatttgatccatggtgtttccaaatccatctcataacgagttgaacttagcatggcttctgctctgtaagcgtgtcaaagcttaggatagtgtgggaacattgtgtttaatttagtaagatatatagagagaggaaaaactaggggtatatctctgcaagagactgacaattagaatcaggagagagaacttgcctttcttctattttgagaaaaggtagaattaattccagcagaaagagcagcaattgaatgagggaggtggggctgataaagtggggagaggatgaggaaaagtagctatgtgaggtggatgtaaagtaatgagataatttttaagcacacatcaagctgatatttgaattggtgttgtccttcaaaattaccttgagagcatttatctgtattcagaggacattgccactgctcaaaacatcttaggcattgctcttagagatttttcctgttactcattatactatggttgtacagttaacataattctgtaatgatgacagactattacattccttctatcgctttacatgtttgtaagtggacagaagaaatatcattccatggatcaatgcctccctgtcaccaggctttatgtacctatgacttattcaccgagccttcccgaggactactgtgtggtgggggcaatctgactagagcccttttctctcaagtgcacaactctagttctctctatcacaaggaccagggcacccaattaggatcaaagtctttcttatgaagtgattccaacaggaatgtgaccagagacaaagaaagcacaggtaccaggcaagtccctaaagataattccttgtcacagagtaacaaatgctgttttggttcatctgatgggacacaggtgttgctctgatatacagaacactttgcagtagtatttattataaagcaatcatatctgttttgtcggacacaggttgaagagaggaggaatgttagatagattccatcaagtgaaattctcagtttattcaactggaatttgaaagtatatgcaatttccctcaatacatcattctgtcaatgcatatttattgggcatactacatgttaagtatggtactaaagattcaggaagcagtgatttataagacacacacaatccctaccttgttagtttgtatattcagatataaaaaagataataaagagtgataaattattatagggatgtttcaagagccatgagaatatattgtgggtacatatagagtataggtgtctggggataattttttttaagtgaaggaagagtagtatttagagagatggaaagtaaaggcagaacattaagttcttcctttaactttaacatgcctttaacatggcaactgcaaaagcctagaagtaagaatgtagcatggtacaactgagtggaaggaaggggagattgagagagaaagaatggtttaagaagcagctggtgaaactagcgctggacagatcacacatgggcttaaaaaaggtcttattagggagttttaaaggcatccccaaagccacaggaagccacagaaggatttccaaaataggaaaatggtcagatttccaataccgttgactagagcctggagtctcttaagtgctaacctctaagccctaataaagttactttaaaaattttgtaatgtgtgaaggttgaggaacctgggagcagaggtgatttgggacagcatagggaataaaatttctgccgctttcaaggttcagggttggggagctgtccacaaagtaggtgctgaatagctgaagccaggagctgcctaaggaagcttcatgggatgtggggcaggtggcgccaggtgttaccgcctacctcagaggtgggaggaagagagttggtttttctttgtcttttatccatcctatttttctattttccttgcttatgtcttcctctaccttctcctttctcccattttcatcttctagcaatctgggcagctatagctgactctccctgaaggaagagggaagagaatgctttttgctcctccatcagtgacttctcataaggagtcaacagagcattgtgaaaacaaattcataagaagcccgcctttatctaagggttggatgactggttatattgctaaattggccatcccagacccttctgagccattaggtggggagatattgtcattattatactatagttattagtagttgagcatttagtgtggatcaggcagttaaacaagcactttacttctccaaacctaagaggagactgtgttgtctgttttatagaacatggcttgacttggaagatcagtggttgtgatttgtgctatttgtttaataaattattactgaggccaaataactgaaagatgcagaaaataaaatctattaatactctgtgtagactctttcaatagtcatttcatttagtctcataacaatcttgtgaaattatactgttattattctcattttactgatgaggacactgaggctcagagagcttaagtaattggctgaggtcacacaactagtaagtgaccatggcagttttcaaacttggcactatttgattccaaagcctctgccctttcatctagagtgcttctttggtttctttggggccagtcacatctacagtctagtttgattttagcgaatgaaaactgctgcacttcattttccttcagtaccatttgcctctggatcttgatgcttcccatatcatctgtacctctgggagggcagcttccaacctcagagcatgtcagtggtatgcaggctcccagcgaatggaagcactcttgttttctgtaattgtacacttattaggtcacaaggcatcatcaaaccaagctgtcttttgtcggaatccccactggacagtttggtctcagtatcaatactggaaatgttagtctggtaaacagcctttaacagggaagaaggaggctgagaacgaagtctccttcaaatgaaactctagaggatgagagtgaaccgagtcaacatcttactttaaatcccctggagtagctatgaaagagagaagacttgctggattgaggagaaaaaaaacactttgattcatctgaattaatttcacctctcccaggagggaggattctttcaccaccctcctgttctccaccaactgcatgcagctccacaatccccaaagacaaaagactaaactatagtgggcagagctcacacttcctcctttctccacttaaatccatttgtcctggggtcactgatccttggaatgtccttgggctttgatcgttaacccacacacatctgaaggagtgggtagctagtgctcagagtgaggacaatgcctttgtcctttgacagcactgatgcagttatgagctcttggacatagcagactgtggggtttgggcgaaaaatgtgaaaccagctttacacttataaagctgcatgccaactagcatcaccctccaccttgccttgagccctctgtcctcattttttgaaggtggatccaccaggatggtaatttgattgtgttttaggagtctcaggcagaggctgctgtgggttgtaagggttgacttttagcccataaaagatggctgtcccccatccagatccatttatctgtcccctttatagaaatggcccctcgcccctcttttgtctggaacagatcagcacccaccatgagggttcaggatgatacggcagggtcacatgagtgctgccatgcagggccatctttattcaagtacggcttgctccaggctgactgcaggtggcagaatagtgccatcctgggagacaagtggcagtgaacactccatggttcctgctccattgcagagccacgtggagttaatgattttctagttcaaacctctcagcttaaaggtgaggaaactgaggcccaaagaagtcaaggatgttgctcaaagtcacagaggccattagtgatagagcccaaataggaactaagaccacaagtagaagcattcctctgtttactgaagaatttgccatcctctttatcaacctgcctcaggacctgactcaacagagaacactggactcggagtcgggcctgggcaccagtcccaattccgattccaacttgctggcacttcaccgttttgattctgtttctccccttataacaggacaggagtggtaaatgatgataaggcctgtcctacctaccttgcaggttttcttgttaataaggataaaataaaagtggggaaagtaaggcaaagtctatcatataagagaacatgctatatacatgtaaaaccaaactgttatttgggggaaatgtgagttgttcaattttatttttcctccagacactgggggtagccaaccaggccataccagtggtcccgagacaagtgttcagtagcctcttcatcccttggagaagcttgtaaactgcagaaagtgtgtaacctgcagagtgtgtgtgtgtgtgtgtgcacgtgcgtgcacgcgcacatatcggtgtgtgggcacatctgcatgtgtgtcttgggtaaaaggcacggggaaagggaaggcatgatttctttttcattttagctgatagaggagaagggtattgggggagatgcatagagcctacctgtcagacacatcgaggagaggcaacaccatccactgccacaggctcaagccttcataggcggcgacatgccagaccatcctgccttgctccttcccggttttgttctccactagcaccaaggacacgtttcccctcaagactccacgaatgagccaggacattcggagctgtgagggcgagaagagtcagaggacaaggtatgattgctgaaaggtcccctttctggaattctccactgaagtttcaaggaccttataagagactcagctgagttcagcctggtgagaagagctggatgcccaccacctgtctcaccaagaggctttcagtgaagttcaagtatcccatttcctaggataactgaacgaatctgttaattttttttcttgggcagggacaactgatgggcagttttggaactttgttcaggttgatgttatcatcctacctttcacaagattctgcctgtaaggtgatatcaagatcaatggggtagtaaatgaacttcctaaagagtagccaaagattcttgcctgtggccccaatttactttgtgaccttggacaaatgattttgtgactcagtttcttttagtgatttaggtatcatagatttttctctcttccccaaagactctaataatctcatttgaatggtgtcatgtcacatgtcagctaactaaagacccaatgacttgacacctgtggccactggcaggcaaaggccagacaaaaatctacatatcaagatcttttaatatgggcatctttcgaagaggatgcccacttcgccaaaaggaagttacaactgtgtttttcattgtgtctttattaaaagtttctgtggcattgttcctaaacatttgaaagaaaattgtaactaataacctttgtaagaaagtttaagtacgatcatattcagaggtaggacatactataaacaaggtttctggtctttgtgtttaaaaacctaggacaactatatcatatcattgcctaaaataatcctgtaagaaaaaatggtggttattgtagaaagaaaggtaaaatatgtcttatggtaaactggcagtttcgtcagagtaaaggtaccccctttttactgattctctctgaatacctgcttctttgtaaattaccactcctttgtcttccagtccttgatacatggttgcctcacaatttgattgaagaggttaagaaccatgactcacggcagccccaaacttcccactttcttgcatacaaacccttcactaataaggtcacaccagggcattggggcccccagggactgatttacttctgagtccctggaccttgtaagcctggtctataaccacagacacttcacttacacctttcccatttctccatatcctgggtagcaaatatgcatctctactgagacctcctaggataaatgaatgaatctgttaatttttttttctggcctcacttagctttcttgtacaagccatgattggaaatttcaactctacccctgctaactgtaaaccctttcagctctcagcccatgccatgcagtgcctagcttgggatcacgatgctttctccttttgctccttggctgaagaatactgctaatttgaacttccatgaattcagactgttgagtctcaatgccctggatgtgaggtggtacttgttcattctctcttgatttccacagttgatttccagacacacatagtacaatgggtgtttcaaactctccctcgcatactgacactctcaccccctggttcccacctcctaatccactgatttgatttctactttactgagaagatctactatgtcaggaacaatctccttcagtccccttctctcttttttgtgggcccagtgtttatttatcctcctttcttttccttttctctcttagaggaagctgcatccttcactgtcttccacgttagcccagctcattttctctcccccagtccttgctcttttagttactgccctcctttccctcctttccccagcatctcagagtcaatcttttggctcctttgtctacaaataagatcaaggttcacccattctggagaaatatcctttatttcatcctctgggctcctctggcttgtaaccatttctttgccccattcagatgctcacatcttgaacagctgggatgtaactgctgccgctagttacttgttgctcattctctctttaagttctttcaacctggtttctagataatctcctcattactctagcaaaatagagtacccatgtcctttataactctttgaactcttcagagtctcctaaagtgcctctccctctccactctttctctcttccgaattctcttgtatatttctatcacattctcctgttgatcatgctcatctgtgacttgggctcaacaactgtcgatggtttctcatgccctgtcaaaaattatggcatttacattcctctattatctgaggaaatcaactttttcatcattcaacaaatatttgttaagcacttatgctgggtcacatgaattctccatttcagaatggtctaagacctctagaatcagagagttctgaattcaaaacctgtttttaccactttggcctagttatttaatcattttgaagctcagtttcctattctctaagatgagaatagttttatctcttatagggttatagggactgttaactgaaataataattgatgtaacaaaatattaaaaaggcattttggctgaagcatggaggcagtgggtgctgcatttcaaagggaagtgtaagagcacaaggttgcagaactttcaagagaggtggataaaaatgaatgacataattcttaacccttcactcatactttgcatattacaaaatgctggaggttgactattaggagagagtttttggaaggtgcttttggcataccacgagttccatttcactctcctgctaagaagaaggtgggaagggtgttccatcttcatctcaagtcaagagagaatggttttatgataccatatcaaggacttgatacttacccctgcagttttggaaacacggtggattagtgtctgtctcctacctggaaggtctaaagtttgaactaggggctggctagctgctctgatggcagaacaaggcaaggtggcagcatcgggtggcctacactcccagagtttgctggggcagaaatgcatgagtgttgcatatgggtgggaggagaaccatgtataggggagcccatgcagggtcactgtagatcttgcctaagagggaggtaaatagacaatagtaggaagaagctgccggtatcttgagatgcccaagagtggaggaaggtggaagtgaccacctataatagagatgcacatacctggccgggcacggtggctcacacctgtaatcccaccactctgggaggccgagtcaggtggatcacttgaggtcagaagtttgagaccagcctggcaaacatggtgaaaccccgactctactaaaaatacaaaaattagccaggtgtggtggcaggtacctgtagtcccagctactcaggaggctgaggctgaggcaggagaatcccttgaacctgggaggcagaggttgcagtgagccgagattgtgccattgcactctagcctgggtgacagagcaagactctgtctcaaaaaaaaaaaaaaaaaaaatgcatgtgccctaagtcaaggcgaaaaattctaagccatggtggaggggatgaggagaaaggtggatctacaaaggaaccccaaaagcccctgtgtgagaaacagtaagccttggacatttgttacatccagagaacaccaatgcaagattacccaacagtctccaataagaactttcttgctcccctgaaatcctttctgtgtctatgcttacaaccccaacaagtcagaagtcaacaagatgacagaagaggaggagaggttgggtggagaactagagaggccactgaccacaccctttctctcatttcaggctttccatctgcaataggaccaagtttggaggcggcaggagagggcaagaagtgatgactttaaagcaagattgaaattgtgactggatgagcatgctgattactaaaaagcctgtgttttgcatttttaagtgactgaagaactgtctgcattaccttccagtgaccagagaagtagtctgtcagttttcacctagcaatccacacaaggaagctgaatgaatgcgggttccagactcccctacaccagtctacttgccagatttgcacctgacttgcatttctctgcttctatactttttattcttttgttttctctacctgctttttccttctgtcttcttaaaaaatgagatctctttccttttcaggaggcctttttcttttcatccatctcagaaaccacttcctcctcctcttaaatcttctaaggttattgggacctgctgccttgtcttctctctctacccttggtcatgaattccttcaaggcagggactgtcttattcatcttatgttcacagtggctgtcaagcaagggcacgttgtaggaaccaatcaatgtcagcatgaataaaattgcatatctatatagggagacactctcatctttgccaggctttcctcttagaggtagtcaatcaactttccatcctaggaagctccttggcactttcttacattctatgggtcagggaccagggaaggggagaagttcctcactttccagccacttggctatattctaaactgccccctcctcagctgctccctggaactttacagtttaaagtagagtctgctgatggtatgagcatgtcagcaagatgcagccctgtcttgtctattctgggaccaggggccagccagcagctgagctctctccatcttcctgttctgtgttttaggccaatcaggccgggcaaaagagagagaactggactggccacccagggatggtgtgaaggctatggcatccttagccttctgaggcaatccaccaggatccttcctgggattagtccttaagggagatcatcatctactcactcgcagatagttactgcactcctactctttgctgcatactctgttcttgaagatgagctcctgccctcatggagcttatcatccagccaggaagatagaatttaaatgaatgattacaaatgttctgattgtagcaaaaggtgaagtaattggagccacttgacagtcaggacatatgacacaagataatcgaggcaagacacatgacatcacacagtaaagacttaggtccagacagccactggacccaactgttcagagctaggaacaaataggagaattaaataattaacttccggccgggtgcggtggctcacgcctgtaatcccagcactttgggaggccgaggcaggtggatcacctgaggtcaggagttcgagatcagcctggccaatatggtgaaaccctgcctctactgaaaatacaaaaattagctgggtgtggtggcaggcacctgtaatcccagctacttgggaggctgaggcaggagaattgcttcaacccgggaggcggaggttgcagtgagccgagattgcatcattgcactccagcctgggggacaagagcaagacttcgtctcaaagagaaaaaaaaagaattaaccttctttcatcttataatgatacctcctatgtttatagcagaagacactcaactacagccacaactcaagccaaggcatgcactctctgagtttcaacaatgtctcattctagaaatagatgcaaaaggcctggaataagattgcaaactggcagtcagtgaatggctagcaaatgtgtattttttggccattttttttcatccactgagtgttcagtaagggagtatatccaggcagatgttcttcctcaggatataagcagtccactggctagccataggcagaagaatgaaactggatcccacctctcgccatatacaaaaattaattcaagatgtattaaagactgaaatgtaagacatcaaactataaaaatcctagaagaaaacctaggaataactcttttggacattggcctaggcaaagaatttatgactaagaccataaaagcaaatgcaacaaaaacaaaaattgacaatggggacctaactaaagagcttctgcacaacaaaagaaactataaacagagtttataacagcctacagaatgggagaaaatatttgcaaactatgcatccaagaagggattaatatccagaacctataaggaacttaaacaaatcaagaaaaaaccaaataacttcattaaaaataacacctttgccctttgtctgggcaaaggacattaatagacacttctcaaaagaagacatacaaccagccaatacacatatgaaaaactgctcaacaacgctaaccaccagagaaatgcaaatcaaaaccaatgagataccatctcacaccagtcagaatggctattattaaaaggtaaaaaaagaaaagatcttggtgaagatacatagaaaagagaatgcttacacactgttggttggaatgtaaattagttcagttgctgtggaaaacagtatggagatttctcaaagaactaaaaacagaactaccattcaactcagaaatctcaccactgggtgtccacccaaaggaaaataaatcattttaccataaagacacctgcagtcacatgtttaccgcagcacgattcacaatagcaaagtcatagaatcaacctacgtgtccctcaatggtgcatcggataaagaaaatgtggtacatatataccatggaatactacagagccataaaaaagaaagaagtcatgtcctttgcagcaacgtggatgcagctggaggccattatcttaagtgagttaatgtagaaacagaaaatcaaataccgtatgtgctcacttatgagtgggggctaaacaatgagtccacatggacttaaagaagaaaacaatagatactggggactctaaaaggtgggagagtagggggaaaaggacgaaaaactacctactgggtagtaaactcactatttgggtgatgggtgcaatagatgcccaaaccccagcattatgctattgcataacgtaacaaacctgcatgtttatcccctgaatctaggaaaaaaaagatacaagcagtccagagcctatgtctgtcccttggcctacttctcacctgtagttataatcgtagtttcttccacattgtgcctctaagagccagtcagtggtttcctgcttagagtgtggtcctcagactggtagcatcagtgttacctgggaccttgttagaaatgcagaatctggctgggcgcggtggcttgtgcctgtaatcccagcactttgggaggctgaggtgggcagatcacaaggtcaggagttctagaccagcctggtcaatatggtgaaaccctgtctctactaaaagtacaaaaattagccaggtgtggtggcaggtgcctgtagtcccagctactcaggaggctgaggcaggaaatcacttgaacctgggaggcggaggttgtagtgagctgagatggtgccactgcactccagcctgggcaatagagcaagactgtgtctaaaaaaaaaaaaaaaaaagaaaagaaaaaagaaatgcagaatctctggcctgatgccaaatccctgtccctgtgctcctgtgactcatcccatgacctttccagaatgcactggaaccacctgccctttgcatcaacattcattcttcagtggcttgtcaaaccatcctcttttcttgtctgctgactatggcataatttggagtctgtgcttcaaggccaatgtgtattaactgtgtgaccttaagccaaccacttacctcctctgaacctgtattttgttatagacaaacttgtgataataaccaccaccccttccctgcctgcctcaaaaggggattatgaagtatgagatgaagaatgtggaagtagagctcctgtgatattgtgaatgacatggtgaaaccagtggttttcaacctggggtgcaaattagaatcagctttccagacgactaatgtctgggcaccactccagagactctgatttaagtagatgtgggtaggtcctgggcatcggcagattttaaaatttctccacgtgtttctaaagtgcagcctgggtagagacctctggggagctgggttacttagtgcaggaagtgcctgaccctctcagtgaggggtccattttcatcttggactttgagtaagaggcaattcttaataacttacaaatggcttaaaatgtgcccaccatcaccaaggtgtagagggggcgattttcctgcagcggggagtctgctgccgtcagctaagggccttcttggggctgttacatcgcctctagaaaaagactgagaataaccgagagagagaaaaagagagagagaccccgtgagcagtaatgacccgaggatgtatacggggctagaactaccctcttggacctgcagataaggtttttaccaatttcttaattagaagacctggaggcctggtatcagttcttactgagtattccttgttgatcacatgtgtctaacattagacagcactcactgtatgtggttcctagagcagactgcaggctcaagtccctctcaaagaccttcatttcccttacacagtccttggttagaggtcccttgatatcattttatgtaaatacccatgccaagtatacccagcttgatcttggcagtcaaggttctggtccaaaaacacccttagaattccatcttaagacctatttctatctgggtggcctacagcagaggtcctcaacctttctgacaccagagaccagtttcgtggaagacaacttttccacagaccaggggctgggggttggggggtagtttcaggatgattcaagcacattacatatatcgtgcactttatttctattattattacattgtaataaataatggaataattatacaactcaccataatgtcagatcagtgcaatagggctcgcacttctatgagaatctagtgccactgctgatctgacaggaggcagagctctggcagtaacgcgagggatggcgagtgggtgtaaatacagatgaagttttgctcacttgcctgccactcacctcctgctgtgtggcctggttcctaataggccacagagcagtactggtcggtggcctgggggttggggacccctggcctactggatatgaagtcatttgttaattgactctttactgaatgccaggaagctgaactaggcgcttgcacgtaggcttatctcactgtatactgacaacatccctttgtgtagatattattccacccatttttcagatgcagaattgaaggcttagagacgttaagtcagtcacccctgggcactaagcccacaggctgcagacctggagtccacactatgctctgtgttctttctaccatacatggagtgcaatgcccatgtaatatattatggtactccttaaagctttgggggcatattgcaaagattttccagatctttgttgctcagtgtgtggtctttggatcagcaatgtgggcgctacctgggagcttattagaaattcagggtctcagggcctgccccagctcttctgaatcagaatttatattttaacaagatcttatcctagaaatactttcgtgctggagaaattagggagctagtgaattttaatgcatttacaaccattgtccttaccagacaattaacagtcgtgtgtgtgtgtgtgtgtttgtgtgtgtattcacacaaatatgcgaaatctgacacaaattctaaattatatttatgggaaataacgcttgctgatgccagtaacaataaaatttttgatccttctagacacatcctagtagatataggttataaatggcagtgtttgactaataaactcttttatatgcagacagcaaatgagacaagtgagtagagacaacaccaggagtacgccaccagcaattatatcttctggttccagccagcgctttcacaagggccattttttcctgcctctcggaagggactgatagactttccaattatgtggtaccagtgtttgtcattttattaattaaagtcctgtatgtaaagccggaacggcattgtggctaggcctaatgctattatttctctcatggcccattcctcctccagaggtaattattgcaattttatgtcttgaatatgccccatgtttgctatgcatacctcgtggcagcttcaggacaatcccttcaacccacagaaaatactgtgtgttcaaaagcctgcagtgatcaaaagagactcagtgacatcaaataatatctattctgcatgcaacacccctaaatgtaggaaatgttctgacggggcaggtgctatctttcttcaaatttctgaagacctgcatgaattccaatagtagagacaaaaccaaggctagatgctgtagtgtgtatttcacttcaagagaaggaaacacatttttaacagagatgctcaaagatgagcttgcatggtgggggtactccctgggtattccccatccagtctctgttgaatgactgggattggaattgtcatcaggaacatctctgtatgggggttaaggctctccctcaatatagggtgccagagggttgtaattctcagtgtgaaccggtaattttgacttccctggtttcagtgtggtatcttcttaacttcagctgagaatactgactcactgcaaaatccagtgtttttgttcaccatcttctagttcacctggaaaaatgaaacaccaactctctagctataaatagcctaatgacaaatcaacccagcacagcaagaagctggccagatgcagatttttgataacaaggaaataaaacacgtttctggcaaatgcttgcaattatggaggcttaagaaatgctggattcctggtcttgcaggatacttaaaagatcaggatccttcctgaaaataccacttaatgtttcttttctgagggattatgtagaagccagggaacaccagtggacattcatatgccctctttctaaaaacatgaaggccacatacaaaaataatcaccttgagatctctggctggtgaggttataaagttacaagttttttttttttcttctgtggtcttttctttcttttccaatttttttttttacaatgaatatctgacttttgataactagaacaaaaacaatgaaattaatttagagtgtgcagctgttaaaagcatgtttatgaagactaatattgatatgggaaaatgtaatgttaaataagaaataagacacaggatgtttatatttatataaaccctttctctatagcaaagctcaaatctaaatctatctgtctggaaggaaatgtaccaatatctttggggggtaagattttgggcaatttcaattttcttcttcatactttcctgcatttttcctaatgttctacaatgaacataaagttcttttataatcagagaaagcaataaatgctatattaaaaaggtggtgagagaggattctgatgttggaaaacagtaaaagctagtactatgtttttacccacttcagggagaatcaagttattgtgcctgtactctaggctttgtgagggagatcaagggaaggtgggagcttctgtggaatgcggtgggaccgtgctgtgaacggaacgcaagctttcgtatcagaaagaatggtctattttttacgtatcacgtaatatctcagagcttcagcatcttcttccgtcaagtggggtcaacagtaccctgcttagatatttattatggggctttaataagattatatgagaccagtgcccagcttagcgaagacatttgataaatgttagttcctttctcctgcatggaaaagagcaggcaggggacactttgttagagataaacagttcacaaaaaacagactacgacagggtgaaaatgctgtgttaaagtttctgtctggtttttttttttgttgctgttttttaatcttctgggttccctagagaattatctttccaggcttatgggaagaaaaagatggtattttcttcagtcacactgtcatggtgtgatcctgggcaaacggcctcctctgtgtctcagtttctctgtgtatgatggagatgacactgaggagtagctttgtaatctgactgctggggaacaggatgattctaggcaatgaaactcccacagccttcacggacaccactggaaaaagtagatgtggggcacaggagcatctgcagggggcccagagccctctggggagtatttttccctgatagctggagggagtgtgtgctctcaatggggtgttcccccatatatgggtgacatgaatgtgttgcaatgaccactagtgggagccagagaggtctgtgattaacatacagcttttgaatgggaaccaagtctgtgccaagtgccaaggaagatcctattcacacccaggggctgagacagtgattcttcctagacctcagcttcatcatgcaatgggagaggtattagttgtgaatggctcaaaggtattacattaattatgtctgactgcagttacaattgctgttgattactgcaggcattagcaagtgctctggcagagtcgaccacttaacaggcagtggtgatagaatgctgggctccagtggcttcctagctctaggtgctggggtaagaatgactttggctcagaaagctcaggaaggtgtcatttgttgggtcctcgagactcattgaggagtcttcttgttcactctcatcctggaagagggttatgcttgcaaccgtggggggtgggggtggggctgcacaattaattagttaattatcaacgaagtgggtttattgggcatgtcctgctggtgctaatgtggacactgtgtgaaataacgctcccgacctgcccacgtgttgctgattgactgagaggagaaatcagaacacaagcagtggctgaatttatgcagcagcaacttcctcatgcctgagtaacgtaagatgagggatcataataataataattgctgccattcatcaagctttgcagagaagacaaaggcttttcacattttcctctgatcctggtaacaacctcatgcagcaactaaaacaggttttttgttgttgttgttttctcaaattaaaggaagtcacttgcttgaggtcatatggctcctcagtggggcagagctgggatctaaactcaggccatctaaatcaaatcgagtatttatagatttggttggggagttgggcagacctggtttgaatcatgactctgcctctagcagggtgactttgggcagtcacttaaactctttaagctccagtttctgtatcaataaatgggggtaataattttttataacgagataatgtaggtgaaatgcttagcatagtgccagccttatactagggaatcaatatttgaaaactacatccttagttggctttatcgatactaagggtcccttcctccagcactggactaagtgaaggcttctttctactagggtgcaaagagctagggtgttcgaaggccctcattaagaataatggcttgcttttcagcataatacagccaagtgatttgtaagtgacctgaagaccagaagttttcacactgaatgtaagtgttcttaacttttctgtagaataaacaccccaaagagatcccagattcctgtgggctatctccccgcatggctggccacacggcaggtttgaaatcaatacttgctggttcaccacctaactgtggaccctcagtgtccctccctcgctcatccctcttgctcggggtccgtgtgtgcatccagccagtcaagtgccttgttgccatggctcaggggctcatcagaacagggaagattttatccactcacagggtagccgtgggaggtggagagactctgtaagctttgacacacaggggattctcattacagtgatgttattacaggtgtctggacggttgtcattagagactggaagtggggcccaaatctcttactcatgtagagagcctttggaaaaagccatttggaaaatgcctcgagaaccactgcagcttcctcctttgtattagaggcccttgccctctaacacaaagttgcggatgcctagaccccagctaaaggctttctgaggttactgtctccatcaccagcagtgttagcagctgccagggctcagccctcctgaggtttcagcaccagggtgagggtgactcatggggtagatgaggggcaaccatagttgaagctgacttcagggccaaccaaggcagagcaggtgctcttcaaaatgcaccatctatgagcctaattgtgacctaggggatggagtgagatcctaaaggtggggaggccttggggcttccgaaaacggcagtgagggtgggagctcttcctctgggtttcttagagtaggggcacatatgctgctcagctcttcctaggggtacccaaagccacagggcaaacagggtgtagcttcctggagtgttagccactcaatagtaaataatgaggcatgtttttgtgtccaaacaaataggtatgttaaggaataaaatacagaattgacatttaagttaaaaaaaggggtttgtaaaagaaaagtcaggcttatgacgttctgctctgggccgtgtcaccagacttcctccctgccttgagtgacctcgttgacggcagctgtcccactcccaggagctcccctggggaaagtggagatgctcttgcatctggaggacactgtgggccttgctggccagctgtgtgtggtctaggttcctctcctgagccttctctcatttataaaaaggtgacaatatcatcttctctgggggatgggggcgatgtgggggaaggcccctctgtaaacatgttgggactatatcaaggtatggggttattgttctgtgtaggtgtctgctgatggggcagtggagcaaagggacttttggcagattggaggagggagctcccatgcccatgctggctggggagaggagctggtggagatggtggacaggggtggcagggcccccttggctgctgttaaagcataaacttcctctgactccagccactgagctgggcaacacccctctccactggcaatagttgggagaggggtgttgccatattgccaggctacccagggcagggcagaggccaaaccctccagattcaggctccttggagaaggcaggctccagccttggtctcagaatcatcactaaagtcagataagaagataataatagtaatggctacaacagagtagcagaaaccacaggttccatttttaagcacctaattgtgtctagattcaggctgggcatgtttcatatctcctctcactcatttctcctgacagccctggagaggatactgaagccgagaacagtgggtcgctatactcaaggtctccaggctagaaagtgggggggcttcctccaagggctaagggacttcaagccctgtccttcccactgtaccacgttgccttggtgatgctccttttgcactggccccacatggccagctggattcttctggtcacaggagatggcgtggctgttgggctgtggggcaggagggaggcagctctacctggagccaccaccctgctccgacttgctctaggtatcagcattacactgtgggagccagaggagccctgtgctttctgataggcccaacattatgtcctcctgggcagagagtggacaacttagagggatcatatgctagcttggggtcctgaccgtggtctccaatgcaggaagaggcgtgtgcagagaacagcatgtgtgaaaacaatccccagccagactagctggatctgctcttaatttaggcaagcactgactcctagagctggacttgctttctcccaattcaggcacattctgtcactgcagagatgtcacagcatcagatgagatgggggttggacatccacaggaactctgcctgatgagtatcttggtccccaaatacctgaccaaagggacttgggcttagtgagggagatagagataacattaccctggaatccctctagcttggtactggtccccaactatttacaagaagggttttacaaacaccacaaagtgtagcattgcttggccatgcatgggcagagaggctggtcccaggtgggctctgataggggcttgcttgttcttctaccagtcagcccagagaggggaagtgtgcaatattcttctccctagatggtcatccgttctatgcagaaggtaaactggctccaggaaataacaactttatttgcaatcaagcccatgaggcctcctggaatggcttctccttcctgatttgctaaagtaagttggatcacatggggccgagaatgaggcccacccaatgaacaaactccatttgagtcctgtaggtgagtggcagtgtccccttggtggctcaggagttagacccagtgactactcccagcctgtggagagacgaaggggagaactctttgtttacacaatggggtgggattctctatctgcctgcagaaatgaggtggtggggctctgagttaggtgacagtaatgccagttctgatgcttttgaagctctcatcaactctccccaagttgagaaggttccatctgtctccagcagggcagtgtgacaggaagagcatgaaactcagaatcataagatctaggtttggtcttgtgtttattagctgtgggtcttgaggtgaatttcatgatctggatggggagcccgtgatgcataggatctgctctggaaaacgagttgaattcaatagttatgctcatcttctttggctcctgtcgagagtttggtgggggctgataaaggaaggtccccttctgcttttgtttttcctcggtctcatgccatctgatactaagttttcttactcttatcctccttttcttgactttccacagaagattttgtcactgagtttaataaactttaaaaacacagcagtcagaaaagttcctctctttttcccatcttcagagtcctatttgcctgctgccgaggtcgggggcaagcttcaataagcccaatcaacacagcctgcctctcggcttccctgcttctgcgtcacactgagaggctggagggaaggataagcctgtttccagggatgatcaccagcaccctgaaaagtcttacaaaatcaatcagagagcaatttacagaaaaattccctgccttcgggtgccttcctttgagaagggcttcagggatggatggccaaggtcaactccaggggccatggcgtcttctcacatccctctgggctacatttgctggttttaatgacacaaaggatgggtccccttttctccaggcccatgtagacgtggaaggggcccgctggtcaccttctgcctagatcacagcagctccccacagctaatccaacctgattccttttattgctagaggtgacgtcaggggtggaaaggttcggctgtgtcccaagatcccagagggtgtgtgcacgcatgtgtgtatgtgtgtgtgtgtttgcgtgtacatatgtatgtgtgagaagaggggagacgcaactgcagctctggccaggtaggaaaaccagcattgaggaactgaccaccacaaattggggggatcccatctcatttttggatcaaattgcacttctgtagctcacacaagaaaaactgcttccatgccttggaggggaaagaaaatgaggaaagtccactttttctccttgcaggcccagaaggcctgagaacgtggtttaaattattctagtcacaggcaggctattcaaataaaatagaatttcaaaccacacggggcttgttgagacattcaggctgctggggtgtgtgaaaggcagggggctggggtggtgtcagccgccactctgccgtgctctttattaccagcggctgcaatgccagacacatccgcgggtgtctcaaagccgaggcggattcgagcaggtctgacagcaagtgagcacatgaaagccactgcaagccttccctccccggtggcaactttaattatttgaactggagctcagaaaaataaaaataaaaataacatcagaatatattgtaagtggctccccagtttcctgcagagaagagcttgtggcggagaggaggaacacaaaaagaaaaccaaaaccacagcgttctttcttgtttgtggctgggcgaggcagaggtctttaaatattcatgccccgtgtgtaactgtgcagagagataggaggcagccgtggtagtcagcaagagcaggctgcaggagcctggagggaggaggtgggagtggggcaggcttctggaatgccctggaagttagattggcacaaaggcacactgtggctatgcctccatcatggggggctcctgacctggtttcatatgctctcccacccgcttctcttctcccccgcctccatcatttctcatcccttttctgactcatctttctaaaagacaagtgacatcacgctatttggggccacagacaggaggaaaactctctgcatgggctcagaatgaatttcagtcacaattggcaagcacacctacggccaatagctctgaagtttcagtgcacctccaaatcaccaaggatagggtttaaaaatgcagagccctgggccccactcttcgcgatgtcattcagtaggtccagggtggggcatttgttacattttccaggtgaatgtgactggtgaaacacagaactactggttaactcactttctagactttgcaggaaattcttgaagatgacaccagttcttctctgggaatccactgatgattgtggtgtcttgagatagtgtacgatgactttaacttcccggagaccaggactgagctgggtttgaagaaggtccttcgtggtaggcatcagcctcagggctcagctggaccagtcgccagtccctgtaggcctgatgctcatcagagtcctgtccccaaaactctgcctagtgtccatctttctgcactcgggccccataggcaacagaggcccctgtagggttggtggggtttgaaagccctgagtgaacctcacatagtcccccagagaaatgcaatatccatttttttctgccactggggtttagcccgcccgggaggaggaaatcaacttcctgcattctgcatttaggattcacataaaataaatggtagggcttacaaatctagaaatgcatatttctattttggttatttattttcctgataaaaacatttctcccaacattgggaattcaaagacccatcagcattagacaaatggtctgaaaacctgaatgtgaaatcatatgaatatatataaatataaataatgtgagtgtggaatggacttattcccttcctttcattatgcctgctgagccaagttctggaaaagggcagggaatagcagaaacagcccagagcaaattagactgcaggaaaaataaaacaggccagtaaaacgaaacacctgtttaagctattgatcaactcaaaggttattagagaaatgatgaagtattagaataatatcatttgtaccttgacatttctttttctgaaatttggctcatattaaacccagcgaagagtaaatttaaagaccaaatgctcttaaggatcctcccgtcctctccggtgggccaaccatctgtcttcatttatatgttctctcaaaaagccttcctttctaggtacctgctctcagacacctgagaaatatcagcaatgactgtgtaattccaccatctgcatgagatagcatggtttctcaaacacaatttaatttaatgaatctatttatttgtgctcagaattcttccaaaaaggatttaaggtggttcacagagatacataaaatctagtaggatagcatagcctagaagagggtgagaaggaagtggcgaatgtcgagttataaaatcaaaccaggagtaagctgctacaaattgcatatcacaaagtcccatttgcttgccaagtggagccttggttttaatttaaccactcctcggattaaaaaatcatttctacatcttttccattcttatttgttttctgtctgtgagtttttattttatgagaaactcgaggggcttgattctgcctgcatcccttagcaggggcaatcctgttgtctgtccctctgctggccacagaaccaccaccctgggatttctattagccacagaaggagaagtgaatctggtcagtttcacaatgtctacaacttgacaggaaacaaattgctcagagggtgcatagctattcctgaaactgagccagacaggaatttctcctgtgagtgtccagaacgagatgactggccaaacccaaactacgtgtaggttttctactacacgcaagatgttgatgcaggtgcagtgagggagtacaaagaagcacaagacatggcctgctctcttggagcttacagtctgatttctggctcaagttctcttcctcttcccccagtgtccttctgaatgttgatacagtgtgccaggcaccctgtgggctaaatactgcagtgcttactttgtgcccaatgctcttccaagccctttggacattatctatttaatcctcactcttcaggataggcactataaatgtgttcactttcccagtgaggaaactgaagccccaagaggttaattaactgcccaaacaaactatacaatcaatcagtggtggaacccgacttggactcagaaatttgattctagagtccatgagcttaatcactgtaccatgctggggtcttaagtacatttcttggcccctaaagaatatgactgtatgctaaggaacagggcgccagtccctccacccacaccaatgagataacagcatcaggaaccatttgagagagtagttttggaggtacctcactgaatgccattgatgtcttagtgaaatttatgtaaatcaaatttttgaggatgtatagtatttacaatgtattacaagagctcaatgtttttaaaaaggattctgtagaaagtcttttgcaatccttgtcactctcccttgttatgccatggaaaatctcttctgggtttgattaaatcatggttctactgcaagtagttcagtgcagctgggtatggctgtttaaggcatgattctctgtagatagggctttaccatgttgatggacatgctctgcctcgaagatggcagaggtggccctcttgttctctccccaggagaacgaccagcccagccagctaggctactttcttaatctgggttccggaagtgacaagaggtgggaggagaaattagagaactagagaaacaaggagacttgcctcacatggagagctcttgatcggtgcaggaaacgtagcactggtcactgtagcactttcagaagcggggacatcagtggtactgagcaatagagcatggtctaggagagaggaaaagaatcacaagcacgccattatcaggaactgggggaccaggggtgcagggttaatggactgtgcacagttcttatctagcctagggatatctttgaggaaacaggtttctggcctgcaatggagaagaaagcccacctgtcaacaatttctttttttttttttttgagacagagtcttgctctgtagctcagaccggagtgcagtggcgcgatcttggctcactgcaagctccgcctcccgggttcatgccattctcctgcctcagcctcccaagtggcagactacacaggcgcctgccaccacgcccggctaattttttgtatttttagtagagacggggtttcactgtgttagccaggatagtctcgatctcctgacctggtgatctgcccgtctcggcctcccaaagtgctgggattacaggcatgagccactgcgcctggccaacaatttcattctaaactgcctgtgaggtcccagcaccatcatctgggctaccacatccctgatcttccaaggtcaccagctttagcccatggcccaggactagcctgaagcacactggcctccccagctccaccctccccattttcagtcatgcgtggccttccagtggtttctgtgaccttcactctcttctcccctgtccagaacccaggtcgtcctgtgcccctgcccatgaagactcacttcttatattttctaagcatggctctgcctgaaaatctgggagaacaggggctcccatccacacgtggtggtgggaagaagcatctgcaaactttcagggtctgcagagcattttgtacgtggccggtgctgtggtatgagtgccattgtgagctcacaacactttagggggccacagaaccccaagcattatactttagtctttcctttctacctttctgcctctctcagtaaaggctgttattaagtaacaaattcgggtgggtcaagggcagagtaaccaagagatctcagcaagcatgagggagattcaaggagctggcattgtgtgactggggacagaaaagccctcatgcaggcaggcgggtcacaattgttcccttcagatttctgaggggctgccttggtgggagagggggtagttcagttctgtggggctccagggggcaaaaggcatgataaatgagtagaagtcatggagaggtggagcttgcctccaggtaaggaaagctaatctgtgattgagaacaacagcatgtctgctctaggaggcagtgggagccctgtcactggcggtattccgcagggctggatgcttatttgctatgggtgctgtagtggaaattatcaaactgggaacagagacatgaagggcacatccagcttggaactccatttctctcctctgcgtcttttacagacagaatgctaagaaggatgctgctgcacagtggggactgagccaactcactgttcaacaaataagcattggagggtctctagttccatagaaagaaggcaaatgaagaggacagaagaaggagagagaccttcccaccccatcagccctatgctgcagagaggtgggcaccagggcctgcccgggtcccaccactagggacagcccccaaggctggctagcctggcctctccagcagcctaacgttgggagctctgctggccatatagaccctctgtgatcccacatcctgcccagcctggtgtctctgagtctggagtcagcttacccaggaggggctggctatctcttggctgcgtggaggccctttgctctctgccagacacgcagggtttgtggggaggatggaccccggagaggggaggacaggcattactagcttaaatcaggggtgaggtagggggatggctggagaggctgtgctgcagggaatggaccatggaccgggtatagggtgaggctccctgggcacaaccctggggcaaatgacacaaggacttgctgtgcctcagtctccccagtcataaagagggctatggctttccctgcctctcaatgaattatgtgcctgacacataggacgccctcagcacatacttgttgatggaaaggattattatcgttgttgctattatctttttgttaatccctcctcatggttcttattttaagtaaccaaaggtgacatctatcttggccagatttaatcactcgaaagcccaaggtgtgaagagggaattgtgtgtgaacgctctaggcaagctttggtcagacacccgagcttgccctgcaggtggggtgaagtccagccctgagtctcccatctgtctatgtgggcatgaagatgggcaccagagagaaggcaggagagcagtagtaccttggtggtcctggaaccgggcatcctttagggtcctgacctgccattgaggagtgtggggtgacagtgtgccttgggtccagccacagaagccatcttcaaagttgcagtaaaaacccacaggcagtttccctatggagagagcagagaggcaccatcattttcaggaccactaaaggcaaaatatgccaatgccaagtcgaattagccaggcatgaccaaattatcttcattagtaatatagctccccagccagaatgctggatgactaatgacactgattataatgaagagaagcccccaagccctaactgatgcccgtgctggtttacagttttcttatctacagaaaacaaaataggaaaaataactcttcagcatgggtgttgttagtccagttgtatatctgacaaagcagaggctcagaaatgtgaagcaacttgaccaaggtcacacagctaacagataacccagttaggactcgaacccaggtcttctgcttctaaattctgcactctttatactcagccaccatgaatgtgaccccaggagaagccactgtatagctcactacatttctaatggttgatacaatgtccagactgtggtggtggttgtggtagtgttggctgggggtttgtctgggtccatcaaattacctgtctgcagagacacatattgctcaaaactttccatttgctttcctttctctcccaacccgcttgcagttaagtgaagacatatgatgtgctctggccaatgaaatgtgagtggaagtgatgtatcttctctgaattaaggctgctaaaagcccttgtgtaaatctttggtctctctgttcccttgctgaaacaaccaatgaaagttcttgttcctaagggtgacactatattgacggaggagcctctgccagcctgggtccctgagtgatcctgtggagcagaggcccctcccacccacaccctcattggacgggtactgtaaatgttatcccaagccactgagatatggggtttattactgcagcataatctagcctgtcctgatcaaacaatcccagtcattggggcctctttatatcatcagtgggctcagcacaaagggcacgtcatctttttctctacatcagactgatctcaggtcctattgaagaggtgacagtcagctttctagactgtatatttcccaactgcccacagaaggaagaggaaaggataagagggtgagggagagagctcactttctccagctcactctgagcatggctccaggaaaggcactcagccctaaggagctagtggcctattccaggcgattctgatggcccccaacacctcccagcctagctgcagagaagcctgtgtctccatgtgggaggaaagaagctctctagctgagacccacagcactgcatgtccttcctctgtctcagccttcttggcagcagcaggctgacaaagagggccctaacgcttcctggctgtgacagcaccttagtgaattattactcatttcccccagattctctgtgcatttcacacagaggcagaattataaattaaaacaggctgtcactgactttgaacatctcttcccatttatacccccctgaagaaataatttccccctaagccccacatgtttctatgattaaaaatcccaaagctaagaagaactttctgttttattttttatttccccctcaagggatcccacatctacttctcttgcagaaaccaactggtggaagtgaccttctcatggagtgtccttcacaagtgagttttaaaaaccaaggcccgacagggcacggtggctcacgcctgcaatcccagcactttgggaggctgaggcaggcagatcacctgaggtcaggagtttgagaacagcctggccaacatggggagactctgtcttgactaaaaatacagaaattagccgggtctggtggtgggtgcctgtaatctcagctactcgggaggctgaggcaggagaatcacttgaacccaggaggtggaagttgcagtgagccaagattgtgccactgcactccagcctgggcgacaagagcaaaactccatctcaaacaaacaagcaaaaacaaacaaacaaaacaccccagggcccatgatggaagattccagtgggtgatggattcctggaggaaggaggaggccggcctgaggtgggagatgcacagtacgtcactccctccttacccttttaggaggcagagggagagaactgagcctggatcatgggtattgttagcacaacagcactggaatccggacatatgggctctagttctagcctcaccacttcctgctttgtgaccttacaaaagtcccttcttccttagagcctcaggttccttatctgtaaaatggggcagtattagtgtctattttactgagctggtttgaggataaagtaggggagagagtgtggaaacactttgtaaacagccagagaggtgcaaatgtaaagtggtggtagtgttattaattgccattcacacctaacttggagctagttcttcagagtatggctgaaactgacagcaagtccctgcctggctctctggaaatgcttgttggaggctgcatatgtgatagctctgcctatgcctttcagctggacagaagaaagccactgaagaaagccatcagcattctctgtctctggaatcccattcttgtttcagcttggcatagaatccagggtgagctgggagtggaaaccccttttctttctggctgactcaataacgggagaggaggcaggcaaaagagcaagacaggccagtggacaattgatgtggcaattaaaacccctaagggaggaaggagagctgaggatttccatgattgtaaactcatcagggcagcttgctcagccagaagccactcctgaggaagctggtgggttaaggttaagagtcggaacaaagacccctgtggattaggctgcaactgggaaatcaccactaaggccaattgctgagcaaaaggttggcctgcaggattgggtctaatggtatcaactcatcctctgatcatccttttctcttctcattcgccccaagctcctactcagtcagcacactggaagacttcaaaacttatttgctgaacaaaaggggagtgggctcaatcctctaactctttaccactcaaaatgtggtccagggaccagctgtagcctcatcacctatgaatctgtaaaatgtgtggaatctcaggccttgccccaacccactgaatcagaatctgcatttttaagaggctcccctagtgactcctgtgcaccttaaatctggagaagcactgttctaaccaacccccttcttgggctgtagccagttatttcattggctggatggccaaatcgcgctgtgggtaggtcaatcaatcctgcaacatttggcaattatgacacctgattccactctaagagagacaaattggtacagtcatggagctgtgacctcagcagcagctgtgggagctgccaagtataaactccaggccaaatgacactacttcttttccttcctgcgtgacaactctgttaacatttttgataaatatgtgctatacattttcttgaaaatatagagtcatgggaaaaatgctagaagaaatacatcaaaatattacagttatctctgaatgtttgagagggaggattatgggcgatagttattttctcttgtgtacatttctagattttctgtattttacaaccagtatgttttatcttacaataaagaaatacacttttaaaacactgtttttgcctggcaggaagagtatccccagcacacagatgagattatcaagtccatgggggaaaagtgatctgtctgcaatacctagtgaatcactgacccatctaggggatgaaatgggaacatctggcccctttctagggagccacatgccatcgaggccattggtcagaacgcagagagagtcacgaagacccccttcagtgcattacagcatctgggatgtctcacttggatttggcgatgtttaattagaaatgcaggagtggctgtattggagaggggaccgagagtactgtgttggagtgtgggtttggaggagagagtacagtggacatatgaggatcatgattggctagaaaaaggcaagggaatgtcacctccatctcaggccctccactcatcctggacaactgttagaatttttaagggctccaaagagatccagttacgttgcccagagtgagtctgataatctgtttgcagccccagcatgtgcggaggactccctctgggaaggtgtggggagttgaggctggcttttggtagggggagttgattaaatgcaacctactttccccttccaaattccaaccatggcagggtttggtcaactaccctggcccaagatgaaagaccctcaggaaggttctttagaggacctggccattcctaacagagctgcagtgtgaacacctgctcagaggaaacattttaacaggttccagaccacctggaaagagctggtgtagtcaagagtattttcctatgatgttggtgttgattctggaaaccatccccctgaagaaaataataacatgaataatactggctaacatttactgagcacttactttgtgccaggagctgctccaaacacttcctgcttgtttctcagacctcagagtgtcagtaggcatcactttacagatgaggaacccgagacccagagggggaggcccccagagaaaggcggtagcagggccctggacctccctgtctcttcctggccccttcatcctgggtgtgtctgtggctaggttcagtgcttatcatagctaagtgctggaagctcgtgaaacagagtttaccctgcagtggtttgagtgtggctctgaagtcagactgagcctgaatcactgctcagcttctggctatcagtttgatcgtggacaaccacttaaactccgtgagcttcagcttccttgtctctaacaaagatgggtacaatagcatcacacaggatgttgtaaggatgaagcaagttcctacatgaaaagtgttgagaacagctcctgcctcatagagtaaaggctcaacaggtaagctggtgttgttgctgttgttatcttcatgggaatggttttcagagtcaacattagtgtgatggggaacacagcaaaaatgccggaaaggatagggcacacaaataagaaaaaggatattttctaagagttttgctaagatctgagtgggaataactctcctgaattgaacttccctcccagcaactgctttctgtagccaagaacacagtgggggtgttctccagggtggaggggttactctgacagcttgtcagagccgcttttcaaatgtggctgaaaaagcctctgggccccaggttcttgccctcagtgcctgaagtagactgccctgaagcttggagctggccaggaaaccagtagtggtaagctttggagtggtgggaaatgccctgagcccatagtaatggactggatcctgaaggttcagggctctaatctgtccctgacatgctgtgtgaccctgaacaagtcaattgccttatctgtgccttcattttcccaattgtcaatcagggcatggcctgcccgacctgtgtcccagctgggaagtaggtatcaaaaaacttgaaaaaggcaatcgcgaaatcacagagttcagaggcactgctggaaacactgcagacacaaataaatagagacacacacacaggcccctgaacagggcactgtgggcaggactggcttcactttgggccatgtgtgtagtgagaactatacgagaaaggccaggagcggaacagaacagggtaagcaaagcccttccctgtaactctttgctgagttttatctaaaaacatacaactattccattatcattggaaaacttcacttgaaagttttgtatagaaatgaagttttaaaaatgggaaaatgaatgtctttattgcttaatttaaatgagaataaatgaaaccttctccaccccccacaaagggtccagatgactgggggcagagggccctgttttaaaacgtattttggaaacttccttgcaggccactggggtctgcatatctgggaggtgaggcatttgctccgggtctgggccccaccccaggcaccattctgcctcctccttccccagtccaggctccatttcactcccgcccctgtgtgaagctttcagtgctttgagggaagatgccaagttattcatctctgctccaggatctggcacattttccagctgcctgtaggtattctggaagcgttggtggtttcagtggcaaaaacatcaagggctctgcggtgattacttctggagaggcagctgcggggagcaccatgttcaagtgcaggagcaccagctgggagtctactccgccccgactgccagtggggcctcggcaatttgttttcccctatggagtccaagtttcccaactcattctttcctctcatcaatgaagagtcagtaagcacagacgctgtgccaggaatcatgagaggtattgctatgggaaagatgaccagactcaaaccacccacagagaggaagagagacatggaaatcacctccataaaacataatggatgcatgcccactaggatggctaaaattaaaaagacagataatatgacgtgttggcaaagatatggagaaagtgggcccctcgtaggatgctaaatgcccagaataggcaaatctatagaaacaaagattagtggttggttcaggctaatggcagggggtttggagcaaaatggggagagatactacaggttccttttcggggtgataaaaatgttctaaaataaaattgtgatgatggttgaacaaccctgtgactatatggaaaacagggaattgtacacttgaagtgggtgaattgtatgtgaattgtatctcaaaactattcataaaaagtaatggcaatgatgatatttggatggatccactggattgtgggggaaggatccagagggagaagaaccagtggtacttgtgggggatggccagggaggctttctgaaagaatcgactcagggcgagtcttgaagtagatgtgactcgagaaaggaaaggggagaccatgtgagcaaagccatggaggcatgaaggatctgtaaggtggttccatacagccggagctggggtgcatggaggagggagaggatgaggggcaggtggggaatgggacttggaaggcgagggaagtctgggcatagaggacttccaatgtcacattagagctgggctttatcctgcacattttctctgtgccttgaggatgctgatagcatcacttacaagatcttgtttggttcttgacttatatgactacggaccaggctatttctagaccacaaatcttagctctgcctcttgaagactgtgtggctttgccatgagaggagtcacaagtgtcagtggatatcaggaaggctgtccatgctctcatgcctgggataatggggacaacggggttatgagcatgggctgggctcaggcagggtggggcagccccatctactcacggcacatctggctctcatcttctccctgggcacagtcctggtggaagtcacaggcctgcccaagctggaggactgtcccattccaacaagtgaaggagctctgcagggccatcttggagcctggggatgttcctggagagcacacagacacacaaccatggtaagtttgcatggccccaggcagcagctggcctgatgggttggtcccatgggcaggctgcagggacagcattatcctgccctgccattcacactccaaggcctgattgagacatctgcatctccatctggccaacccagggccaacatcagcagggagaggggtcaaaacccctcacgctcatccatggcctgctggggtatctcactttctaggaaggtgagcagcagagtggtccatgttccctccatgacattcctcctcgggggtcctcaaacccatgactttagtgtgccaagtggatggcctccaggtggagtctcacctgcacagatagctccaccctcaaggtcaaatttggggtaccaagaggtggatctggtctagtgcatgtcccccatgttcttgaccccaggttctaccactggagtgacttattgagaagatattagaaagatgcagcactttctgttctggaatgcaaagaacaccatcatgcaagcctgggcctcagatctggacttggatcctcctgcctggctgtatgaggctgaccatgtcccttctctgtgtggcccctgtcccatcctctatcaaaggagggatttctattagattgctaaggtttgctctagtctgaaattcctagataattaattttatccagagggggaagggatgggggcagtttataatgaacatacagagttatcagtttctggattaagaacaatgcattttgataatgaattaacctgtgaccactcacatctttgcaggccccagagattcagacaacaggaaggagaaggctggtctggcttagcctccctgaccaaatggagggctttgcctggggaccacctcacaaggcctggctggtgcctcctgctactcagttcttggctgatgtcagatggggagactctggcccctgtggagatgagcaggtagggctcacctgggtcaacaccccgagtgagcctgccttactctctgccttgttttctagctctatcctggtcatagctggtgctaaacccatctcagtgctcagggcagtgggggaagatgaactaggaccccacttggctaagtcccccagcctctctgagcctcacatgggggtggggcctttccaactctggctgcaaatcaaactcaactgattctgatgaggtactctccaggttaggtgatctttaatatctaaaagtccatgatttcctggttcaaaggactcttcctaatagcactgaaactaacatgaagcccagcttgtttacttctggaatttctccatctactttagcacatctggccctgtgaggaaactagacaggtcttaatgatgtccatttcctaagtgggaaaactgaggtcagagaggttcagtgacttatctcaggccccacacctggtatgtgggattcacacccagcttctctgactgtaaaggtgccctctccatctcacggaaggagatgctggaggtggccttgtgccctcttttctagggtagtccagataaggcagagtttgtcagatgacagcacacggccacccagcattgtccaccctgcctcctactgggcattctctgcaaatactagtaatgggaaaacagatcccacctccttccagggaatcatatctgagccctttcacctgctcttcaaggtccctgtgatctgggcctaagttgctttgcctctccctctgcctctgctcatggactctgtgctgcaggctcccagagggcgatgaacatggtcatgtgatggttgtgtgatgatgcaccccatactctgctgattgaaatcctgccgtccgtccaggtccagctcacagacactgcctggcacaatcctcacaccttcctccccacctccatttggggagctgctgcttccatgcaacctgcctccagaacgcttgtgcacaatcccatcatcttcatcaagttgtgtgagcttggcgttcaccccaggcctagccagtgcctggcccctaggagggttcatgaatgcctgcacattaggttacctatcttcagtaggcggaatagcagacccccaaatagacacatccgaatccctggggcccgtgaaaatgttacctatgtggtaaaagaggctttgctgctgtgattaagaatctttagctggagatattaacctggaatatctagggttggggggtatgggcaatgtgatcaccagacaagacagtcaaagtaagaagtaggggactatgagggtggaagcaagcgtttggagtagtgggaggaaggggtcacaagccaaagggtgctggcagcctctgaaagctggaaaagtcaaggaagcgattctcctaaagcctccaggaggaacctggcctgcctgacatgactttagtccagtgaaactaatttcatacttctgccctccagaactgtaaaagaacaaattcatgttgctctattacgttcgtggtagtttttacagcagcaatagagaatgaacactccatcgaaacctgactcccgctgaaatcccagacagccgaggctcccatcactgggagcccagagtagatttagatccacttctcagtgctctaatttgtttttgtgactagacctttgtggtcccctggactattcatctctacctttttcttactcacacagaaggaaaaacaccactccattcgttcctgggcctcaagatagcctaagcaaggtttccccagataacttatagattctaagtgcaggaaaatgcacaacaaaaaattacccttgaacaatacaggtttggacccacttatacatggatctcacccaacacggatggaaaatacaatatttttgggtttggcagggctgactgggcctgtgcagatttgggggtcctggaatcaatcccccactgtatggaggccatattctcagacaaacacacaggatcaaagtacagagggaacaggagaacgagatacaatgctcattttaggatgtaaaatgtcaaattcattttgcagctttaattttgggcatcaattctttacctatcattcatgtcctcttggaagctagaaggtaaaacgcctttctgcacacactggtgctggtcccacggaaggtgtggtctccctaaaacagtgggagaagatgcccccttgcctggggagctgacggggctgtgtcccaggagtcgagagcaccccagaagcagcacctgcttgctcactaaacttgtaacaaccaggacagggagttctattctttctacttagtaggagaaaatggggaaggccagtgtcctctttgcccctctttcaaggcacaggtatttaggataacaagaaaagttctcacatttgcttggtgattttgtttccaaatcactttttcttatgccttaccacaggagaccattaaatatagttaagaccttattaccctcactcccagccctgccacagaaaacataagtgaacttaaaaatcagccaggcgtggtagctcacacctgtaatcccaggactttgggaggctgaggtgggcagatcacaaggtcaggagatcaagaccatctgggctaacatggtgaaaccccgtctctactaaaaatacaaaaaattagccgggtgtgatggcacgtgcctgtagtcccagctactttggagactgaggcaggagaaccgcttgaaccagggaggcggaggttgcagtgagccaagaccgcaccattgtactccagcctaggagacagagtgagactccatctcaaaaaaaaaaaaaaaaaaaaaaaaaaaaaaaaaaaaaaagtctatgaggtctccctcaacctcctgaacaaatctaggctatgtctgtttcatccacaccttatgtcccaatgggcatgggtgtttcacacaccaatcacctgtcattcctcaaagaggtcttacagcttcttttactttccttcattctaaaaacagaatccaattgtctgaagttcaaaagcagggtcaaaagaaacaaagaaaatgcccagaatcccaccacccagaggccaccatttttaacatcttggtagatttctctttggtttagtttcttctgcccatgctttataagtatgtatagttgtgtcatacatataggccttaaaataatttaggttgtatcacaagcttttccaaaggttttaaaattttcccataaaaatcctttttaatggctacaatattgtgcaatatgtcccatcatttatttaaacattattcaatgattgggctgctagtctgtttatgatgacgctttgaagaatatctttgagcgtaaacctttgcctgcactgcagattattttcataggatagattcccagaagtggaattactgaatcaaaaggtataaacattttaaaggctcttaatacagattgccaaattgctttctagaagttaatccaatttacactcttcaccagctgtgttcatacaggcacatccctcatactacctcctggccaaccctgagttttaccagaatttttatttttaactaaaggtatccctctgctgttttattttggatttctttgatagccagtgaagttgggtttttttgtttttttgtttttttttgaggcagagtctcactctgtggcctaggctggagtgccgtggtgcaatctcagctcacggcaacctccgcctcctgggttgaagtgattctcctgcctcagcctcccaggcagctgggattacaggtgcctgccaccatgcctggctaatttttgtatttttagtagagacgaggtttcgccatgttggccaggctggtcttgaactcctggcttcaagtgatccgcccaccttggcctcccaaatacaggcataagctatcgtgcccagcctcgaggttgaattttttctcacattactagcttttttttctttccaaatttattttttagggaattgccaacgtatcgattaggttcttcctgttttcatactgagttgtatgaggtcattaataaggatgcaaaactatttatcatatgcgtgacaatttttcccagtattttatgtatattttcattctgtttataatgtattttgataaacaggcattttaaattttctgagacagggtctctgtcacctaggttggagcgtcatggcgcaaccttggctcgtcctagccttgaccttcccgacctcgggtgattcttccacctcagccttttaaatagctgggaatagaggtgtgcagcaccatgcctggctgccttttttttggagagatggggtttcaccatgttgctcaggctggtctcgaattcctgatctcaagcaatcctcctgcctcagcctcctgaagtgctgggattagaggtgtgagccactgcacccagcctgaaattttcatgtgatgcctccctattcatattttccttggtgatttcctcttctgtatggatgcttactgagtttgttccatgtgggatcagtaggtcacatgtgggttatcctttggaatctttggcttcccctctcctctggggacaccttccaccaactcttcctctttcggccctggggatctagatctcaccacctcatctgtgccattttcatggattctcccctccatgaatgtccctttcccttgggtacattacttcttcttacaattaatgtggtagacactgctacatatcattactatggcttgtatgcctgacttcctcatccagctgcaagtgacttgaagggggaggtgtcaagtctcaccttcaagagcctcagacagtgtctggtataaagatctaaattctccctatttgggaattgaactcatcctgtgtattagctggggaaggtctcattatgtccatttgatagttgagaataccaaagctccgagtggttagtggctggctgagagactgatggaaacccactgatttagatcccttgttctctattctttatgcggcctccaaggagtggtaatggtgggcatggaaggtcaggctgtcagcatccctgcccttcacccacacaccttgacaaaggaggaggtccaggagcaggagccagtgtggcttccactctctgatgccctggattttgtccccaggacctgtcttcctgggtggaagcacagcagcagcccagaggtgcctacgttttcagcactgctaccaactccgcccagtctccttccccgaatggagatttccaggctccctggcacggccttctctgtcccacagggagctttgtgcttgcagaagagtcaattagatggacgcctggtactgtgatctctactgccagcccaagccccaaactaacgaggcacaacaaaaaacaacgctctgtcttctcaagttctgttttttatggggcccataaattccaagaaggaatgtatccttggtgaatgattttaatcaagggcctgagttcccaaacagcatcttctctgtggttataaaatgattgttctggcctgcggtgtagagtatcctgaggccccggctggccacagcctgcagagcaacgaggaagggcagtggcttagacgtgaaaagccagctcctgtttcccattgacacttctgatgccttctgcccatgtggttcctggtaaccactgaaacacctaaatgccctaataggcaaaagtaagggagatctgagatcaagccactctgggaagagtcggtgcttggggatcttttattagtgagggtcctttctacgggaatttacatattagcctttgaaatggcacttcccccagactaacaatgtaaatcacagggggttacctttatatagcattttaatagcttacaatgtgttttctttacccttcgtttgaatctcataaaaactggaaggaccgttagtaatatgctcatttgattaatcagaagactgaggatgtgagagcctacacaatgcacagagaaatgatttttagacaacaaagaactacagaaggtaaccagtgacttactgggtactttgcaagtggtctcacagctagtaaaccacagataggggcccaagacctggtgagatgatccgagctcgagttcctctcccatgactcagattaaattgtcttctaggagaggctccctgactgcccatgggagtcacttgggaagtaaggaatatttttgatgttcaggccaatgaaatcagtatctctggaggatagactcttggcactggtggttttaaaatttctgggtgccgtggcttacacctgtaatcgcagcactttggtgggctgaggtaggtggattgcttgtggtcaggagttcaagaccagcctgaccaacatagtgaaaccccatctctactaaaaatacaaaaattagctgggcgtggtcatggacacctgtaatcacagctacttgggagggctgaggcaggagatcccttgaacctgggaggcggaggttgcagtgagccgagatcatgccattgcactacagcctggtgacaaagtgagactgtctcaaaaaacaaacaaacaaacaacaacaacaacaacaaactgttcctcaggcaattctcaggggcatatggttgagtatcatttccttggaggcctggagatcttgggctgagatgcctctgtatcagggatgggttcttcacctttactatcttcactgttgatctcaaatcctgcctcgaaggtcccttccttctctgatgtcctgttctgggcagtagctgttggtggttgcatgtttatgaggttgattggatagagttagtgtcgactttattaatgctggctgttgttaatgactctcccctgaagccttctcccttccagggcatctttccaaagccacacacccagcaaacttgcctctcagtgggatttcctgtctcagtcatctgtcacttgcatcctggaacatctctcctgaagcagcaggccacatttgtttgcccatttatctcctctctggatatagtagaaattagttcagatttgcactggagacacatgtggcccaggtcaggttacatgaattcctgttctacaccacaggtgatttattgggttcactcactgagaatgatgcctcttccctaattatgcattcgaaacagaaacccatgcatcctctgctctttcaatcgtgttttagagatttgatgctacaaaacctacacaactctcctaacgcaaatttctttttttaaacgaatgccacattttagggcgcttaatttttaattagggtgatttatgtgtcattttaaaaaggcacatttctatcagctttctggccatctcctacctgcttgctcttgcctaactaatgacactcgttaaaggaggaaatttgagtgctgcttcagtgagaagggggtcttgctcttcaattaaagtgaggggagacgacacgtgggggaacctggtgtctaggggactcaggtcaaacctggggctggagctggagtctaggggactgggccatgatctggactaggaaaatcaggctctcaacagcctcaagacatgaaaatggatggtgacatgatgagaatgtagtcgagtgcacagactaacagctgcagattcctttctgacgttaatgggggtattagaaggcctgagaactgtgtaaattaagcctggcagagaccagtcctgctgagggctttgggcctcctcagttgtagtgtggacaacctcattaaagagctggcatcttgggtttctatgactcaaaatgtaaatcagcgaggagcgggtcttgctatggatggctgctggtgggctgggtaagaaatcatgattccgggaagtgggagagttagtttgaggcctagccttgccatcagccctctgggaccatgaacaagtctctttctctctgggcctcagtttccttgtttgtaaaccctctaaagccagccattcatagttgccatgggcttaggctgttgcattaatggtgtgtccacacacgcctatatcagaaccacgcaggagcttcctgggcctgacttcagtcctatagaatcagaggatctgggtggggagcttggaaaaagcaggtgccacaggctctctgggtgataattgagtacagccaagtctgagaacctctggtgcctgagaaatggatctttagttccttctcctcgcagaggaattccaagacctccagcacttctcaccacccccaccgtctcattgcaaggattttctccttggtccagtattctcaagagcgcctttcgcccctagtttccatgtctgtgaatactcttgcaggcccaaggacccactttgttcagtttgtgttgatgagctgcctaaggtatagagaaaataatactaggctccagcccccatcttctactagctagtggggtgaatgctgacatagcttgcagttttctataaattggggatgctgcctaatgtacaagatttatgtgaggatgaaacgaaatcatgtggacataacagaatacatgggttcttattatgggctaacttcagagactatcctaaggactttgagaggaccagctatggagggtggatgggaagggggtcagtgagggggttacagaggccagatcttgggacagagagaacctttgggtgtcctcatgtcacacagtagagataaggctctgttagatccttgcagcaaaacaataactgaaacaaatgcaagagtcatttccaacataaataatagctatgaaaaattatacttgcaatgatgggttttcagcattagttgtctctggagtcacctcaccaccagagtcagctttctgaggtcagctcctttttggtcctaatcttaccataaacctttgctggtttctgtagcattcagtccaaatcccagctctgccatgtcccttcacatctttagctaaacatcgggatgtgcagttccttacagcctttgtgtaactttgttccgttgtctagaatcatcttgatctcaacaattcctgctaatttggatgccactttccccaactgcttgctcttctctcttgaagaaagacacgcatctccctctggggtgctgatgcatacctttggctgtgccttgcctcactttattgtgtgtttatatctgcattgccagcttctcccactaaattctaaattccttgaggcagggagtccatgtcacttattcagtctcctcaagagtgcctgtcacatagcaagtgctaatgtatgtagtcaaataatacaaaccagatcaccgagtttcagtagaagaatgtcgtgaggtggggtttccttgcattctgctaggaattactcattcctttgggttgcactgcagaaattgcacccaccttccccagtctccatttcaatctttgagcttctacaatgtgcccagcactggggtgacagtggtgaagaaagagcaacatggcaggtgtggtgtctcacacctgtaatcccagcactttgggaggctgaggcgggcggatcacctgaggtggggagttcaagaccagcctggccaacatggcgaaaccctgtctctactaaaaatacaataattagccagatgtggtggcatgtacctgtagtcccagctacttgtgaggctgaggcaggagaatagcttgaacccaggaggcggaggttgcagtgaactcagatcacgccactgcactccagcctgggtgacagggcgagactctatctcaaaaaaaaaaaaaagtgatgtgtcttctctgtggaggtgatatgtgagctgatagtgaaggatgagagagaatcagccatgaaaaaggctgtggaggagcggaaactgcaaggctgggggtgtgaaaggatgttcctgatctagaagcagagctgaggccagtacgtctcaagagggtcacagatggtcacagagggttatgaggggtggctgcggagggaggccaaggcccaaccaggcaggaccctgtgggccgtggcaaggagcatggaccttatttaaggagtttagacaagaaactgaaaaaaatctaagtctttagaaagatcattctgagtgattccggaagaatggatggagagaaaatggaagtgggcaaaccacttggcaggctgctgttgtaaccgaccaagcaagtcacggaggcagcttgaatgaggctggtgacatagagatggagggaggtgagtggatacgaaggagaccctgataggactggcagggggcccgaggtgatggtgagagaggacaacataaaggatggcactagggtgggaccagggctgtctgacatgacagagcctatgagggctggtttccaacttccaaatcctaggacaaagtcagtctccgtatagatttactgagaaccgccaagattcctgtaggccacccgcaggaaggcagagtgcgtttcatttttgtggtcgggttctccgaaggaattaaaaattttcttattcttttgtagtctccatagcccctttattttgttgtgtgatcctttcctaaggttttcctattcaacatttatcttcattgctttgctgaaaacacacaccaataatttcatctgtaatattataaatgacctctgtgtctattttgccattaatctccctgcaaaggggttgcatgtaaccattctgcaccatacctccccgtaaaatatgtcattttctcctcttgtttgttcagtaaacaatgcaatttcaactgtaccttggagaactagtactaatcataaacaaattatagctactactgagactactgcagggaccaggctttagattctgcagcagagaaagctgcttggaatgagagcaaagggaaggagggctcattcaggctggaggaataaagacaggagcacctgatcatgggtagtggccccttgagacacctccaatgaagggagccgggtggattcagccctcttaaagctacgcaggaggtcatcctgcccccatgacatccacggtagccacagtagaagggctggctactttctaaagagacaagatagccaccgggtgctgatgccactgtcaatcatcatagcaatagcttccaccctcaccactgattgagtgcttacaatgttctaggtcctgtactcaaggctttatgagcgttattttatttggaaagtactttgtaaaccacctagtgctagaaaatgattaagatttcatttttaatattaaccatctgacatttacacatgataaacccataagaggcttccacacctccatctttactgaaacgttaccttctcagcaaggccttccctggtggctttatctaaaatctctgccttggcctctaatccaaatcacagatacatcgtctctcctttccttgctacctgtataactgagcaatatacacctttcttattagtgttgttggtagtctgtctgcctgactagcactcaggggatggagaacttagcgtgtgtttcactgctgaatccccagtgcctagaacaacacctagcacctgggaatcacaataaaagtttcttgaaagaataagtgaataatgctttttaataaataattttgggtaatggattcagaagcagggtttatgctttgttcataatataaaattagtatttcagaggacttccacatagccccaactcctgtggctatgtgtgtacaaagctggcatttgttcacataaaaagcaaatcatgtagaaggctccttgtagtgatcatgtccttctctgtgtctaaagaacttgctcagtgctgccaactccattcaggatgatggctgcccactcatacctgcaatgggtcatggactgggaagctgatgaaactgcaactggcatgggctgctgggagccaccatacatggaggagagtgatggctgattcacagtgagtagcgagaggctgggagacagtcagcaagggcttcccagctgggcccagtggcatgtgcctgtagtattagctacttggaaggctaaggagggaggatcgctttagccttcactgcaggaggttgagtctgcagtgagctatgattgtgcttttgcattccagcctggacaacagagcaagactccatctctcaaaaaaaaagtgcttcccattctaggcacaaagccaagtgcaaaacagactccaacctagcagtgtgcagtggatgggccattcttccagctaggggggagaggaagcagggtgtccttggaggaaatgtaagaaggtttggtgttatcaaatttgataggtacagttcaggcaaagaaacctggaaacgggtagagtcccctatgaaaagatgaagatcacttgctatggctaggagtcaagaacctctttgtattttttagtttttagttcttttctaagcctctcatgtgagggtctgaacttctcagaaccacaagattgggagaaacctaatgaagaaggaaaactggatgataggcaggcaggaaggataaataacaacaacgaaaataatattcagcctactatgtattgggcattttttgaatgtgttatctttcacttgattccttcaatgaatatgaccgaaatatacaagaagatgactgatttggtatggttactataaaaaaatagaaatagaaaataatgagtgttggcaaagatatagagaaatttgaacccttgtgtgttgttggtgggaatgtaaaatggtgtggctgatatggaaaacaatatagttgttcctcaattcagctttgaaaaggaaataaattctaacacatgcttccatatggatgaaccttgaagacactatgctaagtgaaataagccagtttcaaaaagacaaatgtgccatttcacttacatgagataccttgtgtagtgaaatccatacagacagcaggtagaatggtggttacagggtctggggagagggaggaatagggagctgtttaatgggtatgaaatttcagtttgggaagttaaaaaagttctgaaaattggttgcacagtaatgttgaatatacttaaacattactgaactgcacacatagatatggttaagatggtaaattttatgttatattttagagcaatttgaaagatgactgattatcctggccttgaaaataagccctaatgaagactgtaggacagggggaagtcagtgtggcctactgagaaaagcctgtggctgaggccccatgcagagttcaggctcttctctttcttcttttaaatcccctttctgtttggtttccagtggaatctaccggtgtgtgaggcactggatatagctggaactacagtgccctggcagtgacgaagcctctgagctaacccgacacggctgtgtgctcagtgatctttttttttttttttttttttttgatatggagtctcgctctgttgcccaggctggagtgcagtggcgcgatctctgcccgctgcaagctctgcctcctgggttcgtgccattctcctgcctcagcctcccgagtagctggaactacaggctcctgccaccatgcccagctaatttttcttatttttttttagtagagatggggtttcaccatgttagccaggatggtctcgatctcctgacctcgtgatccacccaccttggcctccctaagggctgagattacaggcatgagccaccgtgcctggccgatcttttttttaaaatttaaaaatttttttttttttttttgagacagggtctcattctgtcatccaggctggagtgcagtggcacgatcatggctcacagcagcttcagcctcctgggctcaagtgatcctcccatctcagtctcccaagtagcctggatcacaggtgtgtgtcactgcatctggctaagtaaaaaaaaaaaaaaaaatttagagatggggtctccctattttgcccagtctgatcttgaactcctgggctcaagcaatcctcctgctttagcctcccaaagtgttgagatgataggcatgagccaccgcaccaggccacctgagtgatcttaaacctggcattagcctctcagcctcagtccgcttatttatgaaatgatggggttggaccaggtgagctctgagggatgtttctccctgcgctgtggttcaaggtctcagccagcagcagggaacaatggagatgagtttccatgtgcaggaagaaagtgttaggggagggtctggtaatggtgatacatgtggatgacaatttggaaagcatatggggagactctcagctcagctagaatcctctcagccctcaatcttgctacgaagtacaggcagatggcacaaagggctgcttcagactggcaggtccccaggtacacaggactccatttccacttttacaagtctttctcaaacaccagggggattctgccaggtactatattctctagagtgaagagctactaagcagagtctacaatttcatttagggaaaaaaggtgagaaaacagacaagacttgatgggaaaaatctctgaggacacctagaggaaacattcatgcccacaggtcttggactgactggccaagtgacaggggcacaagtgtctcctacatagtaggtattcaataaatagtagacaatgaggaaaatgtggatgacaatcttcaggccatcctgtatactaggacagatattttggcaattaataataaaaatacaataagtgctaaaataggtgtgtgttttggctgtttcaaaacttaactgcaaattctttaaaaatcctctcgagaggactatggagagatggagactttggtattcttctcatgagtcgggcaggctcatgactgcttggactaacagcatatgatggaagccaccacataacttttgaggctagatcataaagactgtgcagcgtcctccttggtcatggatacatctggccttggagcctggggcatgcatgtaagaagtttgactccctcaaggctaccatgctagagaggtcaggtgtaggcactctggcgatagtcccagttgagctcagccctcctgccatcattttcaaggcagcagacatgcaagcaaagccatcctggagcccacacacctcttgatctgccagctgaatccaatgcatgacctgtcaatgccatgtggcatgaaaaagttacctgcccaaattcttgtcccacacaattgtgaaaaatgataaaatggttgttgtttttgctactatgctctggagtatttgttgctcagaaatagataactgggatgtctgaatgataggcacacagagaaggagtgtccagccagggggcaaaagaaggctctaggaaagagataacacttgagttatcctcaaagagtgggtaagaattctaaacaaaagagaaaagataagggaactccaggaacagatgatgccatgctcagggaatagtgacttgtctgtgtgactttagtatgagctgtgtgaagtgatggtcagattcaaacattttattaggttggtgcaaaagctattttggtttttgccattatttttacttttaatggcagaaactgaaatagcttttgcacaaaatagcttcatcaaattagcaaagacttgaaaataatacccaggccgggcgcagtggctcacatctgtaatcccagcactttggaagtcctaggcaggcagatgtcttgtgcctaggagtttgagaccagcctgggcaacatagtaaaaccttgtctctactaaaaatacaaaaaaattagctgggcatggtggcacacgtctgtagtcctagctacctgggaggctgaggtgggaggatcacctgagcctgggagttctcctcagaaggtcgagcctgtagtgagttgtgatctcagcactgcaatccagcctgggtgactgagtgtgagaccctgtcttaatttaaataaataaataaataaataaataaataaataaataaataaaaataatactcagtcctagcaaggatgtagtgagttagggactcttacatactgctggtgagaaggtgaactgggagaacttttctagaaaagtttggcagtatgttttaagaaccttaaaaactttgtatttaagacctttgaaccccaaggttccacttttaggaaacttccttgaggaaatagagttatcagacgcttagatctaaaaaaactcatagcagattataataccatgaaagcaaaaacaaagaaacaacatccccacagacagggaaacagtaataaaagctcgtacccctgtgtcacacaagggtgtttttgaagaacccttattaacatgagaaaattttcataataaattaactaaaaagaaaaccaaccagccaaccaaacaagcccaatgcacctgtatctaagactgttggaacagcatagcaaaatccatttatatacacagaaaggaaaactagaaggaatgtatgtcaaattgttaaccatagttatctctaagggagaggattatgaatgctttgagctctcttttctaaacctttctgaatttctgtgtcctataatggacatatataacttttacaatcaaaaaaaggaagtaaatttctctaaaagaagcatgagtgagtcagtccttctttttccttcctaggctgatgcttacattctgacgaccccaattcaccctgtttctattccaatacatgacctgtatttctattcacaaaactcttccaagccctttcatgtccactatctcattagtttctctcaatcaatccaggaagcaggcagggtgaggattgcgtctattttcagaggggaaaaaaagatccacaggaaggtaccaattgaatgcagtctgctttattttcagagatccacagctcattcacacccctgacccactccctacagcatcctgcagaatcagggctggtccaagtgtggacagccatggggatggggagacagaccttacccaggcctgggccaccaagctgttggcatctctcagggccaccagcatccccgaaatgcccaccaggctggggcgaggtttctgaatcacactgtagacccatatttctgacagaggcacaaattgctacttcgtttcacagtgaatctcaacatctgatttccattgacagttaaattaacaaatcaactaaataccgatatgttttatgtcccgtcttatgccagatttattgtgatcccggcatgacacaatgcagaagagtttggatttactggctcaggggtaaactgtagattattcactgcgtccatttcactggctgaaccaggaagcaattcctgggtccatctgtcagaatctctgaactgggaggaggagaagaatgaagcacggacagctgaccagccaggcagtccccagagctgccatgcactctgcagcacgcttcctgggtcttcattccaatcagtgggacagtttcacgcataaatccttacccgatggtcagatgtggtctccatctgctttcctgacctcacttgtcttctttaaagagcagcgactcagaataataaagatctttatttgcatagcactctccgttttttgtagttcaaggtacatgatttcagttaatactgaaaacaactctatgacatggaactgtcacccccatttatagatgagaaaactggctcaaggtcacatgggtggtaagaggtagagaggaactagaaccgtggtctcctggctgccagttcagggcttctcctagaacattctaagagtggggtctctggccctgcctgaggagagagatcctggccattcctctgaaactctgacaccctctttctgcctagaatctggttttccaggtgggctactgggctgatggaggaggtgaaccaactcatttccatgagcacttggaggaacactgcacaggaccactaaatgccgtcctttggtttggatggggtggggtgtgaatggtcaggaagtggcagggctcatactctgagctgctgggagcagtctgccgttgagaccttggtctctttcatagaggacataggggagatttagctccaactttgtgtcatcaagcaaagaatttgggaagtctgtgtcctttcacttctttttaattataaaataactggctgtatggtcccatccactcctaagatgcagggaatacttgggcagtaaaatgaaatgatagagatgtattaggtggggactctccagcctgggaatattgactgctcagtaaataagcagctgccgatctagctctttccatctgaagaaagtgcctttcaggaggcacagataacctttgcaactataactgggatttactctaagaaagtagttctcaaactttagcatgcatcaaagtcatgcttcttaacacccccggagtttccgattcagtagatctaggatagagcttgataatttgcatttttaattatgcaaattacattggtgctggttctgggactacaccttaagaacctctgccatgagggttttgctgcaagggacagctgtaggggtttgctgtgtcttattaaaacctttcccatcaacttgatacaggctgagaactggtcttcaaggacaacagggctgaaggagttgcttcttctcagagacaacatgatctgtgtcaggctgggcaggggtggaatgcatgagttgtaggattctgcccctaccctagtgagcccaagttgctccatctctcctaggctgacttggcatactcgacccagccagattgtcccccagggtggtccatctgggtctgcttatgagaatgaatgaactgtgtctgtaaagtgctcacagctctctggagagggtatcttagcacaattaccataataataaatgctttctgttcatttggtatttgtgcatcctcggggcacccaggggctcagctcattaaggctctacaacttggacaaacaggttggtaggaagcgaggtgagaagctggccttgtatcaatagtgtcattccatgtttaaaaagccaaagcttagaaataccaattcacaaggtcagttgggccatttcagttagctagtgagtagcaggacgagggcaggacactgattgtttataggaaagcaacaaatgctcacagctcgtatggtaagcatcatagtttaagaaacactttgacacatgttatgaaattcaatctttataatagtcctgtgaggtagagatgaagtcagtttggttcttgtgcagatcacatagaaggaatgaggcagaactgaaggcagctcacattctgctatttacagctcccatcgtaaggacggactcctaattcaatgctctattatgttatcagtgttcactgagtactctccattaaagggacccagattcaatcaggacctttcagtggctctgacgacacgctgtctgagtttaactgttggctccatcacctacttgctccgtaagattgggaagtggtttatcctaagactcagtttctcgaatgtacaacggggataataagagtaccttcttcatgtggcctttgtgaagagcaaatgaattactgtccatcaagttcttagtggtgcctaacacagagtaagtcttgatgaatgttggctgcattactagctcagtccccactccagctgaaaggggttgcagggtcgccctctccatcggctcagggaagacagtagagtctgccttattctatgggctcactgggtcctaattactgggaagcagtggtttccctggcctgtgttgcagcctgccactttgttcttgaccctgctctgactggtgttcttgacaataggccacaggctgggttttggcctctgtttgtttgtagcctcatcaggggaaagtcatttcaaactgcttgtttgtgattgctgcctcataggctgagattcgtggggcaacactggcttaatagtccattgctagtcacagtggggaaatcagagtgcattatgctaaggcagttggcatggcggtagggggcaatggctgaagagagacgctcatctagacacaaaacaactccgcttccaggaagcagggatcctctgtacctgggctgttttaaatactctagtgcaaaaatcagggcagcttgctctggccaaaggcctcccctttcattatttccagctctggaggagcaccctgcaggtggtatgaaggatgtgcagagtggacaggtgacagctcataggcaggagctatgtctgtcagctggaagaaggatggagatgtggtttacacaccaaacctaggatgtgccctgctcagggaagagcagcctgcaatgtacagtgcgactgtggggaagactccaaactggatgagtagaaccaggacctgctgggtcctgtcaccatggctacagtgagggctggtcaggagacacctggctgggaagttcagcctgcacaaggcaggaatcactgaaacaggaatgttacccactcaaggtagagggaggcagctcagagcctggagagcaatggataatcagcaagaaccatctctagcaagcagggctgataaactgctgctctcagggtgaaggtttgggcaactggcttagtctttccaagtcttactttatgtatgtgtaaaatgggcataaataatcccggtcctgtctatcctacagggtttctgggattagaactatcctgatacataactccagagcattctatgtgaggtctatcgggactggttgaagggataagatggaagccacaaagaaaatcttgtgaatgtgaaggaattgggccattgtaagtgactgtattattttattctgcatgctgcatgagaatagccttgggccaccagacatttgttgtggccagtgaaaggctagtggccccttggtgatccctatggccattggatctggagaggggactggcagatgtggagatcctgggaagatccttccattgacctgagcacctgagtcagcctgccccacctctgtgggacagagacagctgccactggctctggtcttgctcagtttctgttggctctcaggggccttctaggcttctcagtggtgctgtgcttctgaaccagaacctcctgagtacctgctgtagagtaaactcagtaatgacagagtcccaagaaaccagcagcgaccatttacggagcacctgctcacaggcagtcactgagcaagtcccactggacccactgtttgtcattttatcctcctaccaaccctgtgagtaggtattatcatctttgtttaacagataaagacactcaggcccagagaggttaagcaacttgtccaaggttgcagagccaaatttgaactatagcttgcctgcacctgagtctaaggaatttctgctacatgtgtatctcccaaactgttttctgcaaaaacactggttctgggaactgtttttggtgcttcatgaaaagattattttgtgggaataagtttgggaaggctgcatattctattttactcttggagattcatattgtacattagcaaattaaaggctctgagaaaccctggactggagaaatttgggcaacatttaaaaacccaacattcattgctcctatttgaacatgggacacgttttcaccacaacagtgttgggaaacactgagttatattgtggcttctattttgaattaacatatagagttattaaagatagatgaaaaatacttctgttcttttgggatcttatatttttgtgggggtgaagacatatctgaaactgaggagagatgtatggaagcttagagagaggactggctcattctccctgaaggcttcacaaagcagtgaagcctttgtgcttcacttgggctgggccatgacaggtcagcagggatcacccgataatgacacaggggaggcatcccagacaaaagcgttaactgcatgctcactcctcctcccttcattgtccagggaccagtcctctgctcagagttcctgcatcctgggggccacttctgaaccagaccatgcccactccagccaccacagatcgagccacgggcaaccaattactagactggccacacctgtgacttgtgtggttccgccttaagagatagactggagcaatcagattctcagtttgagaaatctgatcaaacacatggaaagacttgctgatttatggtgatgattgcagctgcaaagtcttgaggtaaggctggagaggctaatgtgggccaggtataattcagttaactccatgggaggctggtggtagggtgggagaggcagacccagactcctaagcagagtaccctagttggaagaagaagcaccagagagagaagtggcacttaactggggctgagacaggtgaagagcagaatgctggctttaagatcccaggactctcctgtttgggggtccctgcagctctaggtatgcagaaccttctcagctctggccacagtgaaaccaatcctatcatcagccctagccctggcagccactctctcttcttccagctgccccgtcataaggagtaggagatgatgaccatcttggaggagggagatgctgtatcctggagaggccactggggtaggaatcggccatctgtgctccgcttcaagttgtgctaccgattagtcacatcacttcacatctgtgctgcaccctcaccctcactgctaaactggtgacaataaagattgtggggaagagcacatgagatgtatatgtgaaagccctttgtaaactgtcaggagtggcatagatttattactgttactggttgtggaaatgtatgtagagaggacaggcagaaatgcctttaaaatctgtgtggggcctgtaatacttgccggagccaagcaggctggtctccagctgctagggccacgtggtcacgaaagaagtgccctgtgtaggccacggcttgaggccctccccaaccttgctctcctacatcacgcccagaatgttccatgcctgccttgtggctgtggtgagtatgctaaagcaaagatacagaggacagaatctcaggctcagaggtcttttagacaggcaacatccaattatctgggaaaagagaggtccagagagggttatgtgatattgtgacgttgaccgatcaatcagtggtcagtgagcaggcacttccagatccatctgcagaggaattgtcccaagacacctaggctgtagtggtagagaggcaggagaggccacaagatagaggctgtggggtagtgaggaataagagggtttgtgggaagtgggcagagtccagaaagggttgagggatgggagtgaaactgcctttgcaaaaatcataactgataaaattatgacagtgaaagagatctgacctgattccattttgcttctaacctacaagctgtcattgttcattcctgggtgcaggagaaactaacttcgggaagaactcagtttgtagtttaactttgaaacaaagacagtaacagccctttcccaaaacaaacctccttcttgcctggggaccagactgcctttgtaggactaacagactagctacaagattagaaattattgtttaggagtcatgcagctggaggctgcaagattctgaacctcctcaaattgctcctggggacaacatcactattgtaaaacctaaaatcaatgcttgagatatttgcagaccctctactcaatggatcatctggcaccacccagatcagtaaactggcccatctgttcttgtggccccatgtcctccatcaggccctgcctgtgcttagaagagcttcaggtctggctgtgtgctactccaggggaagataatgagcttgatgcattattccttcctatcaatcaatcaccaatttttttcactttttgtgtatttacattttgcaattactccaattttcagggaagagagcaaaaaaatgacatgattaaacagaagactcatctctggaattttccaacctgagaacacagagcttttattgctttgccgagtctgggtctggctccatgcacagcaaacctccatctctagagagcagagggcagggaatttacaaggtggtgttggagctaaagcctgctcctgtctgtacaccagggagaggtgttttgttcattacacacttgtgttgaactgtaaatgacccaaaggcagtgtgttgaggtttcaatattttctagtggagaaggtcatgatgaagtgaggatctaaaaaaaaaaaaagcatttattgaaggcttcctattaggttgaaccagatgaaactggtgacattgtactgttctgggcacataaaagtggcagtttcacatgattcaacctaatgcattcagactctgctgaattcttcatggacatcccataaggaaaaccttggtactttgttttgcctgattaggatgttgagactcaaaggtaggaagataaatggacatagctgacacttttaacaaaggacagcctttggtccttaagcacaagagagcctgaggctggggcatttctgtcacttggcagctcaaacacctgagaccagcctttcactgacttttatagcttttgtatgaccttcagtgtagtctcatgtgctggccataaggtctttcagaatttcatttctttgtctttaaggggctaagaaaagactgtagaagtgtctgaggagcacaggatgttccagagaggccaactgtggctgtttcctgtcctgactcctcacagagtcttccctgtcttaggtggccctgtggtctctgcgctgcgtgactccttcctggctgtgatagaagggaagcgctttcacaagctggccaacaacctaagatgcatgtggccttgctcaaaagccagatctgggcccatcagattcctttcttcagaattcaagactgggatagtgctgggtgtctgtgagggttgagctgaatgatcctggggtggatctggggccaaggcagcccttctgggccatgctcatcagagaaggcaggagagcagagcagcacccaatgggagccatggcatcgtgcaccggagaccatccttcttcatccttcttctcaatgtcccagttttagagagagagagagagagagagagagaagctaaaacccagaggctttggcatgatacctaagagatgctctcacctcttttgaggagcaagatgaagagctgctttcctggcacatgtagctttctggttccagtcccaggccatgactactcttaccacatgcccacttttctttttctttttttttttttttttgagatggagtctcgctctgtcacccaggctggagtgcagtggcacgaccttggctcactgcaagctccacctcccaggttcacaccattctcctgcctcagcctcccaagtagctaggactacaggtgcctgccaccgcgcctggctaattttttgtatttttagtagagacggggtttcactgtgttagccaggatggtctcagtctcctgacctcgtgatccacctgtctcggcctcccaaagtgctgggattataggcgtgagccactacgcccggccagcccacttttctttgtgacaagaatggatacctgataccttccctagcaactgattggtttccaaggtgtttggccgactcatgagcatttagctacttcacagttgagtagagattaacctcttccatttgtgtggtgcattcacagatgagatgtcttttgattctacaacacccctgtgaagaaggcatggtgggcatcctgattctcctattttcagctgggaaaacaaagtcatgcagcactgggcctaaaacccaggtccccacattcccactccagtgctgtttttatgtaatttctctggttctcaggtcactttctacgagggtaattcctgagtttctaagcccaagactttcagtccatcctggcctatgctccctgctaacacacacaccacatacacacccaccacacacagacacacacacacacacaccacttgtccttgaaggtctctgcaatgcatgtccttatgccactatcccatccctcggctgaggcgtgttgcccaatgggccctagcagtaactgaatggctgcactggaagggaaagacttttagctacaggaagcagttctgctgattcgatctcatctaattaaaagtcactgaactgtcagaagtgctgccttttaggtcaggcattaaaacctaacaccctgaactctccaaactcttttctgcttgctccacactctgtccatttcctcacatctgccaaacattggtggggagcttaactccaatgtttaggctaccctgagttaggatatacaaagccagagctgacaaggacacctaagactctctggcttccacctaggctcccagagtagcacgctggagccaattgtgtgcatctcttcccaattccacatctggagacctcacagtggtatcttataatcagccatcatgggaatatttacactacagaaattggcaaatggtaaaatcaaggctccctcctgaagaggcacttgttagacacctgcccaaggcccctcgaggtccaaggagcctgcatgggagcatgggtggaatctgaaggcccctctgtcctgatgcagcctgggcccttctgattgtgtctgttccgcagagcaataatagctgacgtttcctgaggactatatatgtgccaggttgtatgctgacattttgcaagtattaactcattttatctccttaaaatcctaagagtaaatagtattattaacttcttttttgcagatgaggaaaatgaggctcagagaggttacataacttactctatagcttacacggctagtgagggtggtacctggatttgaattcaggcagtctgactcttaacccacattcttaacctctatgctatactccttctccacatcagatttaatttggaaaaaaaaaagtcccagggaagaaactgttagaaaattaagtaatattctcactacagtacaatggaatgccctgagtgtacccttctccgcactttgctgcctctggttctagattttagtaaaagctgcttagtcagagttggcccaattaataaataagtatctttcagaaacctcaaacttgttccactcctgcctgattttgggatgggagactgagcagacccactggggtggtggaatcactcaatcacactgaaaatgacatccaaataaataaagaaaatcaagcgtgccatctgggccctgcacacagcagggctcttgtgcagctgcagggtgctgtttattctgagctgtcttggacagagaaggagacacctgagttcagccagggttaaagaattctccaggttcctgggcatgagctaaaccctcagtaaatgaagcttccccatccagcccatgactgctccacatcttcagagacccccaagtcccaccctctggggcttcagccacaacaaactactcacaggtagtttgtgagtaaaccacaggctttttcccatccaactgagtgcgaagattcaaccaggccatggtactcacttctgctcttacatatcagctataacgaacgcctctgagttttaggttctctgtctccaaaattgggatgagctaccacatgggttatagtgaggaatacgagctaacccatttaaatgctgaatgcaaagcttggtccttcactaggactaaatatgagtcagcaatgattagtggtgacaatgcagacactagttagttctttgccctcatctcctcctcatgaccactatcactgtcctggcatctggaataccctgcacatctcactgtcccaattttctcccccgctggcagggctcagctcacgctgatctttgaagacatctgtgactcttccagggagaagtgggctctttattccttgacacagcacatcataccaccgcttctagcttctagaaaggccagttatattattcctgaaatctcagcagtcatggcaaactttcacggcagatgcctttgttatttagggtcaaaccacagccagagttaattctcattctgtcctcctggtcatagtgggggtgctgtggcaaacctgaggccccatctcccccacctgtctgtccattggaatattcctggtctcccatgtcaaatgccaagctccaggtgggatttgacctagcatctctttcatgtcaatgctccccctgcagaatctgcaggctgaccttgcaggaggtaggggccctgaactaagctatgatcttcctggaggggtaggaggaaaggattattcccttgcatatggtagatgaggttgtatctcaaaaactatactctcgatttcagagatgcttaataatatctcactggcttggccctttcctgggtcaaaagtaaaatctccctgtgtactaatcactttgataaacataatgtgcaatatcccatttggtccactattttacagattaacaagaggctaagagaagaagcaaaagacttgaccaagttttcacagatggtaaacagcagaaaggagactcgagcccagaacgtcagcttgcagaaccagagtccataaccaatatggtactgagtttgtcaggagtacctataaagttgctttgtgtgtcatgaacatttcatgcaagaaaatctgcaaatgtattaaaacaataactgaaccaagacaggccttccactctttggaaaaggcaatgctgtcctcttaagatattttaccttctttatttagaaatttaaatctctgaatgatgactgaaaaaggtgatcaaattgtgtaatttttaataaatgttctggccttagctgaaaagtaaagatggagaaaacatcaggtagaagtaaatatggagaaaatctcacataaatatttaagcctcacacagagtgttagtgattgggcctatggttcagtctaaggctctccatcttgtttgtctccaaataagaacaaaagtttcccagcatgtggcccccaggaagcagactgattgacagcaagttctcccaagtgctgtagaggaggcttgtcaatcttaagtttgctccagtgtcagggaatttgattgtttgccagttctacttggacatggatttactctgcctgcaaatgcccacctttctgtacagcatctcatctgcacctccagaaaataaactgtggtctcagtgaggggcaggcactgatatattttctcccatttggaatcacatgctcacttctctgcttccacagcttcccccatgagggtacttaatttccttataatgagttgtcatagatccttcctccttactaccttaccagctctgtgaggaccaacaattccctattatatacgttcgtaaatgattaataaatgtttggggagtaataaatggttcagcacaggatttttccactaagagttgtacaattaagaatattctaggtatatctagagatcagctgtacaacattatgcctatagttaaaaataccgtgttgtgcattacaacaattgttaagaaggtagatctcatgtgaagtgttcttgctatggtaattaaaaaaaaaaactaaaaaagagaatcttctaggtatatctaaaaggatgacccaaaccagaatgtaaaggagcctttagaaaaactaacactgcagcatccacacacaaaccagctgggactagtgtcattcctggatggagtcaaggtttgcattgcggccaatgcccctcccttgaagagggtattattcagggtggcccaggtctcctccatacttctgggtccacacctccacccactttaagttccatcaaatctgtgtgatttggcttccagattgtctcccacacagaggagggttcctggcagggttggtgtccaggacttctcagtgaggacttgagtccattagctcagaaatcctgttccttcttcactgggtgctttcttaagactgggccaagtcatggtatttcattaggataataaaaaaggagaaagtcaggcttagaatttgaaaatctctcacataataaaagctgactggtaatttatggctgttccacttgaaggtgactttgggatcaatagacactctagctggacttccagagattcgattcataaaggctcccaaagcctttgaatgggctgcttcagccactcatctcccagaaggcggccagcaccatgcagcttgttcccgggctggcagtcttgttagctgggtggtggtctgctgcctgcttccctcctgtctctgtcttgaagataattccacctaacacagttaagcagcacggccctttggtggtgcctaagactttttgggctttgtccagatgcttcctcatcactgagaagaagaagacctgacctgcattccaatttccttctcacatccagaccatgacgtttccacagtctgaaagctgttcctctctccaggggtactcagtagaagtgggcaggcctcagtttccctctcataatggctatctagaacctttttctaagaatgtgggtctcagggatctctcttcttctcaggcagagcctgaggtgtgcactaaaataaatcaatggctctgagaatgtctcttctctgggaccacagaacccactttggtttccttcttcctaagggccaagattgcaagccatgattcatggcttttctggcacagttggccttcccagtcctggcccttccctctctgggaagagtcttcacagccatgagtgaggcttctgggtcccaggtcttatttagtctgagtggactccatttcctttctttttggataatgcactgctgtcctgcccttggtcagctaatcctctcctgtccctggtctagcctctgtgtagccttctgacctctggagacaggaagtgcagagatagcacattgcccagagctcctgacacaaggctcgtcctgcccacgatggattctttcctctgaagccatgtgtttgtcaatgacttcatgttgagatttgatttattgggcatctttcccgtgtacagctctgtggtaggtgttaggtgatgtgagaatacagaaatgattcatggactcttatcctcaaagagttgcagtcttagggcagatatgacaggagcacaaataactaggaattgtggtgaagcataagggccataatggtggtaaaaaataaaagcccacagacatttagaagagaagttatttctaggttgatgagatgaattaattatacttaatttatgtgctttctagttggtatttatctatgaggtttgtgcaaagatgagtggtcagaagcttacttgttctgggttctcctaagaatggggtatttctctaaatcttcactttggattggaccctcccaccacccctggtcatgggcctgaaaccacataaactgctagggctcagctagatgcagagatgcagagatgcagagaagcatgggcatatttgagggaggccccgaggccatgctgtcagaagtccagcagcaaagtccccctggatcttcctttttggggcgtctctctcaggaagctgatgaatccacgagcagatcgccgacgcagtctcaaatcaatacccctgactggcaagacaggtccctgtgctattaggagtggtgacagctttcagatggggcataaaccaattgttaaagaccgtccacattattcaccagggtgggagaattcattttagtatccgggaaaaacagccgtttgggtaattacattctgtttcccctcgtctctgctaatgcattagcaggagataatattccacattccaagtccagaaccatcccacagagctgctattaaacagctgtcaccttcctccccataactggatgcatttctcagcaggaagaatgactccctgtatgctggctgcatcaatcctggcgcgtaggaaatgcatttgctggagctacaggcaatgcgttatagtgggaaaacactgggccagcagtggagaagctgagctgtggttctgactcagctgtgacttgctatgtaaccttgggtaagtcacttaatctctctggtgctagggcttcccaagttgtaaggctgggacaggcgatccctgtggggtctgcaatttggggtcaccatgtagggtctttttcagtggggcacaggctctcccaggacttctgctttgggctggaaaccctcaaaactggttggccacgtgatccttgtatattgtggcctatatctacaaccgctatctggttggaggtcctggttctttgtttattgactgaaggcttaacttggtttatgccccatttgaaagctgtcaccattccttcgactgtctttgaaacaaataatctttagcccatcctttttcatcacttcattgttcctcatgagccatagcagacctctgaccctgccccaagtaatgggaaattagggagagaaggatggagaaaggacacaaaggcttagggggtcagacaagaagtggaaaaagggaaggacctggaggagaaacagagaaaggaagacaaaggatggaaagtgaaagggagggctccggaatggattgatgggtggtgggcaggaagaatcgaagagaacagggggaaagaaggagttactggatggaacaaaaaaggagccaaatacaggagaaggacgggaggtaatgggaagaagttctggaagttggagaaattcatttccttccttctctttttccttccttccttctttctttcctgccaacaaacactagcaactcacaatctggcacatagtattcagcttcaatattctaggtgctaaagaggcaaacatgaagaaaacatggttcttgcatacaaggagctgacagtatattagaaggaggcagagggttaaatgtgtgacaaggtgtggaaagaccctcctaagaggggtgtgtccacagttacgggaatctatcagtgctcctggggagagggaaggagagtttggagaggtgtcatggagctggatggatcccaggagatgagtagaatgtctgtgctcttctgttctgcactcactctgtggctttgttgtattatcatccttcacacagtcactgcatcctcccccatttccacagcactgcgtctcattcacctcactatattgtagtcccttctttatctgtcttatccactgtactgagctctttaaggccagaaaacttggtttaattgccttcatatttatattgcccggcacctagtttgatgccagcaaatagcaggtacaatccccactcccaaacaaacaaatgaacaaacaaacaaacagaaaaaacattgaatgaaatgcaaggcatatataatttctcttccattggttcccatttacatgggttgctacaacagtaactccccatctagtatttccatcacatcaccaccattgtgtgtggaaggaaggggaagatgtttctgggaatgttttcatcaacatccatgacttgcctggctgcttttccctttccattttccttcccttccctttgtacttgcctcttcctctctccaggagtcctcagtaaaagtgggcaagccccagtttctctctcataatggctatctagaacctttttctaagaatgtgggtttcagggatctcttctcttctcaggcagagcctggggtatgcactaacataaatcaatggctctgggaatgtctcttctctggaaccacagaacccactttggcttccttcttcctaggggccttcaccgatgacagctgggctgtttcttggataacagcatatctagggaactggaggcatagccttctccatggagtggcgcctttctgagctcacagccctcagccccagagaggtctgtctcctgacttgaaagtgtaggtagaaatcacctggcctcatctctcacaccctcatgagagctctgcttctactgagacatgtcttctagctgggtgagcttgctggagtaccaccacttctggatctgtaggccaggactgtatggctacctagactgtagttgtcttggcatgtatacaggtgattcagtctatcttcctgggggaatagtaccttttaatctttgtacacaagcccaggggcctcagtgatggacacattttaaaaatccaagtaagtaactctttaattcatcattctcacctctgaaagcaagattcttggaaagctgatacaatttgagtcaacaattcagactcagccatctcttcagaaaagttattaaaaacacatcgaggaacccagatttcattctgtttgagagcattgagagaatatataataatactatagctggaaactgaagtaacatgggcatgaggtggcatccccttttctaggagacttctttcttcctcccatttgggagtgagatcacaaaacccttcaatgctctcaccaaactaaatctaagtccttaaagtgtcacccaacctcacagttccttattattatgggctataaacacagattcaaaatggggaaaatctgaatattactgtactaatattctacattgaattagaatccttcatggttagagattaacgaaagggaggctattcagatacatgtgtctaagacagccacccaagttctacggcagatacctggtgttttcagacccagaaaataaatgcccagcttgggtcatgataacacctggaatggctgagaggctttggttgctgttgtttctctgtcccctcctggaaggggaaatggagtatggtgagttgctatggtgacttctctgcatcatgggtcggaggtggagctggggaaggaccagctaaccaagtcagctcaccatggacttcatgtcactgcttagaaaggccagaagaccctggcacacttgcagcagaagggaatggggttctgatagaaatcctgccagttccttctgaaggacacaccatccttgagcatggagccaactatccttccttacatacatcctggatttcactatcaagaaaactgaagcccagtgtagggtccttgctaagcgtttcttagaaaaatggccaaagaagagtcagggctccagacagtggtcaggaggcttcccaaggctgggtgaggccatccttgtagagaccaaatgtggaacagggaacaggcgtgggtgacggagcaatccttacatttcatttagtcttattaattaattcatccattcatcatccaacactgagcccatctttatgatgcacatattattttgagcattgtaccatcatgtgagttagcaggacccattttggtgaatgaaggctgagaagaggaagaggaggaaatagagaacttgatgggaaagaaggaagagaattagcttgttttgaacatttcttgtgccagtgtgttacataggttgtctcactgagtctaaacccatccctataaggttggcattataatgattcctattttgcaatgagaaataccaatgctcagagaggttgagttcggtggatgctgtttgtggctccaaaatttttttcaccgaggtgtgctgtcctcagggaatttaccatctagattagcaggaacacattctcatgtgtgttggctgaagcaagagttgctagactctgcccaaaacatagacttttacttaaaataaaattgttttacatgagaagtcatgagcagcaggtaatttaaggccagttagtgccaaatgtgcagtttaaacataggaagcactcacagatgcctcagggagatgaaatgagatttgtgatggtgcttgatgaacagatgggattagggcagggtgatggccatctctggcccattcagaggacaggttatggatctggttgagcccagttgttggacttagaggctgggcaggcaggttggggccagagaaagagggtccagctccaaggtctccaaactttattctacagatgatggggaccttgtgcaggaaaaagacacaagtggtgctttccaaaaatgaatcagaacacactctgcatcctgtcttcagtcatcatcttttgccaggagataatttggtgtaaaactaaaggatttacctagagttctacaagctctgaatctgactcaggactacaatcgataccaaaaagggttgggtatttaatggaacatcagaattttaaaatattttgagttctttatctcccatcataactgtcatggaaattttctccataaagacctttataaaagggcactgatacctctctctggtgattattttagctagagacagctggacaactagagtctggggatgtggcactacaatgagctcattattatgacaattacgactcaaaatatggtgatgctttgcaacatcgcctgaggtttctttttcctgagctttgcagacccaatccttcatttccctccatttagagagccgctagtgctttttctgcacactactttgggttggggagggcagatacacttgaaaatacagatttttagcagtaagatatggactatttgagagtgaaattacatccttgagtctaaaaagctaaactttgaatatctggaaccaagaattgataggccccaaaacctagatttgtagtcaaaagtcacagagtgaggcagaatgtgcagtgatgtggaacagaccctgtgggctgggagcagagagaaatagacaaggagagcatgagaggggccctgcaggagcaacaaggtgggtgcattccctacctgagactttaccagaaaggttgagggagcttgggaaccagatgacctgtgtgccccaagttagcactggaccgctttggtagtcaggggagttgaggagggcagtggggagcccttggcagatagggcctgggaacccagagaagcataggagagctttgagggtctcagtgtcgccctgagaggggcccagaggtggtcgagagggtgtgggcagacctggaggtcctgtggatggagacagagtgatctgtgtggacctaatgacctgccagcaaggactccttcagtcacactcaggctgggcccatgaccagagaccaacatggagtgagtctcagtggagaagggagtagatggctcttccaatactaggatgatacagaagccttcccatgtttacttacacttcagaggaatgatatggagaatgagagaagaacaattctgaattatctgattatctatccaaaagggaggaaaaaattgccaagtgtcagagtttactctaaattagttagattaagctgtttgccattgacggaaatgggttttccaaagagctaagtttaatttttaatttttgcatatagaatgtaagatttatattctctatatgctcctgaaggtcctttccaattggtcagttctttcatattccagctggtctggcttttcttcctcccgtcattactctcttttcaaacacgccgcttccctgggctgagcttgggccgtcctctttttgaaaatacaagccgagatataaggttctagtgtgcctattatccatttaataatttatctggatgccatgtgttccatttatttcagtgtgtgcatccagtatgtgccaggctctgtgctggagggtgactgagcaaccagtgtgtgccaggctctgtgctggagggtaaggattcgggacaaaggttccagtgtattgagaaacataaacacagagactttaaagtcattttctaatattttcaagattaagaagggcagggagcagtcaaagaaacaacagaataggaggttaaaaactcatgacttggccacttggtagctgtagaaccataatgtctttgggattcaatctgctaatctgtaaaatgagggaggaaggaagacaaagaaatcctttagatcctttccagatgttaaattatatgactcttgtgagtttcaacagtacaaaattgtatagtcaactgaaaccccagggggcaagagaggtgacaggatatagcaaattcttctgttccattgtaagatcctcagagcagtggcaaggttacaccttaagcaactcatgctggggtgcgtacataattgatcagctccctgagtagtgctggcagtgctcgggacctagggaaggagtttctagatgttgtgtattgaagggcccattcttgcaatttattattattgttattattgtcattgctgttattatattggcaggggagaatctagaatctaagcttatgctacttggcttatttgtctttgcctataattacaaagttgaatgcctatgtaaagtgattaaatgaatctctgaaatcatctgaaatattaatatatttgccttatttacattttctagctactgatctcaatttcctactcagctttgtgtttatagtttcccgtgccgcaccattttgactcactttttcattcactctttcaacattttacaaaaattcatggagcctccattttgtcccaggctttgagccaaacaccagggatgtggagataaaggggatggcttagtgtttagcaggagggaaaaataacagacgctaaagtcaaataggctgtggcacatggatgacccacctgggtaatgggaagccttgcttgagcttgccagagctttgcagacagaacactgggctgctcctcatatcatatggaatgagattgcctgtgtgccagaaccaagggctgggatggtggtacagtgggaggaattctacaccccacaaaataacttgtcaaatggtggctgtgtgacttcctttccaatttttttcatctctgaaaagcaacactcagtgatgagagacagtggcccctcatacgtcagcggaatttctggtgatgttgcaacaggtaatataataacatgagtatgcaaataaaattttcaaaaatccaaagaatttgaattctctagtaaagtctcctgccttggttctagaagtagggcttcttgttgcaaaatcaaattaccaggtggtggggaaatggacagaccagtttatatgtctgatagggaatataccaggtagggaaatttcactttccttaatacaagctcagaacttccaggttgggcacaaaaggagaacttcatagagtgggaagtggtaagacctcatagcctttttctccctttctctctcttttcttccctgtcttcctcctcctttttctgagacttggcatttgtttggagtatcccatggatcactactgccatcatccatctgttctcaggggtgatatttaaaccctttaaaaccctggcaaaagcctagtcaaaactctgggagtacaaccaagataagctggaacgttcaatatgattttactgaagactaggaaaagacaagggcaaaacaaataaacaaacatacatcaaaaaaccgccagcactcgccatgaatttaaggctctgtgctttgctgaccccagaagagaaaagactcttctcaagaccctgctttccagtgtcttcccatgcagagactgcaatcttagctccaatgtaacttcttgacactcacaggaaaatgctggaccttcttatctacctagagccttgcttttgccatgtgactggcactagggaagacctcagccttggataagacctcaatctctaattaaagacctcagccttgcccctgaggtcctctttaggatcaccacattcaaatgcctccttgctggttgtgtgtgtgtgcacacgtgcatatttgtgtgtgtgtgtgtgtgtgtgtgtgttggtctcctaatgagaaaatgacaggcacttgaaggaaaaggaggagaaatagcagaaggggaaagggaagagagatcatcagaggatctttgcttagagtaaggatgaaaagagaagaatattccatctgtgtatgccctggagctgggctccagtgtagccgatccaaccatttcagccaccttgtccatggatatacagcctcaggcctgtgcctggagcaagagcacagcaggcttcactgatgacggagctggacacatggatcagacaggcaattccacggcccaggtttcttcccttcacaaaaggaaaggaagaaagtcgagaagtgagaatgaattaatagacaagcaaaaagacaaagatatccggagtgtggagaggcacacagaagaggctgaggctggggagatgcaggggaaggctgtccatgagctgccaaacagttgagatggaaaatgatctgtctgcatttatttatttatgatcacacggaataaataaatgatatggttctgagtcgagcacctgcttttgcattacatacagccacagataaggaacaggaagaatagaatggagaaaaaggccacatcagtggaagaatggcaggggatggacaagaagacagccctcgtgcattagttgacacacgtgcacagtggatctcttggggagagagagtgtgcagggagcgagcatgagtttgtgtccgtgcactaacaagaaagaaagacatcgatcctgtgatggtaagacaaggaggaaaacagagaccacttcttcctgtcactttctgctttctcttctaattcaaatcatgtagttcaagaaattttgcaccccaccttcatacactcataagcccaagtcctcaggacagaggctttgagctattcacttgttctcctggatctctgggtagtggtgtgcagagggcttgttccctgtctagtcctccccgagacaaactggccccctctaagggagagttctgtggttggtcccagccatggcagcttattcacacacgtgtggtgtgtttctgaatcataaatcttacagacagcctaggatgggaagaaaacaggctgccttcctgaccttacacttgggctgcccgtccctgtagcaaggaggagataatcagggcccttgtccagagccaatgtttccattatatttaaatttcacaaacgattgaaaggatcagctcataaaagcaaaagagagttgaggcattcaacctctctgggccttttaagaccacagacttattatgaccatgtgagtttccaggaagaagcttctaattaaagcttattgcctcttagctaccattggctggccatgtggctggcccttcctgttaattagagcagaaaggcatcctagtggggttgtagcctcacagagcccgtgcccaccttctggcccacttcccctgtgagctcaggaggatccagggctgccatgttggcccatcatcccctagacgtgagacttgggatccagacaggatattgcacctgtcttgaaggaaatgttcttgaaggaaatgataagactctgagctaccagtgatataaatgattaatggggggaattagttaatgtttgttaatcgttttgtagatacgaaatgctggctaagagctaaaggaagaagcagaagcagcaaaagctgaaagactttatatccacccaaatgctgatcatagaactccataatgttggagctgagggaaggagggatctccgagaccatttgctctatggtttgcaaattgtgcattgaggggccttctgggccgctgcccagcaactgtctgccaatgtttcctccccaaacaaatctcaaccagaagggcaaaataaagttccacaaaaaccgtgctctcagcataacttgaagacagaaaatgccagaactttaaaataaccagaataaaaagagaaccatcatcaaatcccagcagtacactttctggtactcctaggctatgcccctcggctagcaaaaggctccctcactccctgcacaaagcccttcactctggaagacttcagcgtgagcttcccacagatcctggtgtgaggagctctgtccaggggtctgggtagggaggaagtaaaatgtctccaggatcttcagctaaaggttcagtccttgcttacctctccccacctcacccttccccaccctaccccaccaaacaaacaaaacaaatcaacagatcaattctgtccttggggacatttatgatactttaggccaatcacaggagacttttatatctaatgtttggtgggtttggttctgacttggtacgtcagtttagaaactgagcacttctctgcctgatttgggagattggaccccctgctagtctctggtgtcacctcaggatcctgcccactgttgcacctgccaatggcttgcactgagaagacacactactccctggctctcctctccagctggtgatcccaggcctggctgcacctcctcctcatgttcctctgtccaccctggagtgatgccttactattgtcccctctgatgtgtcccaaatggcaaagaagagtaaagccaccactcagagtgtgggtaatcactatgagcagggaaggtcttcgatgctttatcttaacatttgcgtgcagtttgcattggaactcaatacatagccatgctagtttaaattaaaaaatattcctccactccaatcttttggtaaaactgaagctcttgaaagatgagccacactgattctttgggtttgcatgctttgggagcattgctacacatcctgcaggtgcaaacatctaagtgtgagtgctggccccactttaccccaacccacctgttggtacctctcaacctgtccatagccaaatgcctttagcctcctgtatggagaggctctggaagtactacagtgagctgaatctcagacctacagggtaaggtgctgagagctgagtcatctagtccttcttccaggggatgccatttcacttcaccgatcctgagttgtactagttcactgttggtccagtttttcttgatgactcataccaattgtttgtatcaattgttagttaatgaagagccgccaaggccactgggccaacaataccatgatctgcaatttggacacagggaatggtagagctaacccagtttgattttccactaggttccaggcactgtgtcaggtgaggcacacagtatcccatttaatcctcacatggacccagggataggtgtcactgtcttcatttcgcacgtgaattatctggtaccacaggatgtaatggacatgtagcacccaaatgactcaggattcaagtccacgtttttcttctccaagtcctatatcttctttccactgtccatgatgctgtatcccttgcttttctttctgttgcatctttttggccatttcactccttatgacctctaatgttggagaataaaacagagatagaggtgaggttggaaagtttgaatcctgctgtcagttgtttcaggaagacggagatggtgtgggacaggtggtgaactggaaccaatgtctaaagtgacatttctctgatcacatctggaattaatttatctgggtccaccctgtttgcttcacagccacattttttttaaggaacgattccagagagctcttagcgacctaaagagaaaacatcttcccaagccccttccccatcaccagctggagcatccgtctcattaataactggagcctaatccttcacattcaaagggagtcccattacccaaaacaataatatttttaattacccaggcagagtggcaattgcacattgaatactaaggatgatgtaaaactaataaatacttttggaaattcattgaacattttaatgaattaaaagttatgaaatatttataagcggtaacaacaccatttattaccattaataaaataaatacattagttagagaatgaaattcattactattttactaccagacattgatgtcaatgactgagtattgctccaaattacttgtaaaatagaccaattattttagtgtgattaatcttttcaattatttcctttatgtagttgtaatttgaaagtaattttcttctgggagtacaatgacctcggcacactcattctttatttatttatatttaaaaacctttgtgtctgcccccatttctgggcaagttccaatgatcgaatatttaaaatagttgcccaagcaggcattgtttctaagcacttcatggggcattttaaaattggctttattaataattatggataagccattccaaagtaagaacttctttgccaacagtagctaggcactggtagagaaaggaaagaccagcgaatttccttcctggttccacctgctttggcctgactgttttggattccagtcttcctcaagggaggcagtgtgacaggcatttgaaaagacctctctcctgcctccaactacctctacagaattaagcaggattactcctttgtgtggcacaaaggactctgtgcacccagtgaccaaggtaaaaaaatgactttatcaggcataagagcataggtcttaggaggcaagagaagcagctgcctttgcaatcagaaagcaagtctgggctgtcagaatctctgctggaaaagaggtaaattttccctttgcataatggctcaggcaaggcgcagatggaaaggcaaaaggcagatgtgaacctgtaaacataccccaggatagttgtgcagaattattcagctctggttccagaattaggagattcagcttagtcaagggatgccagagagaggatgagaatacgtattgtgccaagcattgtgctaggagctctgcacgcaacatctgttttaatttcccaaaaaacctataattatgtatttcctgatgagaaaatgaaaactcatagatttaggaaacttttccaagctcaaaaaggtggtgagcgatggagctggcatccaaatacattcagtctgattctaaagcctctaatctctctcctacattggaataagcaaacctttattgagtgcttgccatgaaaaaaaaaaaagcacttcactgctaattgagatacagagattttaaaaaaagacagtctttgattttaggaacttagcatctattgagtgagacacataaataactggagagaagtagacggttctaaaatagatatacatggaaacaattctgagtggagacttagagaaaatactatttaagctgggatttgaaagatgtgcaggtctttgaaaggtggagggtgcgctgcagggggcgcagatggaaccaaagcttgagctggggagggacatttgagaaatgcaagcagatctcagtggctgatgaaatcataattttcatgcttatcttttaaatggttcagtccacggtaagttaagggcaggagattttggaaatagggagtttagaaggagagcgtttttaaaatggagttgaacatccacctggagataggcactagaactaagtgaggatactaaggtcgtgactgcgatttctccttggtgatcacttccaagcaatagagctcaccattgcacggctgattgagtgccctgaagtgactgctccaggtggtggcacctccccaggttggcagtgtgtggctctcatcaccctcttggcattaggtcaataattaacatcacaaagctctgcaggaggcctcagaggagccagtttgtttctgtgaatggtaatttcttcatgagaaacagcagcagcaaggaagcaggttagttctcaaaagcttcaggcgaggtgaggcccagagaggttaagtagctcatggcatcatttacaaggcacctccacagccaccttctcactgaccctcagcatgaggtcaattttgagacaactactgacatgttgttatccctattttattttatttttatttttatttatttatttttttgagacggagtctcgctgtctcccaggctggagtgcagtggcaccacctcggctcactgcaagctctgcctcccaggttcatgccattctcctgcctcagccccccaagtagctgggactacaggcgcccaccaccatgcttagctaattctttgtatttcagtagagacagggtttcaccatgttggccaggatggtcttgatctcctgacctcgtgatctgcccgcctcggcctcccaaagtgctgggattacaggtgtgagccactgcgcctggcctatctctattttaaatgacaaaaaaaccccacaaaaacccaatctatgttccagttatgagggaaatctttaatgatttgaagtgtgatggctagtctatggcaagtaagaggtaggaaggagacttaaatccaggttttctgattctggttcagtgctcattctgtggtctttctgagaaaggaatgttggaactgctttggaggaagacatttccaggaatggaacacctattcagtactgacagaggaggagcactgccatcttggacaagcacctcatcctaaagttcatcttaatcaaaaaccacctaaatccaaaggacatcagcctaatggccaaggtcagcatgaccataaaccacaaataacatctctgaccagaaacattccaaactcctccccaaccagagacatgctagccccgagatagtctccctctggccggaaagatgtcagccccaagataacctctcctccgtccagagaaattccaaccccccataaacttctcccccacacagaaacattccaagcttgtgataagcctgctcactgtaaaaccaatatatactcttagtctgtaagagaaagctctcctgaccaaaattggccagaagcccctctcaggtttattttctctaaaataaatctgtttttaaccattgagccgcattttgtgtttctttcctctttctttaactcttacaaactcttcgtaagatttgcacttactttgcacaaacccttacaacccttagggttagggttagggtgcaaattaaatataactcaaagatgccctttaagaaagagttctatgtgaagtagaatggaaatgttaaaggaaccacaccaaaattcagtcctaagacagaaacaactattttatattaatgttagcatgtacccagtttagtacttgctcagaaactgtctgtggcatagatgagtggatgcatggatggatggatagctgagcctgctacatacagagtttgctgctggcagccccaagacagagtgccactgtgatctacattttacaagcacagactgaggatcctgctgaggcgttgcttgctgttggaagagaaaatgcccagtttgggccaggctgctaggagcccatgaagtaatccctcatttacccagctggattttggagcctactctagatgttgattggttccacatggctggccaaagatttgaatctatttgttcagcttctttcgtttcctcttgtcccctttcaggctaagaaagacatcttccattgcccaacattgtctttggtggagaagaaggagagagagggggacaaggttacaggatgctacccattttttcctggaaatatttatactagctacatatccagcacctcaaagccagaacccacctggacaagaacttgccttgtgaaaatggcccatattcaaagtctaatagccttgtgctaagccctaattttttaaataagatacagttaatatacctatttttggttttcatattttaaataagtgtaacatctaggaccagaccataaaaactggagttaataggagagctgaggccgggcgtggtggctcacacctgtaatcccagcacttgggaagccagggtgggcggatcacgaggtcaggagttcgagaccagcctgaccaacatggtgaaaccccgtctctactgaaaatacaaaaattagccaggcgtggtggcttgcgcctgtaatcccagctactcaggagcctgaggcaggagaattccttgaacccaggaggtggaggttgcagtgagctgagatggcgccactgtactccagcctgggcaacagagtgagactacatctcaaaaaaaaaaaaaaaaaagagagagcttagaatcagactgtccaatggttcttaaaatgtatttcatgaagccccattgagggggaatgtcaagggctctggaacaggtgggttctaggcgcccccaaagacagctgtacttgtatcattttatatactgggcttccatataagactttgttttaattaaggcttcaggctctagaaaaggtttgaagagagttcaaacaccctcattttagccccggagaagttaaaaaatggtatttgtgcatctcagactctttggggacatgtgtttcaaggtatccataataatgggactgcatttgactttggataccttcaccttcctgagccagagaagttagagaaataacttctcacgggtaaggtgaaggttatgacatcctctctaatgaatgaatcagaagcaatgtgtatgaaattatctcagtagagtaaggaaccaagaagattacttcttttgagaaatctgttagtgagctgaatgtggctgtggcctgggaaacctcagatgtgtttttgtaggttcctgaaagagaagaggagatatagtggcctgctataaaatgtatgtaggctcacacaggagctatctacatttccttgtttttcatgggggagctcctttgcagctctttgtcttcatattgactagtggcagtggtccatttcaactgcctctgaacaatctgagctgggaaagggaaatactgaattgatttcttagaaaaattgagaacttgacaaccataaggtggaggcagaaagcaccttgggctggtcagtaatttagtgtatcacatttcaaggaaaatcattgggtctttgttcattcaatttctacatggcaagggagacagattagatatttctggtgtcccttccagcagagatcttctgtgcaaactgcaaggtgtggtagctaagaacatggattttggagccagatggcctccatttcaataccagctgtgtgactttgaggaaattacttaggtctccgtgccttgatttctctatccataataatgggaataataatgataagaataatattacatacttcatagcattgttgtaaggattgaatgagttaatatatgtaccatgcttagaacagggcctagtgcatggaagagctagatgagggtttgcaatgctgtgcatttttaggagctgttcagggccatgctgatcctcccctcccctcccctccctccctctctttctttttgacagagtcttgctctgtcacccaggctggagtgcagtggtgccatctcagctcactgcaacctctgcctcccgggttcaagcttctgcctcagcctcccgagtagctgagaccacaggtgcatgccaccatgcctggctactttttttgtattttcagtaaagatggggtttcgcgacgttggccaggctggtctcgaactcctgacctcaggtgatccacccaccttggcctcccaaagtgctggaattacaggcatgagccaccacgcctggcacactggtccttttcaaatccctttcaagaagctagtctttcccattctgacgtatgtgttgctgtaggcacctctgaacctgaggggtcccggtgagtgtcctgcgtgatcctattgctctgggttgtctgctcaagaaaggtttttgtgaatgggctaagggttccctgggagcccaggcatgggtgtctctgggggctgatgtctctcttgcctgtgctgattgtgtaagctgctctttcactggcctttcagtgaaaaatctcttccaagccatttctacttacagctactttcttttggaagtagtagggtaatagcccaaagctataaaagaaggtgcagcatttatcaattgattgattaaccaatcagtcaacatgtattcgtgtggtgttttctgtgtgtttagcaccatgctagctgctccctggagaaataaaagaaatgtaagacaaggtcttgaacttcaagttaggatcccaaaatgattaaattggaaacaattataaaacacctactaaatttagatgtagagtataaagtcttccaaggagaatttctgtggctgcaaatgacatttcctggccccaggaaatgagtaaggtggtccagtataggcccctttttctattattttctgatgtgggaggcaataagaaatgacctatgtcacatgaaagcgccacaaaagaaggagtaatattgaggagatttatctggcaacgtgtggaagatggaatggtatcagggagaccagttggctgctgccaaaattcaagtctgcgtatatgaagaatatagaaagaataagacacacagctgggaatatgaagtcagaagggtatatccaagagacagcaacagtagtattgtgttagtccattctcacactgctgtaaagaaatacctgagactgggtaatttataaagaaaagaggattaattggctcatggttccacaggctgtacaggaagcatggctggggaggccttaggaaacttgcaatcatggtagaaggcaaaagggaagcaggcacatcctacacggctaaagcaggaggaaaagagcaatgaggaaggtgctgcacactttttttttttttttttttaagacagagtctcactctgtcaccaggctggagtgcactggcacgatctcagcttactgtaacctctgcctcctgggttcaagtgattctcctgcctcagcctcccggggagctgggactacagccgcccacaaccatgcccagctaatttttgtatttttagtagagacggggtttcaccatgttggccaggatggtcttgatctcttgacctcgtgatccacctgcctcagcctcccaaagtgctgggattacaggcatgagccaccttgcctggctgctgcacacttttgtttttgtttttgtcttttgagacggagtttcactcttgttgcccaggctggagtgcaatggtgccatcttggctcaccgcaacctccgcctcccaggttcaagcgattctcctgcctcagcctcctgagtagttgggattacaggcatgtgccaccacgcctggctaatttttgtttgtttgttttttgtttttttagtagagacggggtttctccatgttggtcaggctggtctcgaactcccgacctcaggtaatccgcccacctcagcctcacaaagtgttgggattataggcattagccaccgtgcctggcccactgcacacttttaaacatccagatcttatgagaactcactcactatcacgagaatagcaagagggagatcctcctccatgatccaattacccaccagccccctcctccaacactgaggattataattcaacatgaaatttggtgggaaggggaagacacaaatccaaaccatatcaagtatctagacagagacagatagaatacaggcaaaagcaagtctagaggtaaaggttctggcaatttgggtgtagtggtaaaaggaacaggaagagtcaaagatgatgctaaggttttcaggaaataaatgaaacctcagcctcttccacaaaggcagcagaggctagtggacagaaacactggctttgtcatcagatcaacttgggatcgagtttgactctacttttcactaactgaatgaccctggcaagttttgaaacttctgtgagcttcagtttccccatctgtaaaatgaggatattagtccctgctttacagcattatcgtaaagcttgcatgatgtaacacataaaggcattgacacttggctttgcgcatggcgagtgctctgtcaatgttagctttttgctattagtccatatcaactgagatgaactgagcacctacctagtgtcacacactgtgataagtgtaaggatgtagagaggatacaggcatggcctctgtcttgatgacacccacagatagatattgtctccaatgcggggagaattgtcccatgtctccttgagccttctccagatgaactaaaatggcacgtctctgctgtgggccaaggaagagctgtggagttctacagttgtgtttccccttgtgctccatctgtgcctcatcatgaagggaccaagttcttatcagaaatatagaccaggcatcctgcagaccttcctacagtcctggccagtaatgttgccagccctattcacctccttcaaagacaccatttttctccttttatcccctcttcttctggcttaaccaaagcaatgaccccagaaaacatagacatttgcctacatcgaatagacattgagtatgcctttaaagtaaccccttccctttaaatatgagtgtaattttaggatgattcttatgtctgcaatttgtctatgcctactgatgcgcacctgaatttgtcttctatgggaaggaaatttagaagttctaagcaaacactgagatcaccttgttcttcactattctctgccttacacatccgtatcaatcaatccctccccatcccttgttgaccacaggcggtctgacccagagaagaatcacagagaacatttgcctcctcatggagaccatctgttcttggagctagagccactgaaagaaggaagctggaccatgagaacttccccaggtatctgggccaagccactttctctagggaatcagaggaagactcatcttctccctcctctaagagggtgccctgccagcggagactttctgagattagaaagattagaaaaaattagagagattttagggaggtcaactctattggttttgtaaagatagaaaagcagacaggaacgggtctctggaacagactcactgcgaatgcaacacaggctatgggggatgaatgtttttaggtgagagggagttgcagggcaagggagaaaacatctatagcttgagatccttgattttaacatgcaaagaatttttttcaggtcaagaaatttttgcaggagtatttgttgtgggcctgatatctggacttttgcagtttcttattcctttttcctaatgatgatcaaatgagaacattctgggaattgatactttctccctgccacattcttgttaactggttccatttcaacagatggcctcttttgtatggtacatagatccttgacatctgtgaggactgatgatgtccagagacattcacaaatcttcaagttcatgagtgcggaaacatttgtacaagctcctggcttgctcccaagccacatgtttcttatacattgcctcatatcataggttaaccaccttttcaacttgaactgtggttcaatctatcacattatggtgatttttcttttccccacacataaaccagttttgattaaacaacgaaaacaaaatacactataaaatttcctgcaaagccagcaataaatgaagagccacaggggcaaaagaagctgggttggtgaggggtcagtagggcttcctccctaagagaatccctttcacacaccacttcccagaggcacaaagttcaaatccaggcctgtacatggaacagatgactgtgggacatgggccttcaaagttattcaggaatagcctaaattgagaatttaggtctgggagtgcctcaggcttcctctgggtccacgcttcattcttgggcccctgatcctctccctcctcccacccttccctctccaccctccgttaggccccaatgtctgctgttcccttctatgtgcctatgtgttctcaaggtagatatcattttataccagctctttgaaattgattatctgggatatggatcacctggtatcattcagaactagcccctaaaacactctagactttttttttttttgagactgggtttcgctctgttgcccaggctggagtgcaacggcacaatcttggctcgctgtgacctctgtctcccaggttcaagcaattctcctgcctcagactcccaagtagttgggattacagacgcacatcaccacaccaggctaatttttgtaattttagtagagacagggttttgccatgttggccaggctggtcttgaactcttgacctcaagtgatccacccgtctcggcctcccaaagtgctgggattacaggtgtgagccacagcacccagcccactctagacttttcttcataagtgtgcacattcccagccaaacatggttgcaggttattgacacatctaacacaataggctaccaaggagcgtgggaaagccagattcagataccttcactgcagttcttcagggcaaagaagtccactgcagacaagctgcggtttccactggagatgtattccagggccactcgaaatgggttgtctggacgcccgattcttccctggagcactgtccaactggttgcattggaaaacagaggagaaaagcatagagaaacagatatgagaattaggcctaacatgtggacagggtcatgtccttgcagggacttcaggactcacattcttcatgggcaccaagagatgggactcgaagtggcactgaggacagtgattctgacagcaacatgcaaatacttatttccttttagtccaacaaacttagagatccaattcacgaacccagtctcaccactggcattccttttgtcatattctgtttaaggcaaatgcagctctttggactatttgagtagctagtatcacaagaaagaatatatatagttgagaaaacctgccagtaagtagactcaaggaaatgtcttcaaaacatgtatcactctattcaaaattatctctagaaagaatgattggttttcagaattttatctgatagaaagtctcggaaccctcaggtttgctctacagttacttaagacggaagctagtaagaactatttatttactgcaggaaaattaaagtgcaccgaagcatgtattttggggtaaaaggtacctaagactgacgtggactttgcaaaaagtgccaacagaaaaagatggaagcaggtgaaatggcgagctcggcacccacctataatcaaggatactgacactgtcagagaatagagaataaattaaatgaacacttttacaccttgctcatgctattaacctcttgaaatagcctcctgtcactgattggaccatcgaatttactttccagcattgattcataaatgtctgcgagtgtgtgtgtgtgtgtggatttatttacttacttattttgagtggtttgtgtgtaaaataaaaattacctagattatttgatattttctttccttaaaaacaattttattgaggtataattgatgtataataaattacatgtacaaaaagtgtcactttgggaggccaaggtgggcggatcatgaggtcaagagattgaaaccatcctgcccaacatggtgaaaccctgtctctactaaaaatacaaaaaatagctgggtatggtggtgcacacctgaggtcccagctactagggaggctgaggcaggagaatcacttgaaccagggaggtggaggttgcagtgagcagagatcgccactgcattccagcctggcgatacagactcttgtctcaaaaaaaaaagtgtatgatttgatggtgggttttggcttatttatacatctatgaaatcatcacaatatttcacattttttttttttttaccagtaggttgggctttggtatggcagtacaagtggtaaaggattaagggaaaaactagctttccattaaataaatttttttaaatatttccaccccctaaatataaagtgatgctcactgtaaaaaataaaaagcattgaaaatccaactattcagaaaggctgataatggaaagtaaaagtcacctagaataccattgtccagcaataaccatagtcaccacctaaggaaacaacctgtcaggttgtttttttttttttttttctgtcttgagacagggtcttgctgtatggtccagactggagtgcagtggtgtgatcacagctcattgcaggcttaacctccccaggtttaggtgatcctcctacctcagcctcctgagtagctgggactacagctgtgagccaccacacctggataatttttgcatttttttgcagagacagggtctcactgtcttacccaggctggtctccaattcctggattcaagccatccacctgcctcagcctcccaaagtgctgagattgcaggtgtgagccactgcatcaagcccaacctgtccattttaatccattttaatttttcatgaatgagaccatagtacatatactctgtggttgcactttctcacttgatggtatgtcacaagacaatatagattacagtatcattttaatgattgcatttttaatgacctgtgcattgcttctgattttttcttgatcatgattatgccaaagctaactctgtgtacttatctaaatacggcctaaggacaaattcttagaatcagagtcaaaatgtgtgcacatttaggcatatcgtcaatcctgccacagtaaatcgggggcccatttctgcatgcgcttgctaacactaattcccaccaaatcttttctgcctttgctaacttttggtgatgaaggcatcgcctaagaccatccaccatctctttcagcgcggtgctcctggatggtagctttatgtctctggtctctggcatgcggtgggtgtctgctgaatgaaggaggtagtcttcttccctatcttttctctctgtagttaattcaggtcactgaagctaattcttcagccatttaataaaagtgtattgagtttccccacaatagatgctgtagaagggattattgctgctgtaaagtttgttctctgttaccgtacccagcaggatttccatccacaataaaactggtgcaattgaaggaaaaggagggctttcggtttaaatgagggactgtcaaagatagcaatatttgagaagaacatgtaaacaagtggttcttaaggagataaacaaaaagacaaaaagagccgaatttgtcttgttcttctgaaaaataaaggacctatttttgaggaaagatagtggtgaaaggcaggagtattcatattctgccaaaatcatagctctctgctctgagaaatgatggattttaattccaggtacacagcggcccttgacaatgatttccatttctatattggcactagccctctggataaatgtgtcaagagttttaggaattagtttctgagttaccgatgcaataacttttgtctgaaattctctggcctcccatagtttactgctgcaactttaataactttcagagcagttgccaaacatgtattttatatccagggaagttgggactagaaaagggcaagcttatatctagggtcagatttgtttaagagaacgccaaaaacccagtgaaaaacaaatctaaactctcttcttggtctgcctccattttctttgcttacacccaagtggtcacagaatgagcctattagggtcctgcttttgtcccttcggctggtggcaattctacttaggcttgcagaagggaaggttatgttctgacctagagcctcctggagacaaacgtacagctggttccatgtgttggggatttgtgactgtcttatcactggtgcttccatcaatcaatgtgacagtgtggggtgtccatctggactttaggaagtcaggggactgtatggacagcttgtcacaatccattatcttccctgtgtctctctggagctctccggttccagttctggctctgcccctcatttgcctgatgactttgaataaggcacttctctccaaaaatgcctgaaatgttggatgttttctgatcaattgtattctgcctccaactttgcatgaattttttgagaaaaacacggaccagccatttttgcagagtgcctatattataatgagtatgttagagtccatcaaaaaaggcaggagggttggcttgtgaatatcaaggtccatttctgacctacaggctagaagagatatgtagaaaagccactgaattgggagctgagtcctggattccggtcgtggatttgcgtgggcttgggcaagtccctgcacctctttgggttttagtttcctcattagcaaaatgcaggcattgaattaaaagttccctaagggcccttattgatctgatatctatacttccctagctgattgcaggagtcctagtaacaaaacattttatgaaagccctgaaatctccaatggacaaataatatcccacagaggtgggaggagaatgattaatcacagaatcgcagatttatttctgcaaaaagactcagtttcaccctccttggagaagtgaagtcttgctcaaggtcacacattgagttacctgcagacttaggattaaaataaagcatattattgctccaagactgcaagcacaagaggcaatgcaacctatggatcagtctatacagtcaattgcatttcatttccctaaaatctcagagacagagaagaatatgtctacttagcattgctggaggcatcatcaatttgggttatcaggatagacacactggccagatagtgaaatactttgtcagaaaaatctacaaaaaaatcacaagaagctctgacatggaaacaaaaagaatttctaagcctcccacagctccctaccagcttagctctatatgtttaaagaaaactgtctggcacatctgatacaaggcaagccgctgatgagtttgaaaggttggcagctgtgactcaggagggcaaaggcaccaagttattttaagcccagaatgaagggacactttatgacaacacgtgaggaccatgagtggcagttgacaagacagggaacatcatactttgcttctgtgcaatatcccagtgggcatcatgttgacatagggctggcttccttaagtgtgccctcaaacccaccctacatacttttcaaaggaatgcctttctgagatggttttagctgctgcagtgtagcaaggcaaggcctagattcagctctcagctccaccatccaccaccctaagctacgaccttaggcaaatgatttaattcctctgagctccagtttccctatttttaagatggaggtcataatgcctaacttgctggattgttgtaaggatttttgagaaggatgcatgcagagtaataattcttagcacacggtaggagctccataagcggagctattcctatggaaaccactgctttcttcatggaatgacactggtccttgcaaatatctgcatctcaattcatttatgagcgtcaaaggagaaaggaatatagtaaaagagggtgagaaaggtattgcaatttatgagtagcagccatcacgtttgtttaaataaagaaaaacttggttaaatgcatctttatacgttaaatacaaccccaagaaattatgttagaacatccctacaagatgtattaggatttgactatgatagcagatcaccactcctctcagaatcctccaaaggcctccatctcacttagagtaaaagcttcttctttacctttgcatcttcctgtaggacatgaaaagatgcttggtgtctagttcttggttagcatttgttgagtcgcattccatttctcagatatttactggtgcattgttgcacactagctaaagtattggatgctctagggatgcgaagtgtttaggatgtagccttgttctcaaggagcttacagactggtgagaaagaataaacataggtaccaagatttttagtgaatggtagcatacgagaggtgagtgagaggtgtaggcaccatatgctattaaagccgaggccaaagtgatgtctccaaatggatggtcaggataggagtatcttgaggacgggttgtgaagaggggtcaggaattaggaaaagggcaatgcagaaatgcagaaagagagactggcatgagcacatgagcagaggccacatagacagtgtgtgtttggagaacaggtggtccaatcttgcaggtgccaatgtttttcattggcctctacaggaaggatgacttctgtgtcttgccttcccacctccttaatgccagaatggtggatcattcatcacatgtctccaatgccttatacatcgtagacactcaaaaaatatttgttgactgagaggacaaatgaacatatttctgttaaatcagacgagtttctgacactcttggtcaaaatttatattgcagtggagctgagttaatccaaacgttcgtgtcaattcatgaacactagctgtcatctattcacatgataatgacgccttccctgttaggagaaatgcaaagactggggaactttggcggttgcattattactacatagctcatcacataactcttggcctccatttgccaagagcgaatcagaaggaaccggagaattatgtaattgagacctggaggatacctgagttctcaactatgacagttaccatctgttgcataaatgttctctccaatgcaggtcaggcttggaccaagtcaatatgaatactacctacagcagcattaataatatgaccaacaagagttaaaacttattaaaggtctactatatgcgctgcttataactgagtttaaaatgcaggttggcatgcctctataatctttagaacaccattttattctgccatttaagctccctgaggttagaaactgtttttccgaggctttattcctatttctggctctgatgaacatggctggggacctgaagctacaagatgtggctatcctcatgtcctgtgctggtcatgagcgccaagtcattcggatggtgactgagctcctagctgggatgcccaaactcacgggtgagatcgacaatgacaaaagccacataaactagataaccagccaagtccctgtcacatagaacacagtcacgtggtgatgattattatcaagcataacactgtcaggactcaagccacactgctggcattcctccacatgtgtctttgctaagaatctctcttgacaagtgtctggacgaggtgtgaaggtgtaaagatttgttagaaacaaagaactgagcctgtgggagtttgtctggatcaatacagaaagaaagagaaaaaaaaaaaacatttgaacctctctctctaatcttatcctacagggaaaaaaaacacacaactttcaaattttccttaaaatatactttgtagtaattctgtagcaaatataaaccattcagcacaattttttactgtttccattaaatcagcctgcatttaaagcatttttatgggagatagcaggggaaaaatgctagatcaatgtaaattttagtgtgaggtcctttgttgcttattaattttctgtaataataattacacatggcgtgtggcatggagtcttttatccaagtagccttggctttattattcacttgcccttcatactttcccacaagttagatgaatgtgctctgaagaggatcagctgtgaaaggaagaggtttcaggtcgaaaggggatctggcttccaatggcccagcgtggagaagagctgctctgaggctaagggggctccaggctctgtagggggggccaaggcagggctgggttccctggggctgcaggcctgcttgttgagaccttagcattgtcagctgtaaagcagttttcatttcatcagagatgttatgtgggtgacggggatctggaaggtaggctggccttcctggggtagaggcatagaagatgttccaaactgcatttccttaattattttctcatgtttcggaacaaagacaacataaatggtcctgagctccttttcctagcctcttttttttggggggggggtggtggtgtggagtgtcactctgtcacccaggctggagtgcagtggcacgatcttggctcactgcaacgtccgcctcctggctcaagcgattctcatgcctcaacctcccaagtagctgggattataggtgtgcgccatcatgcccagctaatttttgtatttttagtcaagatggggtttccccgtgttggccaggttggtcttaaactcctgacctcaggtgatccgcccaccttggcctcccaaagtgcctcctttggggttacagccatgagccaccgcaccggcctcctagcttcttttgagcttcttctaacttcccctttttttctctcctcccttgttccctccctccctgtctccctcctctctttcttgcttctattcctccctcacttttcctttccttctttcaagagaaatataataattaagcagccagacttttattggctgtgtgacctcaggcccctggacctcctgctctcatcacttgagttccacacctactgagagttttatagtctcacttctgccttttattggctgtgtgaccttaggccagctacctaacctaacctctctgtgcctgaattttgtaattaagaagtgggaatactaattgactcataaaggggtattgtgaagatcacatgggttgagatatgtgggcatgtagtttgcactcaataagcattagcggatgctgttgttattattatgctagtgtttcttttctctcctaaatccagtgtggctgatgatcttataagaaggtgaaataagagattgactgtgtggtgggatttgggggttttggagaagagcctcccattccagacataaaggtttcaggactccttccattaaatatgaaaatcttatttaattttcctaacaaatgcatgaaacatatcatcatcctcattttataagagagaaatttgaggcttagagagctgacacagctggttcatgtagtaagtactaggaggcaacgtgaacccaagactatcttcaaaactctggcacttcctactataatgcacataggtttagatgtatgccaaatgcaagtaactcattttttagaagagcttttggtgggtcagaggtgggttgtgcttgaagaacagcatactagcaaagggtgcatcctgtagatattttggcccctttcattgttgcctcaggctaccttattccttttctactcgacctctgcatcttcagaatctggactggaatatgcaggcttgttgggggctgatgtccaccctggccctggctgagcattttttcttcattctgtgtaccaggccagaaggtaggagacgaagagtctacctctacagacttagcctctaaatcattgcaatcgggatggggaggagtaggagtagactgatcataaccacagttgtaagaaaaacatagtagtagaaatgttcttaactggacttcgtgtgactaatttgcttgctggattagcacaagctctacattttacatgccgtgaaataccctgtgccctctgaatgttcaaggttgctgactggtcaaggttactgagtgttaaaggtcagtgaatgttcaatgttactgaggttcaatgttcaaggttactgagtatttaaggttactgtgtttaagatcactcaaagttcaaggtcactgaatgctcaaggtcactgagtgttcaaggtcactgaatgttcaaggtcactgaatgcccaaggttactaagtgttcaaggttactgagtgctcaaggttattctttagtacccctagaccccctactcccatcatttgagttccacacccactgagagtcagttatgcttattctgtcagactcggaacatgatacccaaaagtatggccccttggcatgctgagtcctttgaattgaaggaccttggaagggcctcagaagcaagttctgtctgaccttctcttcccctcctgtctctcgcccctctttctcccttgaagtgagttgtagaaaccagaagtcctcttccccaaaatcagtcataggaactagcacccctctcccctggagcaagccataaaactagaatggttattctctccctgctgccttgaagaccttcattccataggggtcctgctccacacccaggaggaagaaatgttagacagggaggccaaggagaatctgaacccacaggcttgctaggtttccccctcagtccgtcaccactggatcatcccctttctgtcccatccccttctgcaatggctcactcttcatcaaaccaaacaaagacattgggtcttcatttctgaaggctcccaagtaacgtaaaactttaattaaacaaatttgttttgctttcctcttgctttcctgtcttttgtcctaggagtgtccagagtgacccttgtgatgggtaaggaaaagtgacacatctttctgcccctacagtttctaaaacagtttatgccagctgtactcattaagtggatgaaataggcaggagaacatttgaatactttggaaagactggtagctggtgagtcaccacaaataattactgttgaattaggtgtgaatggggcaacagaaagatcaggaaacaaatcttaaaaacccggaaagtctccagagagccttcagattacttcacaagtatttaaaaattatttccattttaaggaaatggatactgaacatcatggatgaggtgttatgaatgtaatttatgagaaagacaatgaggaactctaatcaacagaccacaccacactaatttggccctacatcaagcactggtggattaacatgcatttagaagttgcaaattaaaataaaatatataaggatctaagttgattcccaaacaacaattggtcccagtagtattgtctaagagggattcttctttgctctggtttgtataaaaaatatatagaagatgcatcagtggtttttttcttctttttaaaggaaaaaacactgattatccagaccagaaaaaaaaaaaagaaagaaagaaagaaaaaaatcaagcaagagaagacttctaatcaagagtagtgaccctgagaatcctgaatttcctctttctgtttctctaaattttggattaggtcccatgcaagccacctcctcctccagcatctgctgagcatccctcaccagggagctgtggggagggacccagctgaattctgggcaggggaagtgagaggggagagagtgtggatggtgctggcattccaggaatcacttagaattagagaagagaccacaggaggggattccagtgggggttttccactccacaaacttgccagacaatctttctggcagggtgggtggtagattttctgtgattagagtcccaggtgatcattttgcctttctaactctttctgtaaggagatgtgggcacatcacccaccagcagccagtgggaatctggaatttggtttcctaactctctctttcttccaataactttttagcaccatctgttcttttcaaatacaatcttttctttcaagccaagtcaatgcagtaggttttttttttttcttcaatacatcatccccatggagaaggataaagacaacattgaaactgaaatgtggccgtttctgtgggatccctccttcagtccagtctgcctccagcttgaggcctgagtcttgagcagggctggagttggggcattcatccagggcccccacttcagagctcccgggatttcccagtcctagaagcatcctccctgcccatgctcaaatgattccagcagcccatcctgttccctagagaggcagcctaaataccacttaatgcctgcatgtattgattggttcaaatgcgaatgcaagcctctgagccaagcaaaatgctgacacccaagcccaaaggctccatttcagccataaatctctggccaagtcaagccactgtgctgaaactttatacagtagggtgaaacttgccataaactgtggtcctgtaagcaaattctggggctgggataagtggtcagccagaaaagcctggaggagcctggtgaggtggggtaagaatagctcacagacttgtatctgctagagagggtcccccacccacaccttgctatgccctgccccttcactggggtggtcatggttggaactcagaacatgaccccaaggtatggcaccttagcatgatggggactttaaactgaaggacattggagggtcttcagaagcaagttctctctgaccctctcctgcctttctatcccctgctcccctttctcccccaaggcaagccatagaaatgagaattgttgctctaaccttccccctgcctttctgtatagagctgtccataacagaattctctgaactaccttgttggatagcagatcttaagaccctagttccagagggtcctgccctgtaccagggaggagtgaggaaggagtgctagacaagagaccaagaagaatccaacagccaggcctttttggggtcccccttctgtctattagccttagctcatacccttttgcctaatcatatttctacacagctatctgttcttcattgaacctaagcataaaaacagaaaatttcccctgggtctttgggttttcatttctgaagcctcccatgtcatggaaaactttgactaaatacgtttgttttgctttttctctcgttaacctgttttttgttataggtgtgtcagctgtggttgttgtgatgagtgaggagagggatcacacctttccacctccacactaggaatgggaaggtaattgtcagaggctttgatggatggtgctctgagccctcttggtacaaaaaaggctcacaagccctcccgtgctgcttatactccatggtggcaagtatcctggataataacgctgttgcaggcttgatagatgttaagaggggtctgagccttggaaatcactgtgtctaatcctctaatatggcagagaagaactgagacccaaggacacatccaccttcagcccgaggaggggtccattctacaccccgtgtcaggaataatctctttaaaactcaaacatggccgggtgcagtggctcatgcctgtaatcccagcactttaggaggccgaggtgggcggatcacgaggtcaggagttcgagaccagcctgaccaacatggtgaaaccctgtctctactaaaaatacaaaaatcagctggacatggtggcgtgtgcctgtaatcccagctactctggaggctgaggcaggagaatcgcttgaacccaggaggctgagagttacagtgagctgagattgtgctactgtactccagcctagatgacagagcgagactccatctcaaaaacaaaaacaaaaacaaacaaaaaaaaccctcaaacatgaccacagttctccaatggcctcgggacctgcctctggctccctgcacataccagggctccttcatcctccacattttgctcatgatgttctctgtacccagaggccctttgttactatggttttttttttttttttttttttttgctacttggctactcctcattgatcaaggctcatcttggtgtttttcaggaatacacctcccaggttggaccaggcaactggtataggggacaagggcaaggagtgccaaaccctgtctgagaagtttttggaaaagctttttggagaaggtggcatgtgccactattggctggcttccttcggtcctagtagggtgggcaggaaaggcagtatcattgtttgaattgtgactcactcaaaaaggtatgtttaagtcttaaccccccatgcctcagaatgtgactttatgtgataacaggatctttataaaggtaatcaagttaaaattagatcattagggtgggcacccatccaatatgactatattcttataaaacagaggggaatttggacacagagacagatacacacacagggagaatgccgtgtgaatatgaaggcagggattagggtgatgtataccaaggaatgccaaagattgccagaaaaccactagaagcacagtggcatggaagagattcttcctcacaggcctcagaaggaaccaaccctgctgacaccttgatcttggacttctagcctccagaactgtgagacaatgaagttctgttatttaagccaccagtttctggtactttgttatggcagtccttgcaaactaatacaggtcgatcattcaaaaccatccccactaactggagaaacaaactttaaaagtatttttgcagacttcggatgaatggtatcattttctatgtgatgaccagcctggtggacagaccagctgagaaaacaacttatttcttgcaaagcagccctattttccttgtggccagaaattgtacagaacatttttctacacgtttacctctgcctcccagatgaatactatcaccatacccttcagggaggcccctctgtagaatgatactaggaagtgtttgctaacaatgcaggaatcaagggcccattagatttgcccaggctcatgctcacacctttaagccatgcttgaggaaactaatggaatttggaattcagaattcaggcctctgctgtatcagccatatgggagctttcccgaacataacaaacagaactgcttgaggccctgagattgtgccaacgatatgttcacttgggagtcaatttctgggctgggactgccactgccaattttcatgactttcgagggtcagctcaaaattgtgacctggaacttttaagggatgctgagcctgcatgagaggcaggggcacatgcaggagccagaaagatgggggctagggctagagggggcaggaatccctgggcacaggccagcgtttcctcccatcttctcatttctctcagactttgaatcaatacagtaagaaagccccaaaccctcaggatcatttgacatggtccctggcctaatacactggaagctgtaattttctggaaaggacaggctgctcccagtttttggctggttcagtccttcagtgatatatttaattgataagggctcggccatctccaaaacaggaatagcccacttcctttacctgtctcccaagagatgtatgcaaagtgtcttaatacagagcttcctggacacccactgttttataagtgtcactatagccactggtgagctggcaatgcagttttcttaaaagcaaaccaagcagaaacctccaaagagtccataaaaactggctcctggggatgaggctgtaaaacccatgtcttcacccaggcctttttgtgataggtcacagaagctggcatcttttcagttgctcggcatgtttcttatggagctgggcaggagagcaggacccccctcctccttcccagtttccagcattctccgaggtcagaggactctggaatagaccgtgacaaaggctggaaagatggaatctggcatgtgagctcccacctcctgtgaattctgtgggtggttgcaaagttctgctgacagctcagagcaggttcagagacagcattcaaaacagctctgagcctctgattcaaagcgctggtggcctctgctccaaggcagttaatggacactcaggctcttcatggctacagggtgaggcttgtgtggcaggagctgctgcaggggtatctgaaaatggtcgagactgtggtctgcaagagtctctggctttggaaacctgccaatgatgtcatccaagtggtgacggtggtgcttgttacactgacattagataatagttacattagcgcctgccatccttggacactaactctgtgtcagacgctgggcaggaattcttcacagttatctcatttaatctcttaggagctctaagaggtaggaattgttgttcccattgcacagattaaaaaactgagattctagcaagtgaattatcttgttctaggtttggtaaataacagagatgaggttccaacctagatctgtcaaattccgagtccacagcaagggtgagtccttgggacagccaggggaccctcagctcagtacactctttaccatctaagagggctccctgtttccacacatacaacccccaccgcccaactaatctgattcttacagccaccctgggcaaaaggcacgagggtgcccgtgtctcctttgtagcatagccaggcaatgcggaatgaagagctacagggcatgctcagaagattagctagtgtgtgcctgagcttgggcttgggattgggatttctaggctggcactcccttatccaccccttgaagactcctgcaagtgggaagtgcctcagagcatggggcttggccaccatggtgtctgcctgctgtgtgtgcctgtggagcctgaccggtgatgtctcttccgtttatgaggtcttcctttggtaggggcatgagaggggcttatatgtgtggaggagcctgggacaaaccggacctgggagtctccttcttccttgcattttcacatgggtgaaaatgaacattggttcttgtggtactgggataatgcaagactcttcccattttacagatgagaaaacaggcatggaaagcagaaggaaataaaagcccattttttcgataggaaaagacacagacactaggatcctagagcaagagtctggtgctgatcctcatggcatcttaccaactgagttaggataactgggaccttgaggcctcatccatgatgacttggctccgtgtatgtttgtgggcatgggctcggtgacaggccaggggctggagccccatgttgagttaaatcatatgccactgagtcttctggtgtcaggtacatcatctcatttaaaagattttttttcgttcattttcatgtattataaaaatcttttgagcatgcgcatatactcctgtcagtctgatattaagtattagtaaaattcaatatcttattttaaaattagtgataaatataagaagccatgttaatagtaccgcaggtaatcattttgaatatcctggggtgacagcactctgttttgggacacaatagcttagcccattgctgtattgggagatccatgctcttgagtgacccttctcgctttggtccaacccattaatggcctccagtgcagacatcccttatgttaccatgcaaggctgctgaccgaggtcccaggggacccctccttaccaaggctggggagtctcattccctcttgtctgctgccacccaagaacaagactttgatcacaatgtgcgagaccctgaatcctagattttctttgttgcccttgcctcttttatgaagtccccttttcccagcctgagtgctgcctctcattcagtccactatctcccaataaaagcagatgttggctgggtgtggtggctcacgcctgtggtccgggtaccttgggatgctgagatcggcagatcatctgaggttgggagttcgagaccagcctgaccaacatggagaaaccctgtctctactaaaaatacaaagattagccaggcatggtggcacatgcctgtagccccagctacttgggaggctgaggcaggagaatcacttaaacctgggaggcagaggttgcggtgagccgaagtcgcaccattgcactccagcctgggcaaacagagtgagactctgtctcaaaaaaaaaaaaagcagatgtttttggcccacaattaaaccttctttcagcacttagtggctctggttacagagttatgcatttaccccttacaaattgctgtcatcagatacaaagcactaaatggcatcctggaggtggctcctttagctactcccaccctcagctcctgtctcagcccccttcactacacctgatcaagttgggccttcgaggagcaagctgctcttctctcctctcctgacgtggccgctgtttgcaggctgtggctgatcctgtgtcctctttctgtccttggtggaggtggtggtgagagtctctttcgaatactccacaaccccctcaggtagtgtctgctgttactttcccaaaagcaccacaggactctccagagctcagctgaaagatctctaactgccttgaccctcccagccaaccccctgtatcatattcctttaagcaatttcccatggaaggattcccagtatatgcatttgcctgttcatagaattgtacagctttcaaaacaagcctcagtgagcatatacatcctaacacatctggtacttgcttccagttggggagtggaagaacagaggtgggtggggtatgatccctgaactcacgactcctggagagaggagactcctttcccaaaaatcccaaggccctttgggacagcacatcagacctagtaccttcagaccaagttcctgtctagcgcctcccacgcaggcctccataataaggaggtgacatgggttgggtattcaaattggccgtctcatgggccacagtgtggaaataattgaagtcttttaacagaggtgtctaagagagcgattaaaagggaattgcaattattgagcccagaggtaaaatttcagaactggcctataaatcctggtctgacacgaaatttaaaactccccagtggtcttcaatgccatattaaaaggattttaatactaagaagtagaaataatgaatgataatcagggtattgtttctgggagccggggcagctctgagggccgggctggtgggaaccgcaggttagagttgggctgtgttttacatccctcccttcacaagagatcagtggaggaagggaaggcagactttggcagcgggtgttgagtgaaagcctggcagagccattcccaggtgaactccagcccaaactctgctgaaagccagaggcacaaacagcccgtgcctgttacacagctgctctgggtcagattgtgtggggggccaggggctggctaagggctgggagtttatgggctgtgggaacctctggcctcctgtgagccttgcagaacaacttccccacaggcctgtgcctactcggcgtctggcccagcgtgagcagatgcttgtgcatagagacacagcatggtccagaggaagaatacccgagtgatggtctggagatcccaactcaagagccagactcttcactggctggctgtgggcgagtcactccacttctttccttgtggtttctttattttattaaccctttcacaggactgttgaaggattaaatggtagaatgaatagaagagtgctttgaagatacaccgtataataggtttctattttttggtttctagtgcccattttgatatggtcattctcttctggatttaagtctgttcccttcaaatctgatgaccaaaatacagctagatgactcttgaagctttgttcagctacagaagtctaggacaatggtggtaccttgtactggtctggcaggtgcagggaatcctagggccagttctccctgaggtctgggctatgcatctgtagcctcttggagggttctctcgccaagcagctccagcacaccatcgctttctgttcacatgtgatcaccacaaatccctcctcctccctaccccctctttgttacccccaattcttttcccacaaatgattaccgaaccagatctcctagattctgtaggttgtggctcaaagcagctggttgttttgaacctgagtgtgggggcatggtgctttctgcagcaaattttaactacttggttgccagaatttagtctgtcatctgtgaagttggctttgctcctgagctttgaatcatcagcagaccaggccactcataaaatgagatgataaccacacagcttctagcaccgtacctagaaggtggtaagtgctgaacaaatgttaaattctgtttctgccaccctctcagtcacgcatcaaaaacacagaaaagccaaaggccaaagcggaatcctttggcacttttatctgagatgccttccagatgggcaagacttactcactatgcctctttggataaaagtgttcaatttgccacagactcacctaccagaatatcaggaaagcattgtccagtgggttgcctaaatcaagttattctgtgtctgttccattcctctaccctactaagctcatgacgctcctgaagagggtctttttattctaagtgagcctgtgttgacacttggaattaccatattctcctccaaaggttccaaaatcacttcttcaacaactgtttagaatgttactgcggttaatctttttaaattaaaacaattggtgggagggtgggggcgctggcatgcttgttcacacctataatcccagcactttgggaggctgagtcaggaggatcatttgaacccaggagtttgagaccaccccaggcaacagtgagacaggtctctacaaaaaaaaaaaaaaaaaaaaaaaaaaaaaggaagaaaagaaaaggaaagaaaattagccaggcatgatagtgtatgcttgtaataccagctactggggaggctgaggtaggaggatcatttgagccagggaagttgaggctgcagtgagcaatgatcgtgccactgcaccccaacttgagcaacagagagagaccctgtctcaaaaaaaaaatttttttattgactcctgaagtaaacacaatcttaaaaatacagcactgacatccttgcatttcaatctaaaaataaaattgtctataaaaggagttgtaggccgggcatgttagctcacgcctgtaatcccagcactttgggaggctgaggtgggtggatcgtctgaggttaagagtttgagaccagcctggccaacatggtgaaaccccatctctactaaaaatacaaaaattagccaggcatggtggcacatggctgaaatcccagctactcggaaggtggaggtgggagaatcacttgaacccaggaggcggaggttgcagtgagcccagatcatgccactgaactccagcctgcgtgacccacggagcaagactccgtctcaaaaaaaaaaaaaaaaaaagagctctaatcaaacttgcctagtttcctcttaaataaataacatataaatatttactcaaacagaacaccttacagtgcatgcagagttgatatacaagatgactttaaacaacaattaacaaggccatccagcatgtggagaacctgttacatcaatgtgtagcaactgttctagaggtagggcaaaaaaagaataagacaagaattctaccttcaaggaatctttagtggtgaaaactgcagagtagtatgaaataaaaagcaaataagcccaaggcacctataagcaatttcattgaattcaacaaacatttattgagtatagtgtgcgccaggcattgtagtaagtactggacagagatgatgagacagtctctgccctggaggaacttgtgttcaagagttttcatactaaaactgtctaaatgctgagaaaaatcaaagaaagtgagagcccagtgcagcatgggacaggatgaatgaattaactggggaaagagaaaactgaagaaagatgttccaggtaggtatcatgccacgaggaaaagcagcactcaagtcttcccacccagccccaaggaggaggactgagaatttcttgtaggggacgaatatgggattccatcacctgattgctcaagacttttaaagctcaaatgccctagacggagacaatgatcaaaatgttgagagaaaagtagttcaagtttaaaagaatagataatgctacaggtcagggaagccatttcaaaataagattctttttgacaatgtctctttaaatgacgtgactctggggacttttcctcgctaagcatctgccaccctacacaataattagccagctacacattttctttgttgttcattaaagattaatgagaggcagagcttaaggtctagttagatggagaaacactgaaggggtcatttgaacctttcatatctgttcctttcgaaactctgatgagcaggttttcaatacaacagcagctgtctgtgtcttctaacctacaatatgcctttggtggaaactcagatgtttctggcatgctgtctcccaccatcagctaaaaagcacatgcatgaaaggaggcagaacagctgtttggagctctgcggtgggtggaacatgtttcatgctggggtgacggggcattttcagcaaagcgtgtctccccactttgtgttgagttcctacggcaccatcaaagagaaatgccaggtatcaaggtgccactgtgcaaacacagcaaggtctggccaatttggaagctagccctcctttacctatttattttgttctaactgttagagtttttctaattcttcactctgcagacagccaccacactgggagaggcagagaggtgataaagagagggtttacttaacaaaagggataaaaggaaaactaatggaaatttaaatacttctagttaaaaataggcagctgaaataatgaagatagaaatgatagaagaccctggaataattaatgcccttctggtacttagcaggtcctggccctttaagattagctcacatgaatggatttcggctggtttagatctttctactcagaatgatgcctgggttggtccacttcctgctctttttcctctttcggtttctgagtctgtgtttggcatcttttagcatcttgtacaatgccatgtacccagaggagctcaaaggccattaatagatgatgttgatgatgccaataatcagagctaggagctgtgattgtattataagcaaagcatttgaataattgcagagccgacaaggcccagagtgacatttctccatccctattactgatgagcacgaccttgggacaagtcaacacctattgttcccccaggatggaatgtagggaagtctggggcggcctctatagcaaaggctgaaggaatgcatcattccaccaaatcagcctccctggatcatctctagtcctccctaggaactctgatctcccaaatccctccctcacctcctgtttccatttcttcctccaggaacccttttgtataaggacttgttaggatttgaggtggaatgagaatctacgaggctatgagctgagatattcccagcctgtctccaagtttgccttcagtaaacaggttcctcttaggctcagaagcctcattctgagaggcctcatagaaatgaatagaagctgaccgattgctgattgtacctgtgttcctttgcagagcctgcatggagctgggagggtacccaattcatggattttctgtattagaaagttaaaacaaggccaggtgcggtggatcacgcctgtaattccagcactttgggaggccgaggtgggccaatcatgagatcaggagatcgagaccatcctggccaacatggtgaaacctcatctctactgaaaatacaaaaatcagctgggcatggtggtgcactcctgtaatcccgctacttcggaggctgaggcaggagaatggcttgaacccgggaggtggaggttgcagtgagctgagatcgcgccactgcactccagcctgggagccagagtgagactccatctcaaaaaaaaaaaaaaaagttacaacagaattttcatgaaagatctggcctgtataatgatcctgcttcccatcctggcacagtctgttctttttcttcttctgcacattctggttttgtccatgtatcagctgtcctgattagcagcacatcttattttgtgcatgaagtccgcgtgctgcatcacttgtggttcatcctcagtcctggaccggtagacctgtccttcaactctccagcaaacgtgtctaactgcctacgattcaactttctgatctgaagcagctctttatcttcttagaagagcatgttttctgccaggttcaaccataaataaacctatgaatcaaatttgtctcctttgggtgagatatacaacatccagatgaaggatccagaagacctgactttctaattccacctttgtcattattcacagttaacatttattgaactcttattaagtggcagacattgtgttaagcacttctaagccattatctcatttaacattcgcccctaccatatgaagtaggtttattatgatgaagaaacagaaattcaggaaagtcagatgacttgctcaagatcacacagctcgtaatagaggctgagtttgaattcagggcccaggcctgtccaacttcaaaaccactgctcttaactgttaccttttatggtctcctaacccacgaggaaccaagcaaggctctttggatctctgggactgtctttatatgcaaagtaagggagtaggtctagggctttccttggtccattcagttctcacatgctgtggatcaattccctacacaccctttgacccctgcagccttttctaccctaccttccattcagagcttcccagggctatgccctcttcctatggacccctaacatttcaccgatgtgtcatgtcatgatggcctagctgctcatcgcatcacctggtagactcctccacctttttctacctcatctctgggtgagtgtggagctgaaaaaaggaattaagccaaataaagaccaattactaggagagtagctttggaaaccaagaagtcccagagactgtataactagaggcagagaaagatatcccaccatgatcaaaggagaaagagtgagtaggctacaggtgggcctgggaagattcttataggcaaaggtactcagggaaagttctttttctttttttttttttgagatggagtctcgctctgtcacccaggctgaagtgcagtggtgccatcttggctcactgcaaactctgcctcccgggttcaagcgattctcctgcctcagcctctcgagtacctgggactacaggtacgtgccaccacacctggctatttttttttttttgtatttttagtagagacagggttccactgtgttagccaggatggtctcgatctcctgacctcatgatccgcctgcctcggcctccccacaaagtgctgggattacaggtgtgagccaccatgcccggctggaaagccctttttataaggcctgccaggagctcaggatggagtggaccatgaggggtaacaagcccgatggagctcaggataggagccagtgggcagggagcacatgacacagctcagtcaccctgaaccaatctgcgaattgttaacctgaagtcagtgttcaatcgaggtatatgcatatattatagggacttataaaatatttttatttctcttttaaaagaggcttatgtagtactctgatttgagaaatactatctaatccatgatatgcgctgatgatcttgatcaaactattttttctctctggacttattctttacatttttagaaaagtggggaatgggcagatgagaatttttagttctatgagtttcaggctgagaagggaggcattctggaggcgggcagacctttctgagattgctgccccagctgacagcctcaaggtcaccaggcttgagaatgctcaggtagaaaaccagatcaagaaaagaacagaacttgctgatttttccttggaatgcaatttcccagggagaaaggaacatacaagcatttgtttctaggggctgatttatttccgtggctttcatatctcaatccacacctatctctgaaggcaaagaacaccagggacttgttttgttgtactttgcatcctggagacaatggagatgccatctcatcagtgaatagtaatgtaagcgaaggagagacacagatgggcgaatctgataacgtgcaacccaaggagtgagccatatttattcttgtcacctctaaaatgccactcgtcttgtttcccacctgtcctcaatatatgcttcactattagcctctagtaagggaagagaataggtcaccttttagtgtatttacccagcgagaagagagtgttctctaagatcatctttgaccttcctttttctccttctactgtctctgcagagagcttgttcattctcacagtctcagtgctgctttctgtggggaggactctcaaatcttcagctcctgctctggtcaggctcacgggaccattggcactgtttcctgccactcggaaccatttctgcctggatgccaaaaattacacggagcccccttcaatccatcagcccatccctctatccattattctactttcctccagaggggaggacacaattcacaagcccagagcttccttaatctcctttaatcagagaagatgccattggacctccagccttataatgatcaccactggctgagccagtggctcccgtcaagcctcatcctcttcctctatgacctgggaccgtggtgcagtatttttgctgagttttgcctttctttactaagactcttatctgtgtccttgattcctagtgggcttcccacctgccttcttgctcccttggtgaccccagacttattctgctccttgagctcagggttcaagggttcatttctctaccccattacccatttctgtcttctctgattgcctgcactctgtgtgccctgttggctgttcatcttttctctgcttggaccttgaactgggtcaagtacttccagtttcactctttcttgagcctttatcttaatcatatacatcattaaacatatgttcaaccttcataatttatagcctatgaacccttagaaggttcagtcacgcattgcttaacaacaaggatacatccaagagctgcatctttaggtgattttgtcgtcatgggaacctcatagagtgtacttacacaaacctagacggtgtgaaaggaggacccccaaatcactaaggaaagctcaagctggaagctgcttagggcaaccctgcctcccattctattcaaagtcactcctctgctcactgagatagatgcatatgtgatttgcctcctttggaaaggctaatcagaaactcaaaagaatataaccctttgtgtatcacctaattgtgacctggaagctcctgcccaccttctgcctttgcttcaagttgtcccgcctttctagactgaacctatgtactttttacgtatattgattgatgtgtcatgtctccctaaatgtgtaaaatggagctgtgccctgaccaccttgggcatatgtcatcaggacttcctgaggctgtgtcacgggcacgtcctcaaccttggcaaaataaactttctactacacacctaggctatatagtatggcctattgctcctaggtggcaaacatctacagcatgttactgtactgaatactgtaggcaaaggtaacacacggtatttgtgtatctaaacacatctaaacatagaaaaagtatggtaaaaatatagcataaaagatttaaaatggtacacctatgtaaggcacttgccatgaatgaaccttggaggagtggaagttggtgagtcagtgaggagtggtgagtgagggtgaaggcctaggacatcactgtacactcctgtagactttagcaacactggacacttaggctacactgaattaataaaaaatatttttcttcaataatagattagccttagcttactgtaactttgttactttataaacttttaattttttgactttttgattcttgtagtaacacttagcttaaaacataaatacgttgctcaggtatacagaaatattttcttctttatatccttattctgtatgcctttttctatttttcataaattttaattatttttgtattactttttaaacttttttgttaaaaactaagacacgaacatgcacattagcctaggcctacacatggtcaggatcatcagtatcacagttttccacctccacatcttgtcccactggaaggtcttcaggggcaataacatgaatggagctgtcatctgtgataacaatgccttcttctggatatctcctgagggccctgcctgaggctgttctagaggagctgtcactcttttcagaaatatgttcagggtggatttcttgctttgtttcctctcttcatcacagagttgcttgtaagcagataatgcacgatgaacattcctctctattaaaaaaaaaaaaccttttggtattggaatccatgttttcaaacctttttcttttttaagaaaaaaagagatgggggtcttgctatgttgctcaggctggcctctaactcctagcctcaagtgatcctcctgcctcagtctcccaagtagctgggagatgtcttcaaactttttgaggaccttgttgaggtctggaaaagcttctgctaaacccttcactatgaattttcttgggagttcttcttttccttctcatgcagtttccttttctcttgcctcttcttcagttttgcattcctcttccagttccaacaactcattagtcaattcctcaggaaccacctctaggagctcctcaatgtcattctcatccacacccacgttaaacttatttgccatctcagcttacagccttgttgatttttgcaacctcctcatccttggcaaatcctttgaagtcatggatgagcctcttgagtgtctttgagatgtcactcatacactctttggtgacaccagcccaagcgcaagcaagtttcttgatgcagtcttagatgttgtaatccttccagaattgcatcagtgtcatctcagtgtcttcctcagcttcagcaatagcctgtccaggtagtagatacaaatgttatgtccaggtagtaggcctgaagagctgctataactctttgatccattggttggaccaaaaaggtgctatttgaagggagagacaccactttgatcttgggatgaaaatcaccagtaaaaggaggatgtgtgggagcattatcaatagtgaacaaaatcttgaaaggtatgttactctccaaatagcacttctccatttcactgagacagcaattcaggaaggcatcttggaggaggagctgggtcatccatgacttctaattgctcctgtagtacagtggcgctgcatgcttatagatatgcctgaaagccctggggttttcactgtgccagatcatgaagggtttccagctctagtctgcaccattgcttccaagcaaaactgttgtcctgtccttaaaaaccttgaaacctgacattgacttagtcaccttatggatggaagtcctttcaggcatccatttccagaatagggaggtttcaaccatattgaagattttctctggcaaataatttttccccacaatcagcttatctagtttgaaaatttttttcagctgccttcacatcagcatatgcagagtcaccactcacacatgcagactcaccactcactttcatattatgtgatgaataatgattcttgaataatttaaaccatctagagctagcagtaaattcaacatcacagtcaggtccagccttgttttttcaacattgcaaacaagctttttgctttggccatggttgccatggtgctgagagggatacacttctgtatctggtctttaatccaagttgtgaggagtttctccataactgctatagacccttctagaatttttgtttgtctccttgccttcaatgaagtagatcctttaatagcttccatcactttgttcttgttcttcaagatcgtagctatggtggcatgtgacatgcttgacgggcaagcaataaccatcactgatttccaccttcgtagtccttaatcacttttaattttgtttccaggtcaatcacttgatgcggcctgttactggcaacatcagcagtggattttgtgtgcttagggaccatgatgaacaaaacaacatgagactaaatcaagcacaagagaaaacgacaccatcaagagacatggtaaacacaagatggatgaggctgctgttggggtaacatggcgtatgttttacagtaaactcttttctttataagtagaaagagcacactctaaaataataataaaagtatagtatagtaaacacatacttgttatcttttttttttttgagatggagcctcactctgttgcccaggctgaagtgcagtggcacgatcttgactcactgcaacctccgcctcccaggttcaattgattctactgcctcagcctcccaagtaactgggactacaggtgcacaccaccacatctggctgatttttacttatttattgtttatttatttatttttttaagacagagcgtcactcttttgcccaggctggagtgcagtggtgcaatctcagctcactgcaacctccacctcccaggttcaagcaagtctcctgcctcagcctcccaagtagctgggactacaggcaccctccaccatgcccggctaattttttatatatttagtagagacagggtttcaccatgttggccaggctggtctcgaactcctgacctcaggtgacccacctgcctcagcctcctatagtgctaggattacaggcttgaggcacctcacccagcctaatttttatattttagtcgagacggggtttcgccatgttggccactctgccgaactcctgacctcaggtgacccacccacctcgacctcccaaagtgctgggattacaggcgtgagccatcgtgcccaggcctgtttattatcattatcaagtactatgtactgaacataattgtatgtgctatacttttatccaactggcagtgaaataggtttatttacaccagcatcatcacatacacatgagcaatgcattgtgttatgaggttaggatggctacaacggcactaggtgattgataggaagtttttaacttcattatagtcttatgggacaatggttgataggtggtctgctgttgaccaaaattttatgtggcacgtgactatattgaaagaaccccttactatcttcacattttaatgaaaggagttaaattggatgatctctaggatctcttacagttctgaaatagtgtgacttaaaaatgctagaagaccacttagctaaactctttcatttacaggcaaaacggacccagaaattgaatgtaacctgacagcctggagactgaactgggattaggactttggtcttttgagtccccattcttgccaaaaccctctgctttgccttcattgtttctttctctccctgcgagtaggtcatagtaggcccctggccatctgtcagatggttgtgttatttggaaataagaaagaaaataaaagaccccttgctcccagcccattccttgcattagcggcttcaagatgacattgggaatgtgcaacccacttacgagaacaaactatttttaagtacttgagcacattgattgtttgtgtgtgagtggcaccactaattacaagtaagtcctgtctatttatcaaagcaggtccctttcagacagttcctgcatgcaaacgatccttccccacaattaggataaattagcaaggttttactgaactaatgagacaatgtttgtgagacttgtctttatgtcttccaggctgttttgagacaagagtctataattgggatcctcaaactgccatatttaaggaagcctgcacaagaagggaggtttatcaaatcttctagtcattccagaggatgtcacgtggaggtgtggctccaggcccaggagcatacaaatgcatgcatggatacataggacatgtgtgcacacacatgcacagatatgcagacaccccacacacatgtatacacacacatcaaatacagtcacaggctctagtttgcaattaagcttcttcttccctcactataagtgaccatctagaatgccatggtctgaaatcttacatgattcatgagggataatacattaataaataaagcaaaaataacatcaggtactctttattgcaaaacaggtttttgctttgtgttagcaactatcttcacgatcttccaaaagaagtattattatcctcattcaatagaggaagacactgatgctagagtcccaggtacacagctagtaggctgggttggcattcaaactcattagttttctactgtacccccaaagcacattctttatctctaatccactgtcttctgctgaagctctatttggtcacctagcctggtatgctctccttaagaactctttctatccttctagcataagatggagaccgtgagcaaggagttaccttaggaccacacagtgctgcttcaatccattaggtttggaaaacacaggctccccaatcagaactacccagttaaaagctatgacgattaattttatgcaccagcatgactgggctaagggatacccagatggctggtataaatattatttctgggtatgtctatgagggtgtttcataagagattagcatttgaatcagtagactgagtaaagaaggcctgctctcaccaatgtgggcgggcatctcctaatcgttgactgcctgaataaaacaaaaaggtggaggaagatcacattctccttctctcttcttgaactaaaatatccaccttttcttgcccttggacatcagagcttttggttttcaggccttttgggttctgagacttacaccagcagcaactcccacccctaccccggctgtatttctcaggccttcagccttgcactgggagtcaccatcagctcccctggatctctggccttcagaccccgactacattaaaccaccagttttcctgcttctccagtttgcaggcgacatactgtgggacttatcagcctctataatcacgtgagccaatttccataatagatatgctttcatatgtctatatataccctcctggttctgtttctctggagaaccctgagtgaatacaaggacacaggcccgaaggctacatgtcaggagtggctggagggttggatgggcacagagacatctctctgggtcttcccagtctctgcaaggtctatgaatacttgtatgcaaattcaacaagaagccaggggctttggggaacaagattagggaaagaaactccaatttgcaggagaaccatcttttagctatttcttcaagtgcctcactcatgatttcagatatcatgaagtccccttcttgtttctagaaatatcaaatgtggcatctaagggccaggcttcagggatctagttctgaggttgtcaaaggcaattttctaagagtttagtatgattaacagaagatgtttccataaaaatcattaaggaaagcgagaattttcagataccattagactttggggatagtgtcaggaagcacaaaaatctcattttagtggctcttgtagaaagaatacccaggatattagatcaaggcttgggccccagatactactccttttggctctgtagactcacttcgcaggatgcaacatgaggtactacagtagtcagagggatatgggttcaaatccagactccccaaccaatagctacatgaggttgtgctgattacttaaccaagctctctgaacttcaacttttccatctgtaaaatgggattagacaaaagcttcttatgtatcaccagcatctggctcaatgcctgcctcatatatggcatgtagtcaataaatatttgctcattaaaaaaaaaatgagtgaacttttgttttatagatgtttgatgcttttttttttttttttttttttttttgagatggagtcttgctctgtcacccaggctggagtgcagtggcgggatctcagctcactgcaagctctgccttctgggttcacgccattctcctacctcagcctcccgggtagctgggactacaggtgcctgccaccatgcccggctaatttttttgtagttttagtagaaacgggatttcaccatgttagccagggtggtcttgatctcctgaccttgtgatccacccgcctcaggctcccaaagtgctgggattacaggcgtgagcatttgaagcattttaaacattcaagcaggtcaataaatgtgagtatcctttctttgctttgctaatcaacttttgaaacattttctccttcctttcctcaacatgaatgaatctgttcttgagctatcctgagagccaaacttgtattgtaaaatgagttctgtagaagctacaaagaacacagattcatagacccatagaatttcatccatcagagaaagccctagtgtggaaaggagacccagagatcctctgttctaatcacttagttccccagataaagagacccgtggagaggaaaatgacttgcccgagatcacatggctagtgagtgaaaggatatgtttattccaaggcaagcctatttttactgataaaatagcttctaacctacatcctgtgatcaccaagtggacggtttcctaccgaaataaaaaacccagatattacatcaggaagagagacttcctcagggctatcccatcctttgtaccttacgtacataaggaggagtggaatagctgtgctctattcttgcatctgctaagtataatatgactgtcccaagtactgtattgtagcataacagcatgctttagacccgaacgcatttaccctagtggctgagcttgtaaattgtatgctacaggacatgtttattatcatagttattttctgcgaatacagttattattctatttgtgaaaattgacataagaggcctctaagcttcacacccctggggcatggcacccctttaaggtcatgcttcctggcttgcttcccttatgctttacttacagcccataagaagtttgcttttactaattggattcgattcgtcctttaacattttgatttgagtaaaaccaacaagagctagatttcccagtccatgacctttgagggctaactctgcagttaaaacatattcagccagaccagaaagcagtcaaccttttacatgctctgtctggtgtaactcctgatgttttccaacccctactccccagcactccttggggatcctgggactagaaaacctagccccgaggtccaagtttttatgctctctactctcttgtttttacaattaaggagtccagaggaaaacacagactttataacggatatgtataatctttctttttctcctatatatttatttttaaaacatttttaaagatgtagggggtaccagtgcagatttcttacatgcatatattaagactgtacccacgatgtaatttttcagtccttacccctcttaccctcccaccttttggggtctccaatgtctattattccactctgtgtatctatgtgtacccactgtttagctcccacgtataagtgacaacatgtggtatatgactttctgtttctgagttatctcacttaggataatggcctccagttccatccatcttgccacaaaagacttgatttcatttttcttatggctgaatagtagatattttagtctttctttttaaattatgctactaagaggtgagtatctttgcattgggtggtataggaaaatagagataaaggctaagaaaatgtacatccagaattaatacattaatttgttgatcactcattcacttatatattcattcatcattgaaaaattatttttaaagtgtgcataatatgcaaagcagtgggctttataagtgagagggtatggtagaaatataaaaaatacatagtctgtgctctcaataatcctatattcttgtgcggaagacaaggtattttattttattttttattttactttattttattgtgagacagtgtctcactctgttgcccaggcttgggtgcagtagtgcaaactcagcttactgcaacctccgcctcccgtgttcaagtgattctcctgactcagcctcccgagtagctgggattacaggtacatgccaccatgcccggctaatttttgtatttttagtagagacagggtttcaccatgttggccagtctggtctcgaactcctgacctcaagtgaccacccacctcggcttcccaaagcgctgggattacaggcatgagccaccgcaactggccaagatggtcatttccccatgtgcttataatacaaggagttcccaaacaagagttaccagtaaagccttcatgaccttgcagcatgacttggaatgtgttaaacagagatgggaggtgaggtccttctgggtggaggaacaagcatatagaaaggttacagaattggggaggcctgaagattggctaaaaatgtggtatgaacctgcctggctggaatggagatcaggggtagaggatgagtatgatacaaaatgagaatggtcatttgtaaggaccttaactgctctatgaagaagtttggttttcataagggaatgaatgagaagcttataaggtttatcatcgggaaagttatataaacaaaatagtccataggaaaaatattttggcattagaatatttaggggtgagaggactgtgaagaatggagacaccttgggaagctactgcaggaatcaaactttgagaggagaaagtttgaaccaaaatgcatgctgacagtttctctagaaatgcagggactggctgggtgaggtggcccatgcctgcaaacctagcgctttgggaggccaaggtaggcaaatcacttgagctaaggagtttgagaccagcctgggcaacatggcaaaaccctgcctatactgaaaatacaaaaattagctgggcaagatggcccacctgtagtcccagctactcaggaggctgaggcaggaggatcgcttgaatttgggaggttgaggctgctgtgagttgggatggtgccactgcactccagcctgggtgacaaagtgagaccctgtcttaaaaaaaaaaaaaaaaaaaaaaggtagggaccacaactgcaagctccaatgcatcatacaaatccaacttttgatttttaatgaacaattaggttcagatcttctccaactcctgttatgtagggactaaagctagtcagtagacagaagtgaagctatctgaaatagaacaaacttttacagatatttgaaggttttaaatgctacttagaattggtcggagaatacctgagcaccttgaggcatcagtttcatgctgaggagcctcttcaaagttcattaccatctttattcagcggttattcacatttgaggaacgcattctggttgaggactgatttttccttccagcctcccccaccctgagtttgtgaaactggagcctcctaacacagctggttcaaaggagggaaaaatcctttcctgcttaacattctgcaaacggcatgggcatatctccgaagtcaatcatcatgaatgaagccatttaagagtggggcccgcgactcctctgtgcggatgaataagcaggcagagtggatcgtatgcagaggagactgcaggcaactctctttctgctttgtcaccctttacgacccgctttgcagtcccagcacccttcatggaatgtcttgctttgcaaaaagaaacagataataaccacacggaggagaaatgctagccctgcagcctgttatttaaaaagtctggagaaagagaatgctagccagaccttacttttgctcgacatagcttgccctctccactttgtgattacatgctcggggaggtcgcatgttctccccatcacagaacttgtcaggaaaagcaatggccaggagctactggtggctcttgacctctctgtctccatgccatcattccacgttcatcccagggcagctgtggcgaaacagtgtcgttggttctgtaagtcctagcttccaaaggggagattggctccaatctgttctctaagacaacggacatcctctgctggtactggaagctgcagatccttcaatccacaaggccaacatagcagtgagtggcaaatctgtccagattgagtgcaggcaggaggccgcctttggtgagccttagtttagctccaagtgccaatgcttgactgtgcagagaaagtaatactgagtgttgacttgagagatcggggtagaaaagagagtcttggtactcatttcagctccgttattgagtcagcagcacaatgtgtactcattcattccacatttgttgagcacctatcacgtgtcaggaagcatgctgacagctgagaacattgagaggaatgagactcctgagggacgtgctagtagaggaggcatttggaaagccatttgatctctctgagcctgtttcctttaaaagcacaggcacggacaatatttctaaggcctctttccactctaacagtctgcaacagcaattctgtgattgacctctgactccctactcccaccagataaacaccagattagagatgtgactcccagctcactgtctcacgttcagcctgtctgcgtcctgtatctcagagagaccagagtgtctgcttcaggcatgagactcctaagtgccagccactggtcaggcatcctgtgtacctctgcccagatcgcagccgcagtggggataaagaagaacccttgaatttaaaccttcctccagagccccattctgcaaatcggaaactctacagaacaccccactgtaatatcttgaggaagaacttttgtttgctagaaattctagaaaagcaattcattttacagctaacctctctttttcttaacctccaagagtgcttggaagtagcagttaggttgtttccattctggaattcacccagacaactccattttgataaagcctctccagtgaggctccctgagctttttccacgaggggaggcaaaggaatcagagtctgaagaccaaagccaggtagtctttttggagcttgtaggtaaggtaggtgtgactccacctttctaagtcagaattacagaattaaaagtcttcaaagaactttaatgatatcaaagtcatttttggaagaacctaacagttcccagcaaaatcaagtgagttccaggagggtttcttgggtctcctgactttcttactaatagaaaacacagtctccttggccagggaaagaggcttgtgaatgactgactacatgtacctaattggtggggttctactcactcagatgaaacctcatccctgatcctatgggggagcctctctagtccaggcttcttttattaggttggtgcaaaataatggcaaaagccacaattacttttgcaccaacctaataccaacaatgaggagtgccttggccttagtacattgggtgcttcctgaggtgctagtctgactctctattttctgtcttctctaacactttctgaagaaatgcttaagaatttttgtttagttttttttctttttgaaactagttaggcacctttacatcaagcttatcatatggaaataagaaatgccggtgacatctcttgccagctgctatttcttcatgagagtcctcatctaaagaaaggaagcatttggcatggcctagggttattgttccttaaggggtccaggttttactcttcctacagatattagaaatctttcatcttaaaagctttttcaggaactgcttgaggaacagtgcctgagtctatgaaaacttcaagcctcaatcctaataacacttgatatgttttttttttttttttcccagcatcaattatttgttcagcctaagagatcttacctggaaatgtcatcaacaatgccaggggagatgagcgtgggtaaggactgctctccatagttttaagaaagagaaatagagggcatattcctgccagaagaaggagaaagaattatttttttctctcttagcagaaagaaagaaaagtggcagtcaatcataaaacacctcttgtgtgccttagctataacggaactaagttctttcatatcttccatatgtcatttcatttaattctaaaagaaaaatgaggaagaggaggagaaacaagggggaggaggaggaacctgagacttgaaagaaactggaacttgcctgtgagccctttgactggtaagagataaaactagaatttgtaccaagattgaaaccccaaagcccttgcgttttccaccacattgcattgacctggccaacaatgtgggcccttcagtgactaatctcattgcagcagacagtgtccactggggagcgaaggcttagatcacgccacaggtggccttagcttgaatcactaatcaaggaggcaacttgctattggtaacaggatgtgtctttagaagtacctcttcaattttctctgcttcttcgtgaccaagctggtgtttactgggcaaataatcggagcaataaaactgccataaactgcagcagcacaagctaatagaaaaatgtacattgcagaggaaaaaggcacaggcaagaataatgataccccttttctcctacttaagacagaaaaattaagaaggggtgaataactccttaggacactgggggaccctcctaggaggaggttttggctgcatttaccttatatacatgggcacataaacacattctcatatgtttgcactaagaatgacaaatgaacagagggaacacagaaaggaggaggctatgctctccttataaaatattaaaacaatacagataagcctagcattttctttgaccagcagactccctccttcccctttccctttctatccctagaggtagccattgtaaaagtttggaatatatcttttcaggcctttttttcatgtatcgcacataaatatgtattcacagaaatgttcacaaggagaataaattcacgttacatgggtaatgaaaaggtaattctaagcaagaaagagaaagagagaaaggtaaagtggaacttaaaagataaagctcagttttggaatgaagttattgattccaaacttttggggtgtccaatagatcaatgtatgtgtcaaaaacagactcaggtacaatcatgatatgaatggcttatctaacctgactttcttaacaatacaatatcaaagatgaccaacctaaaaatagccaaactgacaaattatgcaaaaatcaagtagcacaaaagaatactactataatctggcactaaaataaactcaaagggaagactttttgcaaattccagagaccttagcactacattttctgaatatcgtggctacataatagccactgatctaatttaatgaatttaggattaaagttgttcttgtatattatgattaccattaaggcaaaagaactaattagcaaagtcaagaaggttgccatggaggtacatcaatcagcctgaaagcaaaatgcaaaaggagtgagagtagcagtatgcttatattcttaagcttctggtccctaagagcttaattatttgtatattcaatgatagttcattcatttagccagaacctgtgtcctaagcactatgctaggtgctagagacacaacggcagcctgatggagtgggaagaccatggagttgagagaaagacacttggtttgtgttcttggaaccaacatttactaatggtaagattttaggcaaatcacttaacctcgtaagccttggttttctcaccagtggaatggtgataataattaactttccattgagggtaccataaataaaattcacagacctccaggcagagagtaaatgtaggcagaaattattatttgaatacagaccctattctaaaggcattcactgtctggtatcagagagagaaaaataaagaattgcagagggattctacttttgaatgggggaatgaggagccctgcagatctgctctccagtgaaacaagcataactggtaaaaattattttttagaaacacaatcacttaaagtctttggaaattgtcccaagggaatatagcaaatgaaaaaaaattaagagaagctactaaaactcattaaggacagtgagaatttgtaacattgggaccatgacctgctctctcttttcccctcccggctcaatataatggaaattccattccaggaaggtttagccaagagaggctttcccccggcccctaattccctatctagtgtctggtacctcctggtacccaggagggacaggctatgagcatttctaattttccccagctacacaaggcagaggctaaactccaggtaagcatggccaagaagttggggatcccttactctatccagttctccctcatagagtggagtctctacctcaggcatgtcatgctgataatgctggggctccagttgccctcaccacagctcatgtgtaggatggatgttctaagctgcaagagacatgttgagaagaagagaggctacttaccctgctcagcactctgaccataatgtagggtgtcactctaagaaaagtgggccacaatctcttgctccctgcctcagacctgtggctcagagattttgcccagggagagaagaaggccataagaatagagatcttcaaagttctccccaaagcaacagaatttatttatatcagattgtgagggagttcaagcctaagaatgctcttacaaacaattatgatttttgtggcaaacaactgagaggagactggcagtttcatgactatctacaacaagctaaacagttggttagctatttctccagagagaaccatggaaatagatagctaagaagaacctgctggagtgagaaaaaaccttcaaagagtggcctcaaaaattatgtctgtaaagggactcacatttaattggatcagactgtggcgcaacatttaccccagagctttgccaaaaacaatggaataatcagctgacaattagtaagtgcctacagctggatgtgatgccagcagaagcagttggtttaacagagatcagggaaataaacagtcaaagagaaacttgttaaaagcagtgtcatcctaggatgatcacacacaccatgccctctggagaatgacatgaaaggcttcccactgcagggaaatagactacactaaagccaaataaggccacatttacaggtaggagggggtcaggaattcaacatgtctttttgggagacaaaattcaacccatacatccacacacagactcatggtaaaaaagctgaaagacaaagagaaaatcttgaaagcagcaagagaaaaatgacttatcacttacaaagcaacctcaaaaagattaatagctgccttctcatcagaaacaatggaggccagaaggcagtggggtggcatgttcaaagtgctgaaagaaaaactctgtcaatataaaaaattcccagatcagcaaaaactgagatttgttactgacaggacacactaaaggaatttcttcaggctgaaagtaacaccagacaataattagacaccccctacccacacacacaccaaagaacatcaagaaaggtaactatgtaattataaaagacttttttaatacatagttcttgtccttctttctcttaatggatttaaaaagcagttataggccgggcacggtggctcacgcctgtaatcccagcactttgggaggccgaggtgggtagatcacaaattcaagagatcgagaccatactggccaacatggtaaaaccctatctctactaaaaatacaaaacttaactgagcatagtggggtgcgcctgtagtcccagctactcagaaggctgaggcaggagaatcgcttaaacccagggaggcagaggtttcagtgagccaagatcacgccactgcactccagcctggcaaaagagcaagactccgtctcaaaaaaaaaaaaaaaaaaaaaaaaaaagctgttacataaaaaataggtatataattgtattgctgggcctaaaataaatagaaatgtattatatatttgataataaccgcacaaaggattggggggggcagaaaaggcatacttgagtaaggaaagcacacctgatagtaattttaacatacaaaaaaatttaagagaaatggtaaatacgaaggttagtatcactaccactataaatatatacttgctcttcttttttcctgcaagcttaaaggacataaaattatataaagtagcaattataacaatgtatttgtggtaaagtttataacatgtatagttgtaatatgtatgagaataatagcattaaaaagtggaggggaatagagctatatgagagcaatgtttctgtatctcactggaattaagttaatataaatctaaaatcaattctaataagttaagatgtatatggtaagccctagagaaactactaagaaaaaaactcaatagaatgtcgagaaaaaaatcattaaacaaattaaaatgttactctagaagatattcacttaataaaaaaagaaaacagtatgagataaaaagaacaaaagacatgagacatatagaaaaaaatgagataaaatggcagataaaaatccatgcatgtcaataataacattaaacgcaaatggactaaacaatccaataaaaaggtagagattgtcagaatgggggaaacagaaacccaaaatctgtctatatgctttctacagcaggtatgaataaaaaatcttcttaaatgcacaggaaactttctctgggatagaccatacgctaggtcacaaaacaaggctcaatacatttaaaagaattaaaatcatacaaattattttctctgaccataatagaataaaattagaaatcaatgcagaaaggtatttgggaaattcacaaataagtgaaaattaaacaacactcttctaaataaccagtgggtcaaaggagaaatcataagaaaacttagagcatactttgagataaatgaaaacaaagatgcaacataccaaaacatatggtaagcagctaaaacagtgcttaaagagaaatttatagctgtaaatgtctacgttaaaaaagaagatagttgtcaagtgaataacctcaccacccaccttaagataccagaaaaataagagcaaactaaaacatgcagagactgtaaataacaaagagcagaaattaataaaacagagaatagaaaaaatagagaaaatcaataaaacttaaatttgttctttgcaaaaatcaacaaaactcataaatcttcacctagggtgaccaagaataaaagagaaaatacttgaatcattaatatcagaaatggaagaggggacattactatcaaacttacaaaaataaaaaggattataaaggaatactgtttaaaaaaagctatgtgccaataaagtagatgacttagatgaaatagatacattcctagatagacacaaactactgaaactgactcaagaagaaatagaaaatctgaatcaatacataacaaataaaaagattaaattagtaattaaagaaattacctacaaagaaaatcttaggcccagatatcttcactactgaattatgtcatttaaaaaataataccaattattacaaactctttcaaacaatagaagaagaggaaacacttcccaacgcattctacgatgtcagtattattttgataccagaaccagacaaagttattacaggaaaagaaatctacagatcaatatgtctcttatagatataaacacacatatcctcaacaaaatactagcaaactcaatcaagcaacgtataaaaagacttgtactccatgaccaattaggctttattacaagattgacttaatatgcaaaaatcaatggatgtaataaaccacatcagtagagtagaaaacaaaaccacagcatcatctcaacagacgcagaaagaagattcaacaaacttgaacaccgtatcatgacagaacagtcaacaagcaagtaatagtaagaaatgttcctaagctaataaagggcatctacaaaaaatcccacagctaactttatactttaattattaaagactgaatgctttcctttaagatcaggaataagacaagaatatcagctcatgccacttctattgaacattatactggagattctagccagggaaattaggcaaaaatataaataaataaaaagcaaccagactgaaaagaaagaaggataactatctctatttgcaaatgacataaccttgtgtatagaaaattctaagaaatcactaaaaaatattagaactaataagttcagcaaggttgcagtataccaaaaatcaattatatttctataaagtggcaatgtacaattcaaaaatgatattacaaattctttttagaatagtagcataaagaataaaatggaaataaattttacaaaagaagtacaaaacttacactctgaaaaactacaaaacattgttgaaggaaatcaaataagatttaaataaatgaaaaaacatcccagacatggagcagaagacttaatattgttaggatgatgataatccctaaatagatcaatagattaaatataatccctatcagaatcccaggtaactttttggtataaattgacaaactgatcctaaaattcatataaaattttcgagggaccccaaatagccaaaagagtttttaataagaagaaccaagtaggagattttctgatttcaaaacttactgcagtgtaattgcatctacaacaatgttatgctggcataatgatagacacacagatccatgaaatagaattgaaataaaccctcaaatttgtggttgagtcttgagagggtaccaagacaattccatgggggaaagaatagtctataaaaaaatttttcagggaaatggcatatccaatgcaaaatgaagttgaacccctacctcatataagatataaaacttaaagttgtcaaagacttcaatataaaggctaaaactataaaactcttagaaggaaatataggagtgaatctttatgacctcaaatttggcaatggattcttagatataacacaaaaaagcataagcagcaataaaaaaatagaaaaattagaatttatcaaaattttaaaccttgttgcttcaaagcataccatcaggaaactgaaaagataattcacagatggggagaaaatatttgcaagtcatatatctgatgagacttgtatctagaatacataaagaattcttataactcaataataaaaagacaaccaactaaaaatatacaaaggatgctgtaaaccaatgatagggaaactttttctgtaaaaggccacatagtcaatgttttaggcttgagggccatacagtctttaacacaactactcagctttgccatggtagcataaaaacaaccatagaaaatacgtaacagataagcatggctgtgttccaacaaaattttatttataaaaccaggtggctggcctgagagtcagtttgcccactcatgccctagagcaactcttaaaaaacagaacaatgacatacagctagtaagtcaattctggagataaaatggaatctatgggcatacccagactgtgataggtacttattgcctggtataaagagagcaattaatgaatactgtttaatgaatgaacaaagaaatgaatggggcaggcagaggccaaatactgtgtatgctttcctatgtactcactttgatttgaacaaatttcctaacaccctgtgtttttggacaccttgatcgggaacttcagaaggcaaacagccgagcaagagcaagcctggtacagtatgtcagcattccagattgactgcagctgggctgaaatgcaaggtgaggacaaagaggctgcactagaaggcaaggcgaggctttttttttttttttcttctgtatctcagggataagagtaagagttcttagaaacataatcacttccaccaaagacagacctggagatgccagacacaagagaatcagtataagctaagagctacaaaggacaacagtaagctacctgaaagtaaaggaaaattgatttaggtgattcaatcaaatgatttctgatataagacacaaagggacctaggaggtttgaaaatctaaccaaatgataaatatgggaagataacgtgctctcaggttgtatctcccaagagtcattaatgttaatgtgtatttaaggctgtgtctacaagacagaggaccacagtgtgcaagacagaacattcaggctaatgggttaaggaggagatgggaatcaatcctcttgactcctgtagccaactgattcgaattttagctaaaattaagtcccaaataaaaatccctgaagtgatttatttttttccatttataatgacttattctaggcacatggagactgacaaatcaaggaggtcaaacctttctttttgcccaggcttctatgcaaaccgcctgcttgtcccttgactcagcagaggtcaggatatgaaatatgtataccattgccactgcaagcaagaactgcaacagggactgtgtaagtgttcatgtaggtctgtctataacctcagatttgtatgataactaggtcatggtgatggtgctggcagatatggggttccacaaagctcctgcagtcattgtgatggaagctgaatcaatctgtgaactatgaaagcttctcccaaaaggttccacaaaacaaataggattgagggcctactaggtaataggcactttggggacccagatacaagtcagatgtgtactctatctttaggagctcccaggacagtagaggagagaatatcctgtcccgtcccgtcccgtccagtcccgtcccatcccatcccatcccatcccagtatttcagctgacccttgaaggatagggcttgagggagtgtatcctagcacagaagaaactttgaggagaatgcccctgccctgctaccacctcaacccctgaagcctaggttacaggtaggcctctctctgataactatttcttggatatcagaaaagaatatactttggatgttttgtcccctccaaatgccatgttgaaatgtggcctccaatgttggaggtggtcgtagtggaaggtgtttgggtcatgagggtggatccctcatgaatggttttgtgctgtccttgtgataacaattgagttctcactttattagttcccatgagatctggttatttaaaagagcctggcaccatcttcccattgctctctcccttgccatgtgatacgcaggctcccccgccccttctgctatgactgtaagcttcctgaggcctcatcagaagccgaacagatgctggttccatgttcgtacagcctgcagacccttgagccaaataaagcccttttctttataaattaccgtcttaggtatcacttatagcaatgcaaatggacaatcaacctcagatttgtatgataacgaggtcatttatttaatgattaaacttggtcagtctccacattgtccctgactcatgctatggcactaattgtggtacaaactggccatgttcctataattccattttctccccttgacaacttgaccctaagcaatggataacccaatggtaaactagatgtagccttttcctttttttttttttttttaaaccgatggatccattgcgcatcaattgatctggagtgattcatctaaacatttgtctaaacatgtgcttcaccccctgtcttcactgctcagtgaagtgggggtgagtaagcactagataatacattcagaaaccttagttctaactccagctctcatacttactagctatgagctattgatcatttccctgctctgggtttccttatctgtatgagcaggaaatagatagtcaataagatccttcccagctgtaccatctatgatttcacacaattaacaaaaaagtcctctttataggacccttagagataatccctatttatttccaaagtgaccaggcaaagtttaacaataactaggggctgttatgacactattgaacccatagtagggacttcaggatgccccctgtgaatactctttgatcagccaagtgattgtttctcaggcccttttggtctgcagcagtgcttctcaaactttagcatgcatagaagtggacaggagaattttgttaaaatgcagattctgattcattagtgtagggtggggctggagagtctgtatttctaacaagctcccagacaagacggatgttgaccacactttaggtggcaagtttctagagggttttgaggaggaaacatgaggccattaggaggcttgatactatatctgagagaataccaaattgttccccccaagtgcttacctcgaggccttgctgaagtgcctaataagtgtttgctcactgattgataaactttgctcttttgctaaaggctggaagaaaatgtatctctttcctctttaatcactgagggcaatatagcccaaatagcatcccctgctagactttgccattgcagcatgaaaatatgtaacaggtaagcatggctgtgttccaataaaatttacaaaaccaggtggctggcctgggagtcatagtttgtcaacttaaaaaaaaaaaaatgaaatgatgaggtacagctaataagtcaattctggaaggaaaatggaatctatgggtatgggtatacccagactataataggaacttatttcctggcataaaaaggcaattaatggatactgtttaatgaatgaacaaataaatgaacaaaagaaatatcacatccatcctgtctgcaattaagactttctggatctcttaggcccggcttaatggaatatctacaagatattttaaaactcagagtttttttgcaccaatctctcaagagttggaaccagtcaatgtgctttgtaaagtactgaaaaggcaaagcatggagaaggggatgcttgcttgtgcctggagttttatacaggatgctttccatatcatttcaccacttgcacctgtaccagaatatttacggtattatccttggttggaaagggaatgcataaaatttttaactgaatattttaagaaactaactcctaatctcaatcttatatatctatatgatacactccaagtgggcatattgtcctttggatggaagagcataatgacctaatgcaaatgagacggaggctagggtagtatgttgaggatagttcattccttttctgaaagatgagaaagtagaattagtcccggggcccactcccacgcctgctttgtctcctgggaatatcaaattcatattgattgttctctgatgcataatttgcatggctaaaatggaaacacgttcatcaatttaagccctggcttgccataatgtgttcctttttgaatacagtgtacattacttggaagcaacactagttgcatcataaatatttcagctgccagtgtttgggacttgtttctttgacctggctgtaagtcagtcaataagtaataacaatggtttggtctttagagtttgaggagtactgacaatctacatgattaaaattcataagataagtttttatcaaaataacacttcaccaacaaaggaaaggcattgatcagcccccaacatgtataataaccactttcaatggaggctcgcctttcaattctaatggacattgctgagctcagggttgaatgatgaggccattgtgcctttttccattaggtccatggggaatccatttgcaagagaacagtcaattttggatcacagatcattagaactggaaggaataatagaaatcttctagctcaaagctgtcatttcatagataaggaaactgaaattcagagaattgaactgatttgcccaaggttacacaattatttaaagcactcagatctcctggttgttaggtcagggctgttcatgaatgcagctgacccatatcaagcaaagcccttgggacctctcagtttagcagtccattacccctcctaccagtgtatttttgggtctttacccaaaacgcggtggaaatgagctaaccaaacgaaggaagcaaagagtctctactacttgtcattcattcattaaacaaaacagacattgagcctactatgtggcaagtatttaaataattaaattccccaggaaccatgaaccctcctactggaacttcaaaactcatctctcaacagtctcctaggagtcttcagcaccatccaggttgttctctgctgagtctacctcaagagtaatgcctatatgcctctgtcagaggcagccctgccagatgccaccaacaagaggataaaactgagcacttcgtaagattaaaaaaaaagtttgaacatgcaggtgcaatgccaggtgctttcatatccacgttctcatctagttttggcagcaacacagtcaaatattaccccctctcccaatctttttcctgaaaacataaaaatacagaagtttgggaaaattttatgaagtcaattcaaggtcacggtggtttaaaaaaaaaaaaagctagagctaagatttgaatacaggtatgtttaacaccaaaagcaacacaagcttctcccttatgccaatatgactgaggaactgtgacaagagcagccagctagacagacctgggtaactctgacccttaaagaagtaacagtggagtccatttggtcaccttacctcccacttgttaactacgtaattttccacctttgtcttaaggatttttatttttctgtataagacatggctttcataatgctaagatttggtttgagtataactttggtcgaaaaaatgataggaagaagcaaagaaggcactgtaagcacatctggagaacttttcctggaaatgaaagaaaaaggcaagatacaaatattataaaaccattgggaagactggaactccttagaaattccagtatcaagcaaatgatactggaatttaagtatcattccagtatcattttaagatttgggtctttacccaaaacacagtggaaatgagctaaccaataaaggaaacaaagagtctctactacttggcattcattcattaaataaaatagatattgagcctaccgtgtgccatgtattcaaatacttcaattccccaggaaccttactgataaaattcttactgataaatgtcagctgatattgccacatgctcctgtctgagaaaggcacggtgcactggcagaggggaggcaagaacccttgagagcgggaaccccctgcttcctaatcacttcccagttctctctgcctattccccaggggactggttttataacgtcatcatctttaagccaatacctttgcatcaaattattacctccaaactcttctcctacatcattttcattagcccctttaaattaatctgattcaactgaagctattaacagagagacagcaggtatcaagagttcatcttctactgggtatcatgaggcctttgagaaaagcccctttcaacagaggccagtttttttgctatcatattgatgttcgctcatcagctgataactctctcttagcccatcaagtttggcttttaatggcccaatcgtatctgtgaccacaattcaatttccactctgcacttgtggttccttgatacctcggaattctttaaacctgcttgattagccaccagagataaatggcttagtcattttaaagttttatggaacatctgtgcactgtgatcacagaccagccagaggagaaaatggctctggaatccttcccctcaaaccacttagggagcacaggcccgaagatctgtatgacatggaactcagcaggagtgacagaggtagtgaggggtgccaaaagaggtcaaatctacaaccagtcccaggatttgattcaagtggtgccctttaagggaatcaaatggtgttggtgttttctcggccaaccatgtgatgctgccttctaatggtggcctcttagaagcggaaatcactcgatccattttagttcttccagagctcttggggagtcttggaggacatgtgaacactctacagcctcccaacttctttccccctttatgtttctccttccttcctcatttttctccctcccttctttcttctgtctcttagatatgctgagtacatctatttttgaacccccacgtgggcccatgtttctccagagaatctgttggtttgaacatacgtaatgtgagaaataaaagagcagcttctgacattcagaagctggcctgactcacaggtaggccatgtgattctcccattagacacagaatgcagaataccaagttcagacaaggcttgtctgagatcttgataaaatgagacaaagcgaggccacttctaagtacagacaaagataagatcactgtgttacctccaaaatgccaaacatcttctcttgaccaaaatgagttactcctgcttctttaccaaatacagctttatcctcattctagtctttcttctcaatggaggtttattgagataaacaattatagaattgctgctacctaatgacaccatccaattcagagcaaagtcctgcttccctaagccccacctcaaattacccaacaaagcccaaattccataataggttctttctaacaccctcttactgagacactctacatgtttattcttcatgctacaattagtaatcaaccaaacttgtttaactatagattatctttggtggtctctggctgaagggcatagacaagcggcaaaactaactcagattcaaacagtcatttatattttgaaaagcttttatacccattattttattcaatcttcataacaccaccaatgaggaagacctgcaggtattattatattaatactcattttccagattaggaatttgctgcaaatggttgaaggctattctcccagattccacctgaccttcagagggctgcctttaggaatatgtaggcggagctaagaagttccactagtgtctgccatccatttctgatcaaagaacacgaagcaaataccttagactgacattattttattcaatcttcataacaccaccaatgaggaagacctgcaggtattatcatattaatactcattttccagattaggaaactgaggctcagtgtagttagatgtaagttcaaagttcaaacatcttataagtattagagtttgaaccaggtcatcttgttccatatacagtgttttgttcacatgagctggtcatagaagaaaaatgtcccatagctatttgttatttagtgctgcactaattggagattgcaggtgagaagggaataagactggtagcaggcaccatgacataggaaaaacctggaatatctttcagaagcatcaattttaatcaaattattttgagaagacaagtttaatatttttttaaagcatgagattcaaacattttaaaattcaaacaaaactcaaagaaatgttcaaatagaaagcaaagaaatttgcagtaatttgctgccaatggttgaaggctactctcccagatcccacctgaccttcagagggctgccttcaggaatatgtaggtggagctaagaagttccactagtgtctgccatccatttctgatcaaagaacatgaagcaaataccttagactgacattctggctgtcttgctggggtgctgagagcaaacctgtcctcagggccatgagggtcaatggagtaggttacaatatcccccagcgctcctactgatttggggaggagagcactgtgggcttgttctattatagatgccagttcttccctagggctccaggggccacccatctttctggagcttggctatctccagaccagccctgcctgtgggactccaagccagaatctgactcctctgtagcccagatattgttgctgagagaactggtgttggctccaggtcatttcaaaattcaacatttacctcgaggacatctgcaagtcctgagagtacacaggtccttaggaacttgaaatctgaccacctatcaagcttagaaaaggcacagtctcttctcacatctggaattcatctggactccagggtttctagtactgaaacaacatgtagctgctttaaatagaacaggtgacaattgtcaaggactgcctgagctgacaaattatgtattctcatattattttaaaatgtaaagcacaaacgtgggtataaactccttatgcttatagctcttacttgactattaaaaccaaacaaaaataattcaataattaataaaaaataaatataaatgtataaaaccatactgtttaaattaacacatcaattcaatgcgatggaaggtgctatttgctgaaacaatatcgctgctcacaggacagacagatagagaatagacggctcctactcaggttctataatggattatattatgtcctccaaaaagatgtgttgaaatcctaactcctggcacctgtgaatgtgaccacatatagggtctctgcagatgtaatcaaattaaggtgaggtcattagggtgggccctgatccaacgggactggtgttcttgttaaaaaaaaaaaaaaaaaaaaggatgggagatacgtgcagagagaaggccatgtcaggccagaagcagaagtgggagggatgtggctgcaaggaatgccaaagactgacggccaccaccagaagctaggaagtggtaaggattctacccagagtctcagagagaacatggcctggctgacaccttgattttgaatgtctagcctccagaactttgagtgaataagccatccattctagcaatcatggaaaactaatacacatctttggccgggcatggtggctcacgcctgtaatcccagcactttgggaggccaaggcaggaggatcacctgagatcaggagttcgagaccagcctggccaacatggtgaaaccccgtctctactaaagaaaaaaaaaaattagccggacgtactggtgagtgtctgtaatcccagctattcgggaggctgaggcaggagaatcacttgaacctgggaggtggaggttgcagtgagccgagatcgtgccattgcactccagcctgggtgacagatcaagactccatctcaaaaacaaaaacaaaaaaaaccactaatacacatcttttcagatgattgatatgcccatgttacgtaggttacgtgatgaatcaattttttttttttttttttgagacggagtctctgttgccaagtagctggagtgcagtggtgcgatctccgctcactataatctctgcctcctgggttcaagcaattctcctgcctcagcctcctgagtagctgggattacaggcatctgccaccacacccagctaatttttgtatttttagtagagacagggtttcaccatgttggccaggctggtctcaaacacccaacctcaggtgatccgcctgccttggcctcccaaagtgctgggattacaggcataagccacagtgcctggctgatgaatcaattcttctaagagtttttggtatgcaactgctgcaaacccttctcttgtcagggtcccctgcaatcatttgaccttcaagggcatgaacccttgacaagtctaccttgcttctgtctttaagtctgataactattaaagcaccactctttgatgccaaagtgatccagaacacaagcgcaaaggtagaggcaaaaatgactttcttttagattatcatcaatatgagatcatttaaattatcatagagaactcacagatccttgtgtatggactctgatttgaggggcaagaacatcagattttgtccatttctcgctccctcttgcctttcctgactcctgtgtgcctccaggctctggctggccaagtctccggcttcaatagccaacttggacttggacttcccatcacactcaacccagtttgtccctgcaggccgggtctggccatcaggctccagcattgctcacctgaacactgtaagaggtagtgctggcacgccctgctcaggggcagaacctactctagatctgtctatgtcaacttcagagccaacaagaatacagcacatctgcttgggcccctgtgaagagcatagagcaggggtctccctgtgtacctcacaaaggaactcaaaggcagagtgccattaaaaccatttggcaatcaatcactttaggtgcctctgggggaatcacagagtgggcattagcctgctagggctcggtgtcactgtaagggatggtgtctcccttagcagggcagggcccgccctggctgggggacatgtaggaatggggcaggcatgcaggggccatgaaggcctgactggcaggttgtgggtgcctgggtaccagggaagctcttgatcagtgctcatctgggatccctgagtctggggaagctgaagaggtgatggagcacttgtagggcttggagaaatggctatttttcaattgatctggaaatatgtcaatgttttaataaccagcatgattgtagctgtgtataccaccttaacatctgccctggggtaacaaccataaaagggccaattacctgcttccaagaagtgctttggaaggggctggacatttctcaagactttgatttgggcattacagttgcattgagactaaggagcaacaatgtctttccaaattggcaggaacaggactatccactgttcctctgcagcccaggaatgttcctctgcagcccaggaatgcccctctgctgcattcatctggcccattgtgagaagagtaaaaagttatgatcataggaaagaaaacaactttcagttatgttgtcttgtagaggcacaaatcatttccaaacaagctaaattaacactaattgagaagcagatgtccaaatccttctctagagctcgctggtttcatcattaaaatcttcacaggaagcaggctcataggtgcaccgaagtgcacccaagaccactaatgacaaacccatatcctgcctaccctctggtctccggcagccattctcttccactccattataatcctcgtgataatgacacttgaccggtaaaaagagcatctgttgggagaatgcactgaatccaaaaaccttatggtactaggagatttggggtgttaattacacaaattgcccatcaactctattgttactttctttcctctgataaattaaaaaaaaaaaaatgttgagacttctgagcatgaatgcggttgggccagaagtttgcctataaacatggatgggaatccttgctccttcacaatatccataaccacagagctctggacagtaggctttgaggcagtgtgggatggagggaagtgcactgtctgagagtattggtaagtgagactgggtttgattccagctctgccacaatgacctggcgatcttcaatattctcccttgagtcttgggtactctcccttagcctttctgagcctctgctttttcactggtaaaaatggggatgtagtacacgttttccaggcctggttggtgtcaggatgcataaaataatgagagtaaaagcacacctagatcctaagcatgtgggaagggtacgcacctaaaaaccttatgcttaacagtgaaatgaactttcgactgggcactaggagatctgggattttagtcctgatttctttgttgtgagaacttggacaagccccttaagtttctgggtttcaattttttaatttgtaaaaacatagtgttagacaaatgattctcaatgtcccttccaggtcgaagatctctgattctaacttgaaacctgaaagggacaaagcgtgactctaccactgggtaaggttaattgccacatggtggctacagtgtgatgaagttgcagggggtctgggagcacgtcctgtgtgtcctgctcaaaggatgactgtggaacagagaatgaaggcatcagccttgggtgacactagacatttgagggcgtcctttcccatccctgtggcatttttaactaaactttcgcttcttgcacttctcctctttctccttgtttgcctctgtagtgtcacaggttacttaagggtctatgcctgctgcctgaaccctgaagaccaggctgtgagccaaggccatggtgcctgccagggagcaggtgtccctgagaatgcaaacctcccagagagtatctgagaaccaatgaggaaaacagttccattgcatacatacagtaggcaaagagccagaaaattagcttaaaagcagcttagagatgggaggcgggctggatctttagagctgttctgctgccgcccaggagtgccccgtatgtaaggccaaataaactcatctacttgccaccgagtctttctttggtcttttggctcccttccagtttgggggaagggtttgtttgtttaatacaattctgggtttttctccttacagcctctgccctcctttgcccgctggctttgcttcttgctcccaatttctcaccccttagggtgcaggcctcctgggagactgactgaggccctcaggatggttggaaaggggctagtctcctgaaattaacccaccactggctcactcaccctttcacaggttgtgggcataaactgagaataactggagctcagggcccatttagtagtggtgaaagcaattgatggtgaatcaggaaggaagaggaggctgacgtgtagccttataaatacaggaagtccttatgccccaggcactctgagaggcttgagctcactgatagtcatgctaataataacttcaaacgtacctaggatgtttcttctgaagggcattctgcgttctccaggttgtaattttatttcttttcctactgtttctaccagattgctcttgttacgcccaatttgcaaaaggagaaactgagtcacagaaagtcatatgaattggcattggttctactgttttctcaaatgttcacataaaataaactacagtagagagcaacgtgattgccattggaatgtttatttagtctgccagaacagtcctacgtggggaggcttttgggggtaggacagagagtgaatcgggagctccatttatgaactctcccctcttctcttttattgcttggcttgaggtggttgagggttatgggcaggaacatgaaggaaactgaagaatgtggaatgatactggctggtgcaagatgcagggcaggcaggtggccaagtctgggcaaaccaaaggtcacactgatgtaaaggacctgccccgtgggtgctcactgggcatcatgaaatgttgggagctaggtcagcccaaggctgcctgatttggaagctcttttgcaaatgaacagatgaggattgaacaaaggaggagtgggtgcccaggagacaacagaggactgggcaagaactcccagggctgcgttatgacttttgggggccctgggtgcttttgccattatgggatcctttatacaaaaaaaattaaaaattctgttttacaattgcatcagtaattgagataaatatattaatagcatatattaatgcatacaaagtatattaatgtcatatatttaaaccattttattaaactcaaaagttcatttttttcttctgatttttcaagaaattaaaaagtttccttgggctcctaaaagtactgtggccctaggcactgtgcattcctctttctcatgaataagtcggccctggaagtctcctctgcatcctagggctgctggttatagtagctgactccttggtcctgcccatgcctgtccacatacaggcttacccaaatttacaggattagtcttagagcatcagtttgggcatctaggggttacaggtgcgtgactgaagacactcaatatcagagaggccaaggccaagttatcaaagataaaggagccaggatttgaactcagctctgactgcttccaaagcccatttggatttgactcctacttcccattgtgtgtctcccctgagcctctgctgaaaaggtcctgggtccttggtccaaaatctggcctgacctgcacttgaaccctttctatatagcttagcaaatatggaaattaataattaggcagaggtgggccagtgatagatcacagggagaaaagtctaaaaataaatttcacacaatgcaatgaaaaaggtcccatggagatgcacggagaagaaaagaaatcatccccagaggattaatgttctagtaaactataagctgcttatattttcaccccattaccataactttcaaataactgtctcaaactataaaaagacaattacttagggccagatgcatcacaggctgggtaacgctcttccagagccaatagggggttccctcacatcgcttcccagtggcagtgtggtgtctgaagaggagatgctggattaatagtaaataagggctgggcatggtggctcatgcttataatcccagcacttcgggaggccgaggggggtggatcacctgaggacctgagatcaggagtttgagaccagcctgaacaacatggtgaaactctgtctctactaaaaatacaaaaaattagccgggtgtggtggcagatgcctgtagtcccagttacttgggaggctgaggcagtagaatcacttgaaacggggaggtggaagtggcagtgagcagacactgcaccattgcactccagcgtgggcaacaagagtgaagcgctggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaagtgaagcgctgtctcaaaaaaacaaacaaaataaaacaaaacaaacaacaaaaaaaatgaagaaaacacaacaaccagcaaatagggacattttacctcttctcaaggcaactctggatcaattctcagagcaacaaggctctgaggtccatgaggcctggatttggaattgtcttaggtttgcatgttggcaggactatttaccaggctataactaggcaatccacttgacccctccgatccccttgtagaaaagttcttaacaatcctagccctaccaagtacacaggtttttgtgagacttaaataagagatataactgggatttgtcaactactagcactatccagacacttgaaacttgaccctgcccccaaagagttccctgttctcagactttactgtgtctattgacccctggatacactaaatctgggttgtcggagcttcttaaaaactgattcttggctcttccgccaccactgccaagatctccaagctgagctgctatacaatggcagtagattacactaatttgttttattttatttgacatacttggaattaaggctttttgaaagcactatgcaaatgtatgtaaatgaccacatttcatgaaaaatagtgtgcaaatagtgtccctgtgttggcttagaaaaatctggtggccaaaggctgtctgtatcttcacaagaatcaggaagaagagtttaaactttagttacccttccagctgttttataaaatgcagatgctggggaagctagagtttagtgtgtggtttatgagctgtgtgcttaatattcttttccagtcttcatcagggtatttgatatcatttaagcagagtgtttcattcattaatcacttaaaactgatggtgccaggcacttactcactggaagaggagtaaggaaccaaccctcccctaaggacctccttggcaatgtggccaccagagtcagctgtaaacgcagctggggcctcgtctcctggcaaacacgtgggtggaggtggatgccattttgaattaagtccagatacctgatggaggcactcaagaccctccacaatctacccccagctgaccttccagccagagtctcctcccctacccgtctccattattcattagcactgcccatcatgatttcttgcagaaatctctctggcaggtacagcagcacctgggcagggagagttgagactaaaccatcacagtatctgggtaagacgcggacagagagtccacgcagaacaggcctactggcatgtggtgcttttgtcagatggggaaattattttgagcagcacagcaaggagtggctttaggagggaaaaaaaaaatctcgtgtttattataactcagtccaagatgattgccccaatgtgcaaaatagaataaaattggtcctggacttctgagcacgcataaaagataagaacatggagtcaggccccatccttctctccacagtcagcttctattaggagatgacatgattcaatagcacctttcatagaaagagagtggctgggggagaggtggaggggtttcactttgagctcagatggccgcttcacacctcaggttcaatggcacaggccctccaggtagctcctggctttgtttcctaaccagaaacccacgcacacatcttgtctttgggatggggtggggtccttactactctcaacttttcccaatctctttgctgctcaaatatgtgtgagtttttcggcaaaatttattgcttaatgggggtggggtggggagaaagggatgttgcctttgttgcagtttcacaattggtgtagtgaaagggtgaacaaaaactgataaggagtcaaaactatctttttaaatgacaaaggacagtaacattcttggttttttgcattattgttttcttcataaatttaaggccagatgcagcaatttatggtctattattctttcctgtggcgcttgctaaaatatttcaaagctataccatactgactttttttccttttgtatttcactgctaacggacacagttcgaatcaaatctctaacaaagagagaagtctcagagcctgcttgtgtgctgaaactgctggaaacctttttgattttccagggagccacagatggtgcaggagtttctgcagcccacagacttaatatacgcagtaatttaggagggaggctggcttcgtttggccagtaatgtgagttcatttgcaattctcttctcttcttaatagacttgaacctgagtgttgaaattcagaaaagggggtgtgtgcctcatgggcgtgttaaaccagagggtgtgtgctctctctctacactctggggaagggaagcctggccatgcaacattttttacagctgcatttgcacaggttgggaaataacagtgtcatcctggaacagcagacactgatatatgtgtttggggacatctatagagcacagtgaatcatgcaacatacgagtcagccccactataagtcaatccaccgttcccaccaaaagctccatgggtaaacggagaggctgccttcagattactttggaagatgaaaaatatccccatatatattcagaccaataaagcagccatgcaggtgaataaaaacaaatcctgaaagtacagagtctcaaggttggaagaaaccttaaaagtgtccagaccggtcacccctccaaatgtctgcacctgaatcctcttagaaaatctttatttattctccttcagtttctggtttaaaccctgtccatgaaggggatctcgctgcttcccccaaggcagctgactcatctcaacctctcagtgactgggctgctaaaacaaaaacaaaacccctctactttacattattaaaatcatgacatccactgcttgattctcatttcatccagtattgcacaaaggccataaacaatctttctttgcatgacaatcttccaatagctgcaggtagctgtcttgccatgccatatcatatgatttatttatttgttcattcattaggtgaacatatattaagcagctactaagtgccagaaaccagagactagggatataagatggataagatatggaatgtgctctcacaatatagtatggtaccggacacaagtcaactaatctgaattttctatggtgagtgaaagcctaaacaatgtcctctgggggtctacaggaaagcacgttcattgcctagtgggtgggtaagtgagtggaagcagagaaggcttcccaaggtggtggcgttgatcttggacattgagggctgcatatttcctaacttttcttcaaactgcttggcaaattcatcactaggagacttgcatgttggtgtctgcccagctgctgtgttggggcctccattaatgtgggctctgacagtcacaacagtttggtgcatttccattcacagttcagatccatcttacttcacctgggcatgcaacttggaacaggaaagcccctgggaggggccagggcccccaagggtctgtctgtagaagctgagggcttacggatgtttgttctgtcccccatcgcctccctacaggaactgtctgtgcagaggaggctcttatctcagaacccccatctgttctgtagaggcatggattgccaaaggaaatgttgaggctcaagcattttgtctgaaatgtgacataattggagaaaggggctgtgttaaattgtaaaagctctttacttgtgtgaaattggaggaaaggtctgcaattatcactgtctggactccccagttacctgtgaattgggaacataggtcttgaagatgggctaatggaatggctgcttgtttgtgctgatcatgtgtgggcacatggcattggaggaataggaagacaaagtgtcaaagttggaagtggataatagcaagcaaaacacaaagggcaaaggggaaaatgctgtccccttcctgctccctccttgacagtagggctcctgtgaccgcagggaaagaacatcagtatcaccaaaccttccttcacctacctttacctaccttctctgagcccatgcagcgaacaatagaaacacatgggacgccaggttctgagaccgaggttcaaaaccgctcagatgttcatgtatgcttctgaggattccacataaacactctgagacttgctcatcttgtctgtcaagtggctttggtaatgatgccaattcagagggtttttagaacatttgcggtcccaattgggccagccctctaattgtaccagggctaactaggacaattccagggcacagggctgagccctgtagggttcagagaagtgactgcaacaaggtctttgccctcagagtttttggttgtgtggggcagacagggcaaagaaaaacaaacgccaatataagggatacatagacagagggtagatagattaagctctggaaatcagcacttggggaaaaagaaaaaatgaagggtaattctttaagcctattttaagtggataaaataaaaaattataaatggaaaaaatatgttacagttctcttaagtctactgattcatggaggtgagagaaaaaggcataatgagagaggaacaattttcatgtttgcaggactatggcctataaataatgagaagaggaacctgttagcttgaggttagaaagctgaaaaggaaaagaggttgggcattgtttctcaggcgcctttcctcagatcactgactaccctaatcatagtgcattcctgttaaaaaacagattcctaggccccatccctgacatatgaagtgagagtccgtgggggcggggctcaggactccacattttaataagctgctcgaggtgacttttatgagccctaaagtttacaaaaccctgatttgtgtaaataaacacacacaaagagtgcctgtttttcaacgagcttaattacatcctgtgggtctgatgtttgcttgctataaagagtaagtggtgtgttttctaatctcaggtttatttctgaatgttatatttcaagcagcctgtcttcttgtgcttgagaatgctttcaggtttcagaaaaatagatgctggaagaggaatgacctcacacctgctctactgcaaatagatttcccaccctttctctgcagtccatctccccagccatcatccacttcatatgctgcacactgaccaatctttcttaagcacaacttcaataatgttactcctttggtaagagccatccacagctcccccactgcctctgggataaagataaaactctttagcttggctccaaggcccttcacactctatcgccctccttcctgctaaaatctccctttcacattctcctacacacacacaaccaaactgcagccaacctacactacttgctatcctcatcttgtacttgctgtcttcgaaaacctcagctcatatcaaacttccattggacataacttcctcctctcaacccaaaagaatcttacctagacatttaacccctgcttctccaggaagcctcttttgatctcctgtcagtgccgcatccaaatccgacagcaatttttctgtgccatgcccgtgattcttaatatgagctgtctggtactatgtttatttgcatatttgtctcctaaacttgaagttcctggagaataagggccataactcattcaactttgcgtatcccctagaaactaacataataaatgacctccagaaaacacacgcagccacgctgtccagtggacgttattgccatgatgaatttgttctatagctgtgttgtcgaatagggcagccgctagcctcagagtgactagtggaccctcaaagtgtggctactgtgactgaggaaccgaactttaaaatgtttatttgatttcaatcaataacaatttaaatataagtagctgacatggctagtgactaccctattggacagcacagttgagaatatatttaacgaaggaggttgcactgtgcttcgaaaacgtccccactctctaccccacttacagacgtcacttgatttggttcttcctacttcctcctccttgtcttctacacttggccccttactccctgcactccagccatgcctggctgatttccttttctccaacaggcctggcttgttctggcttcaaggcttttgctgttgtatgctttgcctagagtgtgtttctcttagatctcactcaagttttttttgtttttttttttttttttttcttcattcaggactcagcttaaatgtcccgtctttagagaggacttccttgatgtgccctctaaagtagacctctttgctctcacttcaccctcttacactttctttataacgctttcattaaagtcatctcatttatttcgttacttcttcattgtctaactcctaataaaaggtaagcttcttgagtaaggaagtgctcaaaaacaatgcataataaaatcaatggaggaaagcatgatgagaaacaggatatttatatagtctcaaagtatctccccataagatactaattaattataatggagaaaacagaaactttagtacagaagagaaaaccatcagttgccacctctccacacgttaacttcaagtgtaaccgacgactaacatcaccagttacaagacattttgacatgagatgcccacttgatatgatgcactgagaaggatccatcacttctggggtctcctctccataatgtagaacctcagtctactcagaagaaaaggttagacacatgcaaattgagtgacgttgtaccaaatacctggcgattctattcagaagtgtcaaggtcatgaaagatgcattcagattgaagaactgtcatacatgggaggaaaataagcagatacgataattaaatgcaatgcaggaaacgggattggctcctgaactggaaaaatgagtaggaaaactggcaacaatctaataagatctgtaggatagctaagagaattgtatcaatgttgattttctgttttcagtaattatgttttagttagataagatgttggcataaggtgaagttaggtgatgggtttatagaaactctgtactgtttttgcaactcttatttaaatatcaaactatctcaaaacaattctttttttctgagacagagtctcagtctgttgcccagggtagagtgcaatggcatgagcatagctcactgcagcctcaatctcccaggctcaagccatcctcccacctcaccttttgagtagctgggactacaagtgtgcaccaacatgcctggcaatttttttttttaattttttggtagagacgagttctcactatgttgctcaggctggtcttgaactcctaaactcaagcagtcctcctgccttggtctcctaaagtgctggaattttaggcatgagccaccggacctggcctaaaataaaaagtttcttttttttgaaaaaaatacaagtttcttgagggcaagggcttatctgccttgtgctagaacagtacctgctacatagtagatattaaatatttatttgtgaatgacaggaagactgagaatgaagaaggaaagatggaataggagaaaagaggagctgataaaggaaaagagaaagaaaaagaggaagggaagacgatatggagcaagtgtgaggagaaggactgcacagttttgggaaaatttgaggtatcccttgaagaagatgtgaaacagaacaggcctgttaaggacctcagagaaaaggctcactcacagcatccagcataccccagggacacacaaaagcatggagatctcacattctagatgtttgattgagttcaatttaattcaagtagttaataacttggattaaatgcaatagttggattaacacacgcagtgctcccccaaaagagttctccagcttttggtgggcaggttaataactttggctaccggatggaactgtcacagtctaaggcctgggtcctgagggcttgcatatgtgagtctctacagactgctagaaattggagcaagactaattcagtaaaatagggcccattcttggatgacctatagaattgaatttattttcaactgtgggatatagaaaatcatacacatccctcagtatttctgggggattggttccaggacccccctgtggataccaaaattcaagaatgctcaagtcttttatatgaagtagtataatatttgcatataacctacacatatctttccatatactttaaatcatctccagattacttacaatacctaatacaatgtaagtgctaggtaaacagctgtgatgctatattttaatttgtattattttctatgttgtattgttactttttatttttttcctagtagttttgatcctcagttggttgaatccacaaatgcagaacccacagacacgaagatctgattgtatatgctgtgctgtcttccaaatctaaggagacaagaagggctcaaaatttggggtgtctttccagtagaaagaatgaaattgcattgatgaatattattttaattctatatatcaattgctaatcatatgcctatataataggcacaaaccaaaacaaaaaaccaaaaaccttaattttgagatagttttatatttaaataaaagttgcaaaaatagtacagagagttcctataaacccatcacctagtacataagtgcctatatactgggcacataattggcaattgatacatatagttaaaattatatactattaaagttatatactattaaaattaaagttctatactcccttagttgttcaaataaaagtcctatgcggttagtttcatgtacctgcttcacagatgaggaagcgggctcagagaagaaaatcactggccctaatttacacaatagggccatgaagccagaaactcaaatctagctctctctcattccgagctcttgaaaagggtcctagacgtcatctaatccagctcttcacttcttcgccccatctttcatgtctatttcataatagacatttgcagaagagagagacgagactttaagaggaaagggtcctggtcctggtctctttcacaaggtgtggcagcaggaggtggcgggaacagtgtgaagagagcccagagggactgtcagcagactggagtcctgcctttgtctcatattatttcagtggaatcaatgaaggcatttgccttttctgagccttagctgtgtcatctgtcagatgacgaagacatgaaaaccctctcctaccctgggagagcagcaaggtggggcctgtggtctgatcagcttggagacttctgctgtcctgtgtgcgggggacagaaatggatgttgtttaactggctgaaacgctgtgccatgctaattacatcaacctcacaatcctctcttttttccctccgtcttcttttcactgcttctatttctgtctctttttctctctttcactgtcagttttcaaataaggactgttttgttagctccacaatcaaaatgatctaattggctgcagaagggaacaagcacaatatccccagggggaaccttcctccggatgcaagaaagaaaaggtcaaaaaccacttgactgactaagagaagtaagagaaatgggaattcaaaagcttctatttataactgcacagactgaagttctgggctgtgcccttgactgggcaattatgttgcagagactgcctttccatctttgggtggctcttgaaaaagagaactgacacaaccaggctcttctcttacacagactctctactctgtggttttcccgaggtccctgcactcctagcattgtgggggtgcaaggaacacagccataagtttgaggccaaagagctctagattaaaactgagcctggtgggaataccactttatatccattaggatgcctattatcaataaacaacaacaacaatgtccagaaaataatgagagtagtgagtgggtaaggtggaggagaaattggaaccctcgtgcattgctgctgggaatgtaaaatggtgcaggggctgtggaaaacagtttggtggttcctcaaaaagttaaacatagaattgtcgtatgctccagcaattctactcctgggcatatactggagagaattgaaagcagggagtcaaatagatatttgtacacccacgttcatggcagccaaagtagccaaaaagtagaaacaacctgtgtccattgacagatgaatgattacacaaaatgtggcacgcacacacacaatgtaatattattcagccttaaagaggaaaaaaaatttgacacacactccgagatggataaacctttaagacatgagaagtgaaataagccagtcacaaaaagacaaatattgtatgataccacttacatgaggtatgtagagtagtcaaattcatagagatagaaagtagaatgctggttgccaggggctagagggagaatgaggacttattgctcaactggtacagaattacagttttcaagatgaaaaacattctggagttggatggcagtaatgattgcacaataatatgaatatacttaatgtccctgaactgtacccttaaaatggttaaatggtaaattttatgttatatgtattttaccataataaaaaatgggaatattaccacctagattgtggggttatttttgaggattaaattagatgtcacatgtgaaatatctagaataatgctccatctcctaatagttgctcaacgtgtactggtttctttctttacagagaatatacaatttatacagagtgtgcccttgccttctcagttaggggagaataactgaaaagtggccacgcacataaagacaaaatagaacgacatttctactgcaagatgaccacactcaaagaagaaagaaagtaatcacaagccagtctggagaccctgctttctccattgtatgccttaaaaacaaacagcttcttgcagcacactgaaagcagaaaggcaccgtggtaactttctcttgagtttaaaacagaaggggagatgtacctctctgggtctgaaaagtgaagggagtatccttccttacctacttagtccactaggccagctaacacttcagcattggctcgattgaaatgtaggagctggaatcttacccacctggctgaatggtgtttctgggtggtgagtcactgcatctgcccatctatgctcaggtgaacttcagaaataaggtgaagaagtaaaccggaagggatgagcctcggttaggagtagggagggcttcagctgctgctgggaaatgggctttcaggggataattccaaacagtacttctctaaggcttcttccagatcatttgcagtgcatctatggcctctgtgtatggacaggtttccatctgcaggtctcaggggaactcttcctgcaggagcccaggtgaggccctgaaccctattgtacacttgtctaggtctgggcgtgactctttgtcttcttacattgctccttctcagatggtgccttcaaacaacactatgaatcagggagcttgggttcagatcacgttttcaaacctgtcacatctacatatagagataaataaaaccaataacagtggtttatcaagagtctactatttgtcagactgtactgggtgttttacatacattatttcattcacttcccacaataatcctttgatgtcggtattatgatttccttctcatggatgaggaaactgatgtttagagaggttaggtgccttgtacaaggtactaaaacaaaaaaatccttcacacatacttttctcctgtccagccacagtctttcagcatcttgaaagtactatcatcaatactttaggaagtcaggaaggtctcagatgctactctcaccaatagcctttgtgaaagcttaccggtgtgcttagcttataggaaaaaaagactctaagaatgacaaatggagacatgtaatctactttttaaacctataatcgtgtttaacatgtgactcccacagtgttttacaatgtgtatacatatacatacatgcacacatacatgtacacacacatagctatgtaaacttaaacgtatatgcttgggtatacatttgtttacatttgacaatcatttcaggtacagttatgtaacttgggacacacagcctggaataatcatccataacttgattaatttgcttcaaaatcaaccaggaaaacatctgctcagtcacacccggggacttagcttcagagacgctatgttgtaatattacatagaactttgaagcattccattaagcgtttatagtaatttatcatctgcactttccaatgctctgggctaaggagatgtcgctaatcattacaccttgattgggctgtctttcatttgagggactccatgccctttatagatactgcatcaatcttgcaaatgccttcaacacaatcttgaggcttaacatttcttattgacctacagaatgcattgggaatttcctattgttccctgtggatcaaattaggagtttcaatgatgtctatcacaagcagacctgggtgatagtggcttcatttcacagacagtgactgaacaactgaaccatagctgaagcctccattaagattgaattctcctggtgctggagaaaattgtcagtaagaataaaagttgctgccatgattgagtgcttacactgtggaggggctgtgctaaacagaaggtacagctaccagtcagcaacctgcccttttgtttggtgttcccctttctgatactcccaaatgcccattgtaggtgcacatctacccaagaacacctgcttttgcctcactgagtggttcccagtcatacaggaccacacttttccattttaataggcttataggtcacttgggaaatgtttcaaaatataagttcctgggactcacctagaggtccaccttcagtaggactgaatttatattttaaattaacaatccttctgatgccatctaacatatgccttaaaaacaaacagcttcttgcagcacactgaaacttgcagactttgataactgctgacttaggacattcaaggtcattcttattctccattgaaattttcccctttgttcactccttaatttaccgagaggttaacataatgaatgatctcatttcattggtgcttttataggttgaaagtcactttctccaacatccacatttgaagcacatggcagccatctaaacttcaggcaggaatagggacagacatggcggacaccaatggacactcctctgctgctccctctcttctgtcagcaggacgctgatgttttcagaggttgggctggagattccttaaaacttgggaacataagtccctatctaatcctcaggcggaaatctttgattgttgcaaactcgttatttttggcaactgattggctaaggatgggcatgttctagctaatgattttttttttttaagtgtgctgagggagaatttttcttcctgaattaaaaacaaacaacttccagaggtagaggactttgcttcttctttcttcctggaacttataaatgaatagccatcttgtgacactgaagtaacaagcatacaaataaaagccaaaatgctaagtatgatgggacagaaagataaaaacagctgaggtccccaacaatatcactgaatgtctaaaaaacatttagtaactgcatacctctgaacttatttttaagtaagaaaagcgaatctctgtttagatcaccataaactgaattttatgttactttcagctaaaagcattcctgactgatatagaagtattataatgattaaaatccatgttttgtaaaaagcagcctcagaaaggttatgtgactcactccaaatctctaagcaagtacacagtggatcctcagctggaactcagcttgactcattgcaaatcttgacccatccaccctggagccttgctccacagtgaagaggttttagtgactaccttgcagtaggagtggaacgaacacagcaagatgtgggggctgagctcctgatctcacttcagccagaagaattcttgttaatatattttctaaattgggcttccatgtaaaatacaatttaaagaaagagttttgatgcatgaaaaaatcgtttgaaatacaatagcattatgccatgctgctttcttcttaaatgtaaggcattgtagatacaaagaatgcaatacttgatcattgttctaagcacatttgttacccagcggaggacataagtcatatacacatgcaggcacgccttgttttattgcacttcacagacattacattttttacaaactgaagatttgtggcagccctgcatagagtaagtctattggcaccatattttccagcagtgtgtgctcacttgtctctgtgtcacattttgatacttcttacaatatttcaaattttttcattattattatatctgttccagtgatctgggatcagtgatctttgatgttagtattgtaattggtttgggatgccaaaaaccacgccaaaataaaacagtgaatttaatcaataaatgttgtctgactgctccaccgacatgccattctccatttttctccctatcttcaggcctttctattccttgagacacatcatatttaaatgaggccaattactagccctacaatggcctctaagtgttcaagtgaaaggaagcgtcatatgtctttaactttaaatcaaaagttggaaatgattaagcttggtaaggaaggcatgttgaaagctgagacagaccaaaagctaggcctcttgcaccaaatagccaagttgtgaatgcaaaggaaaagttcttggaggacttttaataaaaagtgttactcaagggagcacacaaatgataagaaaagtgaaacagacttattgctgctgtgcagaaaagtttcggtgttctgaataggagatcaaatcagccaaaatattctcttcagccaaagcctaaccaagaacaaggctctaactctcttcagttccaggaaggctgagagaggcgaggaagctgcagaagaaaagtttgaagctagcagaggttggtttatgaggtttaaggcaacaagccatgtccataacataaaagtacaaagtgaagcagcaagtgctgatggagaagctgcagcaagttatctagagatctaggtaagatcactgatgaaagtggctacactacacaacagattttcaatatagattaaaacttccttctattgaaagatgccatctaggactttcatagctagagaagtcaatacctggcttcaaaacttaaaaggacagtctgactcttttgttaagggcaaatgcagctggtgacttgtaagttacaaacaatattcatttaccattctgaaaattgtggggcccttaagaattatgctaaatctactctgcctgtgccctataaatgtaacaacgaagtctggatcacaatacatggtttactaaatattttaagtccactgttcagacctattgctcagagaaaaagattcctttaaaaatatgcttgttgacaatgtacctggttacacaagggctctgatggagctgtataaggaagtcaatattgtattcattcctgctaacacaacatccattttgcagcccattgatcacgaagtaatttcaactttcagtcttattatttaataaatgcattcgttaggctgtaagtgccatagatagtgattcctctgatggatctgggcaaagcaaatggaaactcttctggaaaaaaaaaaggaccattctaggtgtcattaagaatatttttgatttgtagcagaggtcgaaatatcaacatggacaagagtttagaagaagttgattccatccctcacggatgactttgaggggtttaagacttcattggagaaagcaactgcaggtgtggtagaaacagccagagaagtagaattagaaggagactccaaagatgtgtctgaattgctgcaatctcatgataaaatttgaatggaagaggagttgctttttgtggaagaacaaagaaagtagtatcttgaaatcgaatctattcttggtgaagatattgttaacattgttgaaatgacaaaaaggatttaaaatatttcataaacttagctgataaagcagtagcagggtttgagaggattaactctaaatttgaaagaagttctactgtgggtaaaacgctatcaaacaacaacacatgctacagaaaactctttcataaaaggaagagttagttgatgcagcgaacttcattgctgtcatttttaaaattgccacagccatcccacccttcagcatccactaccctgattagtcaacagccaccaacattgaggtcagacctgccacgagctaagagattctgactcaccgaaggctcaaatgattgttagcatattttagcaataaaacattttcatattaaggtatgtacattttttagacataatgctattgcacacttagtaaacaaaactcatatgcactggaaaaaccaaacaatttgtgttacttgctttactgagatacttgctttatcgtggtggtctggaatatcttaatgaggtatgcctgtaccatactgagaagaaatgcaagagttaaactagagtccttttaaagcaatggctcctttttgctacaatgtgtccttgaaaacagtgttataaagcaaatcattataaaatgattcctattttccccataggaattatgtcataaaaagggttatgctgttaaccaaagacttaggatccaattaattataaatatagccaataacaaggcacaagagcaaaatgtaacatcatctgaaataataaaatgatgatccaaatcctataaaatgggaataaatatatagaacatattacagcacatttgggctgattgtataatcaaagtagtcttataacatataatcgtaaaaacctacaccataaatccgacctaagactaacatgctaacaataataaaccaaaaacatgtaatgaaggataattttatttccttcttttagaccttagatggatttttacaggatggtttagatgcccacttctcttaacatgtgaaatacccaaggaaattagtgcttacgtgctcccttgttttggattgactgttgcagcaagaagaaggattccagacattccattcacttgaaataccacagaaaatgatgactgctgttcacagtagatatggtatgtttcatactgaaaatatgttttaatatgaaagtctgttctttggtttattcagagctcctcaaaaacttctactttggctcatgaggattaactgctacagggattgctctcatgttacaaagaaatagaaagctggaaatctagaaaaaatggtgggtttcagccactgaacaacagacagcacaagacttgagagaagggaaacaagtgatccttgagagaaaggaaacaaatgaagtgacacttataatttttccagattattgcctggaggcagtttccaggttgccatgcagagagaataaaaccaaacacagcttggtgactaagtcaaggttgggatgggagatgtaggggagagagagaatatgagtgttctggaaatctgtaaaggcgtccccttgagtctttggctgagtactaattcatgcatgcatgagggaaaactaccaccgggcaaggaaagcagtaccagaaatcatcaggctgaacaattcctagatccaaggctatgaacagtctgtgtcccaaccagccaaagtaggtagatctagttactcatgggtcattcagtagagccctcagaaaagttacactttcccagtattaggattaaattagtcccacaataaaggctactctgagtctgacacagcaaaacttaacagcaatctttgaaactatcaaactgatttacaaattacttaactgcatgccagatcaaaatccaacactctttaagggaatattagcaaaattcagccttgatgatataaaatcacaatgtctagtatctaaccaaaagttaccaggcattcaaaaaagaagaaaattggacctataattaagaagataatcactcagtggaaacagagatagaagtcaaagcgataatagaatttgatgatcttagaacagcttattataaaccttataaatatacttactaatataaagcagggggccaaaaaccttttccataaagaactggagtataaatatgcaaatattttaggctttgcaggtcgtcaactattcaactctcctgttgagtcatgaaaacagccatcataatatactggcaaatgggcattattgtgttcaaacacaaatttatttataaaagcaagtggtagaacagaagcctgtgtgtgccttcatgtaaaggagacatgggcaaatcaggggaaaaatgaaagactgaaacaggcccagatggaaatttttgagataaaaaatataccggatgggactaaaagcagattagagagtgtagggcagtggttctcaacaggggcccgttttttactagggaacatttggtaatgtgaggacgtgatttttgttgtcagaaatgaggggaaggtgctattggcatccaatgggtacagacaaaggatattgctaagcatcctataattcacaggacagctcccccaacaaagtattaactagcaccaagtgttaatagtgacaaagttgagaaaccttgttgtagaggaacagatcattagacttgaagacaaagcaatagaaaccatccaaaatgaagctcagaaaaaaagactggaaaaaattaacagaatatcagtgacaatgtcagtcgaatatatgtgtaactggaatcccagaagggaggataactctttgaagaaataatagcacaaagatttccaaatttgttgaaaactttaagttcacagagccaagatgcttaacaaaccccaatctgaagaaacgtaaagaaaattacatcaagatccatcataatctaaatgcttaatatgagtgataagaagaaaatcttaaggtacctaaacaaaaagagatacaatatatgcagagaccaaatataagaatggcagcagactcattgtcagaagtcacacaggtcaaaagacaatagagcaatatctttaaagtgttaaaagaaaaaaagattgtcaatttaggattctatattcaacataaacatcctttcaaaatgaagaaaaatagttttttagacaaaattctatagggactttcactataaggaacgttaaaagtaggccaggcatggtggctcatgcttataatcccaacactttgggaggctgaggcaggtggatcacttgaggtcaggagtttgagaccagcctggccaacatggtgaaactctgtctctactaaaaatatgaaaattaactgggcgtagtggtgtgtgcctgtaatcccagctgctcaggaagctgaggcatgaaaatcacttgaacctgggaggtggaggttgcagtgagctgagattgtgccactaccctccaacctgggcaacagaacaaggcttcatttcaaaaaaaaacaaaaacaaaaaaagttaaaagtagttcttcaggcagaaggcaaatgatatcagatgaaaaactggatctacctaaagaaatgaagaacgtcagaaatggcaaatatttaggcaaattaaaaaacattttgtctcacttttaatccctttaaaagatttgaatgcttaatgaaaaaataatggcaatatattatgagtttataacatatgtagaattaaaatgtattacaataatagcacaaaggctgggggtagagattggaaatacaagaatgtaaagatcttatactatacatagtcatattatttgaaggcagcttgtcagaagtttaagataaacatgaaaaaccctagaacacccaccaaaattatattaaaaaagaaagatatagttaataaaacataggtaaactaaaatggaatcacaaacaaatacttcagtaaactgaagctcttcatggttccagggcttctggacatcatgtggcctgatttcttccttcttctttaaaaagccgtgaaaacactagtacagacctcagaaaagaatctcccaagcctctgtgttgacatcttagttcccgtcatctattgtttctatgtccagagtcatgggaaccacatacacacacacactaactcacacacatagacacacacacactctcacacactcacactcaccaagctttatctggagaacacatttcaaatatgcctcacaaatatatgcacaataattttcaaacacatatgggtgctatcacatggaaatctattctaaaatgtcattatgttttttaatcaatcaatatttatgactaacaattaggttctcattcatggaagtcattaaaaagggctcctcaattttaagaggctaggaaccatggaaccattgtgatgaattaaagggcttggccttgagggtttgagactgtttcttgtaagtaacaggcaattgctgatggcttctcaatggtgtgtcatatgataacagtgctctcacaagttttacatttgatgaaaatgaggtagaaaaaagctgaagagtttgttttgaggctgactaaaactaataaaataatcataaatcaatcactcagttggtaacttgtctgcaagacagttctctggatcattgaagtgattagagcacatattttacatctgataatttgtgtttacacttgattggataagccatttgttgatgggttattatgatatctttagtggacatctgtaattttgtgtgatgtgtgatcagtatttcttcttttttgggaactgccgcatctccagttgtttctggtaaggctgttaataatttcacccctcctccccttctaagctggcaatacccattcacctcacatacaatagttgatacagcttggacacatgatccaagaagggctgatactgacatgctgtgtgaaggaagggatgacttttgttttgggatcatgaggaccaagagccttgtttgaccagggcttccaatgagcaatcttatggagagtcttattgataacagaaaaaaaaaaaaaaatggcaagccaagttgaggataaagagtcctgaaaacagttactaatttattgtttaattaattaaaagatacatattgaatatttgctatgtttttggcactgttgctggccttgggaatatggcagtgaacaagccctcagagcctgaagcctagtttcactattttagatttttcagttacataagccaattagtcttccttttccacttagtttatcattttctgccatctgatggagtccaagtacattctctattaattctggttttaaaaggtacaaggatgattttaagaaatgagcctgctctaagaccagagcttggaatctgctcattctttctggtataaaagcctatccactagaccagttcctctcaaagtgtggctcgggggccctgagatcttttcagggaccctcaagattaaagctcttctcataataatactaaaatatcatttttcttttctacacacactctctcatgagtatattacagagttttccagaggctacctgacttctatcaagttagacattagagagatttgcaaaaatgtacaacaactcttctctctaaatttattttagttttggtaaatatggttactgtttattaaaataggttatttacaccaatattgttatgtaacatatttattattatttgtaaatgaataggtaaatatttttaaaatttctctgtttaatatccaacatgataagaatcgatatatataactcacatgaacaaaattctttggggtcctcaataattttttttttttttgagatagagtcttgctctgttgcccaggctggagtagtggcacgatctcagctcactgcaacctgcgcctaccgggttcaagtgattctcttgcttcagccttccaagtagctgggactacaggcacgtgccaccacacccagctaatttttgtattttcagtagagatggggtttcaccatgttggtcaggctggtcttgaactcctgacacagtgatccacccacctcggcctcccaaagtgctgggattacaggcgtgagccaatgcacctggccaataatttttaatagtgtaaaggagtcctgagataaaaattatgagaactgctgacctagaccaatgctgagcacttgggagattaataaatatattttagggtgaagttgaggagccatggagatacagatttgaagaatattggcttgctagcgatatgagcccataataagttcatgaacatacatttctcttttcaatccttctaaatgaaaagttcatggttcagaatgaatagccagctcagctcagtggctcatgcctgtaatccaacactctgggaggccaagaatggtgtattgtttgagcccaggggttcaggaccagactggccaaaatagtgagaccctttctctacaaaaaatttgaaaaaaaatgtagctgggtatggcagcatgtgcctgtggtcccagccactcaggaggctgaggtgggaggctggcttgagcctgggaggttgaggctgcagtaagctatgatcacaccactgcactctagcctgggcagtagagtgagaccctgcctcaaaaaaaaaaaaaaaaaaaaaaaaaaagaactagcacaccaaagaactacagtaactgccttaccaataacccatttatgcctgaggttgcaattttttgaacttttgcaatcagactttggcaatgaccttgagcagtaggatataaataacactcacatgcttggtgttccaataatggaacactaggcataaatgggctaatggcacaggctgaaggctgatatgtcttggaaatagtcaaccctaatgaggtctgagagggtaaagatcatactatgaagctttcctaaaggaagctgctcttatttgcagtctgagtggaggagtaggcacctggtcaatgagataatgaaaagatgagtttccagaaccattccacatctgtggacatgttgggtcaatgtaaggaattagccaaatcagtgatcaccagccactatcttgtgccaaattgccttctcaatacccagagcccctaatttgacaattgctgagaaccagtgacatcaacagtaatatctaacaggaaagtggcaggtggtcttcagatactagttttgataagggcccacttgcatttatttttaggtccatctttcagggtgttctctctcagaaagataaaaatcccattcagtcccagcatcttttcacaggcatgctgcacctctgtggtcatgaaatctctccttactctttcctaactttggccctttctgtagctctcttaatggcaccatccccctccttgacattgaagttcccagccacaaagggtttgacttcttctttcttgaaaattcccactcatcatcccccagcctcccaacgagtttttaataagttgtggatttctgccaattctatgcagtcatttagtcattcattgagacttcacagccctaaatcatcaaatcctgattggatcaaggtttctgcctgccaaaagaaaatgaaacttctctgaagaacaacaacctttagagcttctggaattcaataaaatattaccagaaaggacaggaaacagagccaaatgacccaaagccaatataaaaagcaatggaaaaaaataaaaacagaccttgaagtctgatattggagttatcaaatatagactttagaataattataatatgttcaagaagacagatgagcaataaagaatttcattagaaaacgggaatttataagaatcaaatggaaattctagaagtgaaaaatacaataacgaattaataattcaatagatgagtttaacagtagattagacacaagagaacagaaaattaggatactggaagagagactcacagaaaatgccctgattgaataataggaagaagaaaaaaaagacagaatatacagaaaagaattcaagagacacgtgagtcacaatgaaaaggtctaaaatacatataatttgaagtcccagacaagaggaaagagggaaaggacagaggcaatatgtgaagaaatactggctgacaatttttcaaaattaacaaaaacttcaaacttctctgtgagtcccacatagaataaatgtaaagaaaactatgcctagtcacatcataataaagctgctgaaaatcaaagacagaaaggaaatctttaaaatagccagagaggaaaagacacattacctccaaacaagcattgataaaactgacaactgacttcaacagaggcaaggaaggccgaaagagaacagagtgatgtctttaaagtgctagcagaaaatgactgccagccaagaattatttacccagtgagaatattcttcaaaaatcaaagtgaaataagacatttcagacaaaacagctgaatttttttttttttttgccagcagacccttactaaaagaaatattaacgcaagctcttgaagcaagaggaaatttttcccaaatggaggcaacagtcatagaagaaggaataaagagcaatggcaagggaaaatacgtggaaatatttaaatgaattttggctaattaatataataatagtgtcttcagatatgtaaaatatgtgtagctgtaaaatacatgacaacaaaaggataaaagaaaggatggtggctagtggagtttaagtaatcaggttcttgccttgttcaggagtggcaagcatactaatttaagatatactctaatggtcactagggtaaccatgaacagcatagtaaaataatatataactatattttaatggaatacacaattaagtaggatacacagttaacaggatgcaaaattaaatacttttaattatgttaataggatatataattaaatacttttctacagagaatattccaggccaagttggctttatcaatgagttcttccaaatatttaaagatgcagtaaaaccaatttcacacaaactcttagcagaagatagaaaaacaaagattttctgtcttgttttataaagttagcataactttgataacaaaatctaagaaggctacaagaaggaaaaattacaggtcaatctctcttattagcatagatgcaaaagttctagacaaagtattaacagatcggtatgaattatatatcaaataggtaatacatcacaaaaagttgagcttattccagtatataaggttggtttaattctcaaaactcaatccatataacccactatattaatagaaaaaagaataagcagtatacagttgtcttgataaatacagaaaaagcatttgatatcattcattacctattcgtgatgaaaaacctcagcacactaggaatagcagttgtggcagactgcattttccaaatatggtcacagcaatatttccgttcccacatgctctcacagaacttgcagagtagaatgcagtggcaatgatgctaaataactttcttttcttttttttttttttgagacagagtttcattcactcttgttgcccagactgaagtggaatggcacaatcttggctaactgcaacctccacctcctgggtttaagtgattctcctgccttagcttcctgagtagctgggattacaggtggtccccaccacatccaggtaattttttgtgtttttagtagagatggggttttaccatgttggccaggctggcctcaaactcctgacctcaggtgatccacccaccgtggcctcccaaagtgctgggattacaggcgtgagccactgcacccagccgatgttgatgactttcaaggcaagatcacaggtggcacctggctgtcttgcaggacggtcaccctgggaacccactcaccatggtatgagaaagcctgaattagcctctatggagagactatatgagaggcccaagtagtgatgccaccagtctactgttggcatcaaccaccagaagtgtgagtaaacaagctttcaaatgattccatgtcctcaacttcaagtcttccagctccccagtcattgtgaagcaggggcaagcctttcttactgtaccttgtctaaattcccaatccacaaaatctgtgagtgtagtaaatggttgttctttgccactgagttttgggaaaattttttatgccattgtaggaactggaacggaaggaaacttcctcaatctgacaaatggtatctctgaatatcctacagctaacttcatacttaatgatgaaatattgaaagctttccctttgaattaaggaagaagacaatgaggctccctgttaccacttctaacatacattttactagttctcttagccaatacaataaggcaagaaaaagaaataaaaggcacatttggaaaaaaaataaaatgatcaactagaatcaataggtgaatttaacatggtttttgaatacacagtcaatactgtatacaacaaaaattacatttttaaatactagtcacaaaagaaaaaatgaatctttaaaaataacttttataaaaacacttaaaagtcacaaaagagtaagtttaaagaaatattggcaagaatacaaagaaaactaaaaacaattacctggagaaattaaagaagatctgataaatgaaaatttatcatgtgttaaggactggaagactcactatagttagaatgtcaggtctcctcaaatctgtagattaaacttaatcccaatcaaaatctcagcagaattgtgtgtatttgtactgtgtgacaatttatgagatgattctaaaatacacgtagaaatgcaaaaggcaaagcatggcaaagatgatcttgaagaacaaagttggagcacttacagtaccagatatcaagacatattataaagctcctgtatttaaaacagtgtggtacttgtgcaaatatagacaaacagagaagtttgtcttctctgaatgaagtccaggaacaaacctattcttaaaaccacctgattcacagcaaagatgccattgcaatgcagtggagaaaggagaatcttttcaacataaatgagcctatacctctacttaatgctaaatgaattatagacctaaatgtgaaaggaaaaacaataaagtttctagaagatgacatagaagaatatatttatgatatcaaggtaagtaaagatttcttgaataggatataaaaagcagtaaatggaaaggcaagccacagatttggagaaaatatctgcaatattcacaatgtatacatcttaaggactgttgtctgtaatatataaagaagccctaaaatcattaagaaaaatacaaacaatacaacaaaaaagggtaaaaagacttgcacaggaccttcacaaaagaaatattcaataagcatatgaaaggtgttcaaaatcattactcatcagggaaatgcaggagtttgagaccagcctggccaacatggcaaagccccatctctactgaaaaaaaaaatacaaaaattagcctgtaatctcagctactcaggaggctgaggcaggagaatcgcttgaatctgggaggcagaagttgcagtgatccaaaattgcaccattgcactccagcctgggggacagagtgagactttgtcaaaacaaaaacaaaaacaaaaacaatacttcctatccaccagaatggctaaaaacaaacaaacgaacaaaaaatggaccctaccaagttgttgagactatggagcacattctcaatacattgctgggaggagttaagttggtacaattactttggcaaactgttccagaatatcttctaaagctgactagacacacatttttaccctcctaagtaaacatccaaaagaaatgtatatatgctccaaaagacaagtataaggataacctaattcactggatatattgtggtatgtttatacaatgaaatagtctgcaacaacaacaaaattgaattactgctacatacaactaaacaggaatatctcacagacacaaaatagttaatactatcaaataaagttacacaaaatttaaaaacaggaaaatctaatctatagggaaagaagtcaaatagtaatgatctttaagggactgtaatgactgggagggggcataagatggcttcttacctgccggtaagtgtttcacatcttggtccgagtggtaattccatgaatgatttccttttgtaaaaatgtatccactgacgtgtggttttagtgtatgtatgctctataacataaagctagcttaaaaaaaggaaaaatagcaacgacggctggttgtgctgatggtgacaaggatgacttcctaattctgaggtttgatatttttccaaacgccaaagttgtgtgctctatttaaaatcacatgtagatttccagttaccttgtgtaactaactctacagaaataatatctgaattttttgcctctaggaaaaaattgtggattcaggaatatgctgtgtttcacaagacagaactgcagtacagaaacgtattcgtgaattaattttttattctgttggatttggggaggtttagttcaggctgattttctagtgcgatataagtgggggagaggtggagcaaggggtggttcatcagatcaagttgaaaagccaagatagaagcacaaaagcctgaacaaattatctactgcgaggcctttgctggacggggcctggctgccacacctgctgctggtcagggcccaggcactggtgttcactttgaagagaggagttagggaaccccttgaagtttctgcagaagaaaccgccaggctcctgtgtaccccctgctcctgcattccttcttcttatctcctccactcactcatcttccctatgagtctctgagcccttccgctgacttcctgcagaagcatcagacaactcgagagggcggaaaatggagaagaaaggccaagcaaggcagtgggcgaggtcagaggccctgtagcctgtcctggagaaaccccttccttgctgaaccagagccaccatcgctggaagacctcaggcctcagggagctcaagggggcagcaaaagaggaagactgccctttacttaatgtctcctcccaactccacatcccctcaggtaacacagttaccatctgactgtggaagaaataggccccaagaggtgaactctcctgcccaaggtcacacggcgtaggtggcagaatccgcctctcccgccatcttttcccagaatccctccctccactaagggaatccttcaatctccaggtccacacactggagaacattcctgaacagtctcgggcccgccggacgaggctgcatctccaggccctcccagaccacactagagggaggcagctgtcgccatcctcattgttcccctgaagtgagtggctaagcccctgctagctctatgtagagatcggcgaccccctggggccaatctccctttggtcctggcctctcagtcaaaggtttggaaaatgtggctggaaatttaagacagcctagagcacagctggctcccactgagtgaacagcgctgaggccccgataaaggctcattcatctctgggagcttcatgcttggaagactctgagtgcctgaagaggaattgtgcaaactgccatcacaataaacagagagagagagcatgtctataaaatcccagacaggcggcaaatgagaacggtgacatcgagtctcacaactgcaatgaagtgaaagtctcttggtcctcccgtgtggggctgcttcggacagatggggcagggacagtggggcagagactcaggccagggagcagcctgctcctccagcgctgcctatgggcgggagtggtcaggagactccctctagaacaacttaggatgctgggaccaccagggtttgttgctcactttacagatgaggagacacaagctgcggctcagacccagcctttagctgccaacccaaatgctgccctctcctccccatgcctgcaggcatgcatctagtccttcatgcatctgacatacaatgagcgcattctaggttctaggcactgcactaagctctgaagatcaaaccaaggcctagtttctggcctggatgatcctacagtacagtagggacataaaattaccacaatcattttaaacaccaacattcttttccacttgtaaagataattgtaggaaagatacattatagaaaaatatagaaaatgaatcaaaatatcaagaaggaaataaaaaacacacagaatcccactctccagagacaatcatggtatgtgtttaggtatatggaaaaaaactccgtgtacccacaggccccgtgcctgcaagagacagggtgtcggtggtagaagcacagaagagggagtgagtagccctgagacccgggggagtttcccggtggagaaggagggctgtgcttccccgacaaggcacaggaggatgcagggaagtgtgctgcatgggctgagactcagagcgtgtgaggctgcccagggaagacagggagaagagaccagggagacagattaggtgtgtaaaagagccctgggctttgtggagagttcgattccatcctggagcatttcttgctgtgatgtcacactgcagaaattagttgtgagatgtatagctaggaatttgttactaatgactctctgggtattgatcaccttgcccttttatcgttggttgacactggagcagattcaaggagatcaccatgcacctcgcctcaccctcattcacatatgtcctgatagaccacacagagttgatgcgaaggggtggagcagcaggatctaggtgcagatgtagactagggacacccaggctagaaaggctgtggtgtgcaaaggaagaagtgaaccacgagggagagttgagctgagcagtgcaggctgggtaagatttgggcacgtgaataggagccaagagatacttcctggggtggaaggtctgagtgggtcctagagcctggaaaggacatcatcatcactaacatggccagtaccccctcatcccactacccagaggcagcatcatgctaaagagaaaggggctttgctatataccagctgtgtggtctgggacacatttacttaagctttctgagattccacattacaaaataaatggcaacacttggctctctagttgtggtgaggatttactgagattgaaaccatgaaattgcttagtggagttcttggcacacatatgtattcaagtgatgttgattttctttccttcccagctaagcaagtcaggaagtccccaccctcaggttcagaatgttttatcagaggtgctatatgattctttataacccagagttggtcccagattttaaagggcatggactaaacagatggcttctcagtggtcccagatcttcttgtcctgggacacagtggttcccaagctgatagatcctaaccggctgctggtttcagaggtacagtgacagcaggcagagggatggagagggatgcgagggaactggaggctctgtgtgggcaggggcaacaagaaatgtggggacttcagatatggctaaaagacttaggggaaattgcttccctggccagcaccaggtggcaatcaggaaatcagagctgaatgtgaatgtgatttagaatccgaaatcttgggttctagctggaggtgctgtgtaggagcctataggcgaagcaaggaaggcacttctgccagcagataacacgttgattttaagcaaaaaagaaaaagactattttcctgagtctgagttcagtattgatgagctgtgcaaagcactgtccttcttgatgtatgctcctccatccataaaaaatgaagagactgtctcactctcagcttctcaaagctccccaggtttgctgcctgtggctccagacccaacagatagaaatatgaggattgatataatcacacatatgaacaggaatacaaacacccatgtgaatggaaacatacatatgaatatggcccatgttgccctcctctcatctctagggggaggacaactctcactccatgttccagttagagtcaatcagcaaaccatgttttaccatacacaggactgtaatgatcctgctttcgtataaagggctttgcagccccagaacagccttcacatctattgtctgccatgagccacacaagccccttccaggaaaggtagggtgagtgctcccatcactgggcatatatggaaacagagccttggacaggcggaggacttgcctccctggtggccttctttccacgactcctccttctttccatgactcccttaccctgtacttaacttgagaagagctttgaagtaatgagctcatgctgtgctctcaaggctcctacagactgacgaggaataagtcatacgcatacgcaagtcagtttacactgccaggtgattgaggattgatgccgatctgtatcaacgatgagcatggacatattcaaagaaagcggtcactcaaaggctgggtggcctgagaagaggcttcaaagaggacctcagtgtttaagctgggttttgaagggcaggcaggatttggaaaggtcagggagaacaagtgtgtcccagcttgtgggaatggtaggggcaggtgcagagggtgggagcatagctggcttgtgaattcagttactgttaagacatgtccccagagactgactagcttcaggaacacagaaataaatctagtttctggccctgcaaagaataggaccctagacctaagtgaatgccgtctaatgaagccttgccatgacatcctgtgtcctcataaaagggtcctagactggtatgaaagaaaggatgtcttcgctattgtgagactgggcagcctgatcatcttggagagaaagggagtgtgttagagagagctctagagcctgggagcactcagggttccctgaacatctcccatctcctgtgatgtccccgaaatgatggctcaccctgaagcaggcagatctacactgccctggggaaagaccctatcctgagctttctgggatggcagcaggagatagtagtaggttctgagacctcaaccacagcctcagtctttcttcatacacagatctgttgccaagacctaggaggtagctaacaagcaggcccagaggacgcttgaacacacaggcctgaaactcattcttcacccgcttggtgattttggaattaattaaatatcctatcttaccaaagctttagggtgttttgctctagaaagcttcttttctcttaactaaattgaagcccataaatgagaaatacagtgcatgaaatctctggatgtcacaccataaatctcaagcatgtggctttgcaaatctcctttaggataaattgtagcaataaagtgtttgcattttcttcatgtattgctgggttcagggagttgagccttctctagtcacaggcaatttgattgaagaccacagggtcacacagggggacatggggcagcttggctgtgggtctggggatggctggtcctttgctctcctaccaccgcccccagatgagtgggtgccctctgctctggcagtgaccttggcaaaattaggaagatctggaagataacattcttctcaggggtggaaaggataggttcagactgggaaaaggacatgagagtcttgaaatctggtacaggaaatctttgacctaaaatataccagacacataactcaaagttgtttgttcttcctaaacagcccttctcactcccttcaactaaccgttcctgggcattttgttctttcagctaaatactaaacagcagctttaaaaatacatgtgactttgtatatttcagcacagaaaaatccccaaaacataatgtggagtgaaaaacacaagttgcaaaagagatatacagtgtgataaaaacaggaatatgcattgactatggtatggacacatagtatacaggaaaagtacagtctcatgtggaataacaccagcaacctcagcagagtgacgtgaggctgaaggaggatgaggcgaggctttagatttatttatttaaaaaaaggaaagaaaaacaaagcaaatagggtgaaatattaatatctgctaattctaagtggtggggatggagctgtttgtaatatttgtgatattattttctatgtctctaaaatatttcataactgaaagtaaaatattattttaaaaacaatgaaaattataatttcttctggcatttggagaggtgtgaatcttttcagagtttgctgagttaaatgggactgtttatctctaaactgtgtatggtcctaggtgattgtctgttatatttcttgtctctgctttttattgccccgttgccccagggatgagttgacacttcttgctgttgtcagtcaatctgcccactcacttcacacagcagtcaagagcagaggccagtcagacgcagggaggaaagcagaagtggggctggctggctcaggccgggggctacaggcactctccagcaacacgcaggcagatgcaaaagtgggaactcagaaagctcagggaacagacatcttaaaaaaaaaaaaaaaaaaaaaaaagccatcatttaagccagcacttctcaatgcttaaatgtgcacaggaatctcttagagaccttgcagattctgattcaccaggtctgggcaaggccaaagattctgcatttccaatgagctcccaggcaatgccgaggttgctggtccagggaccactggagcaaagtccctaacaaggaaaagagatccggcatgatcctttgaaccatctcatatatcacgtgggtgtattcctgtaatgggggcccatgctcctgtgtttgaggaccagcttcagatttagtgaacgcgagacctgagcgattattctcgaacagcaagggagtttcagtcattcacccaagccatgcagctggtaatggcagatctggactagcacttggaatcctggtttgtagttcagtgctttaactattttaccatttcatcattttcctcttagtaagaaaacaaacttgacggtaagaattcattaaattgccaatatatttggctttaagcaactcccctgtaaacaaatttagatttaaaatagaagagcaatgtggaagggaagacaattatttttcagtctttatcataagattcctggaaactacaagctcccataatacacttcacatttaatttgattttaccaaaactcaatttatacatattatgttatcagcacacattgcatagataaggcctaccttaactgattaatgtgcttctgtcagactctacatctctgtcttcattgaggtttctagaatctccgactttggcaaagcttcttccctaggcctcaagtttttcatctaaaaactggtgttgaacacatcatcactaaagtcttttcagttttaatggtttttgagtttaaagttttcctctttgtataccttaaatatggctttctgggacttctctctccagctgtcatttttctctttgcatggttcacagctctcctgctcagaaaagtgataagtgacaggaaggactattgatacagtggttactttacattcaggaaagagggtcaaggtgatatttaaaactcagcaacagaatgactttctgtttgattttcaaaggctcttaagcctcaattcttcccacaaagaaagaaggtgattaattggctgatgtcctgccttccttaaaagaaagaatatgatcagtgcagtggacctacgaggaaacctaatcaaaccagttgtggctgtcccttcttgccttgtgaccacagatctcaaatgggaaaagtgcaaacctgtagtatatccctctgaataaattctgcctcttccctcaagaaaggcctggtttgagaccagtaccgggaatgaaaaccctagtagcattggagccatcaaggctttctctgggcttgcagagatattgctaggggtaggatcaagctggtcaggatgggatacaccagtggacagtgtgccatgagcaggggagttattttactgtttagagccataatttcataaaatagagggttggcctgcaagaatttctggtgtctagttctaggattctgtgtatgaaagtggacttggagtgagggcataaatcccacttcttcaaggtgaaggagaactgagggggaaagatgcctatgcctacatctgagggaggaggtatcaaattaggtggcttagtatgcaagaacagaggttgaggttagcagagaggtgtgacagctggcaccacctgggaaaagtgacctgatgctttaaataggcaccaagctaatggtgtgaggtgaggtcaggtaggtagggtttcctcagttatttacggcatgtatcctatgggtcctcagcacagaagtgagtattgttggtacaatggaatgaactaaaagtgtcttgtattttagctgatgacagagcaggagagtgccgtaggagagcaaaaacaacaataacaacaacaacaacaacaacaacaaaaactgagaaactctgagacctggtctttggataagaaagttctttagtcttccatgacgactacatggattactaaaatccacagtaggaagctccccaagagagtgtgtgcatgaaggggcgataggaggcaaggagataatggagagtgccaatggcagcatgctttgatttacagccctgccttggatctgcctgcttttcttctactaggctattcctacgcagttattgggctgagaagactgaatgagcaacatgtgttctagaataggaaacccaaagggcaggaacttggaaaagactgtggtaaatatttgcacttgaaaagagagcaggaataggagttacaagattaggttctggtccccagcaagctgtatgacctgggtaagcatctccctctcccagagacttagttctcttaggtacgaaatgagaaaatatattatctcaatggtgttaaaccctgtctgtatactggtattgcttgaggagctttcaaaaaacaccaatgtctaggcactgcctcaggtcaactgaaccagaatctctggggataggacacaggcatcagggcctttttaaagccctcccagctaattccagtgtatgtctaagtttgagaaccactcctgctattcaaagtgtagtctgtgcaccagtaggcggtatctcctgggagctttttagaaatgcagaatctctagcttcagcttagagaatccacattttaacaggattctcaaatgattcatgtgcacatccaagtttgaaaagccccaagacagttcatctctaaataacgttttacttttaattgtgaaatatttttaacatacagaaatgcatagagaataatttaattagtactcacatacccaacctggctttatcaagtcattactttttactatttttcatttaggttttgtttaacataatgacatatattttaagttgaaccctccctgtgtattcctcttagatcttatgcttattgctttcttcatagatagagtcaatatcctgactttggtgtttctccatcttattaatgttttcatattatattagtccgttctcaaactgctaataaagacatacccgagactgggtaatttataaagaaaaacaggttttaatggattcacagttccacatggctggggaggcctcacaatcacggcggaaggcgaaggaggagcaaaggcatgtcttacatggtggcaggaaagagagcatgtgcagggggaactgcactttacaaaaccatcagatcttgtgatacttattcactatcatgagaacagcatgaaaaaaaccacacccatgattcagttactgcccactggatgcctcccacgggattatgggagttacaattcacgatgagatttgggtggggacacagccaaaccatatcatatactattattatataagtaggtaattagatggattgattgatagaatgactttgtcttcttaacatgatttctgttgatccattcttgcattcttgagacaaatcctaatgggtcattacacacacacacacatttttatatgtgtgtgtatatatctatatatacaagcacacacacatatataaacacactgctggatctgggtcctagcattttatttaggacttatggtattaaatcagatcagtttaaagtgttcctctattgtcagggaacttagcaagctttaagtatagactgaacaccacttccagttttgtttttttctagtgtttcagtttcataatttttagataccctaaatcatttcttgtaatcaatgcttaattgtaatgtttaaaaatttagcaaccaaatttattcattttagtgctacctattgtaccttgttttatataccctccctttaaatttgttttcttccttcaagaaatacatccttcaatagtcttttcatgagatctataaattttaaactctcttagtcctgataagtctgaaaacatctttatttgtacgttattccttaacactactttaaatgactgcaaaattctatgttgacaactcctttttgtcagcactttgaaagtactgatctactgttttctgttatttttgttgttgttgctaatgacaggttggatgtctttctgattataggtaatccctttaaaaaatattctactagcttttagtgttttttttctttacttttgataatctaaagtttcactataatttgtctaggagtagatgtatcttaatcctgctgcctagttggagtgaaccttttatctaaataattctgcccttcttcggttccagaaaatactcaaattattttcccaagtattgatcctcctccatctcttccaatctcctcttctgatgcccttttagactatgtctaagcacctatcttccatgtctctaaaccactttttcaaatatttagacaatctctctctgctgcattctgagtaaccaccaatggatattctaatcctctaattttccatttgaacaagaccatcccagagttcatcttatctgctgagctgacactttaagacttatttttaattcattttgattttattttagtgaccatcttttgtgtttctaatatgtataattggttcttttccatatctacctgttctcatttcatttcagcctgattctgtttcataacttctggctctttttaaacaaaagatttcctccctgtatctattcaagtatatcttaaatgtattcatttgaaagtttattcagactggtataaaaatttctattaatctgaagaggattcatatgcgaatgattggtttttggctttctttcttggcagggttttacattttagaattttgtacttgaaggctaggctccttttgcttgatgggtgtttgtttacaggtcctccccttccccagccaggctcaccccttcctgtctggctgtttatgttgcctctgtttggtcctccctcaaggtcagaaccagattcaatctctgggcagtctggttcgggtctgagtcataagacattgttcctaggactgcaacttgcgaaaaacagtggcctcagtggcattttttttaggatcctttttgtggttgtgggagctgatctcatgtgaaccctggctgcaagcactgattctggccctggcctttcatcttggctggtcatccttagaagtatttatcacacagaggccaaattcctggctgtatggactgcttcccgccccagagctcagctggcctgcaggctgatctgcttactactttccatttctgttctgggtttgagagatggaaacacggtgtctattgttcaggacagttatgtcattcccatgttatctctccttgtgctgcatttagagcagagtagtgcaaaatataccatcttgctcaaagtctagatttgcaaaataatggcctaggcacagttgccaaattaataatggagaatcttgttttcttggtggatgaggatcagtatatagtatattatctcttaccctttagaatacaagtaccagaaggacagagactatggttctctatcattcctgcatttccaggaccccagagactgtttggtatgaaatgagtgcttcataaatgttaaagagaaaatgaagtaagcttctctgggcatttttctgaacctttctgataatgttcttagacttaaattcaaacacctatcccctggaccataacttcagtgttgcacataaagtcagcacattttgaagatcaatgacgtcttgaagtcagccattaactgcaaaagtcagagctgcttaagagagatacgggcatgccctgttttataacaaaggagcaacatggaaaaatattcactgataaatatcctaccagtaaattaaaaacaagaagcaaataccttcaaattgctttcacagtgtgttttgtctttctctttgaatattatttatgagggataatttactgatattgtggttaccccaaattatataccaaagaaaattaaaagcactacagaggaggaaataatagtagcatttaattaaaaccaaagtgggcacaatcaatgcttgtctaatacaataatgagcttaatttaattttaatttaatggaaaaaaataaagcttaagtcaactgcctatgtaattaaatgacagcaattttaaaaaatgtaagcttttctaaagtggagtcctaaaagggtaacaatggcgaatacaatgccaactaactgacctatatcaatgtttccagaagagttagaggggatcattttcttcaggaagcaggactatgcattttcagcttctggaaagtagaattaattaacaagcgatactctaactttccgtcctttagagtcatcaaaaaagtagacaaaattggatttctaagaattgccagtttgggagtatggtccaaaagggactgaaataaacagatgaccatgtaggggagcttgaatggatgcttcctaccagagctgggctgcagagaggacagcgattgagcctgaggtgggagaacagtgtgaaagggaacccccatacccccagacagctgtctgtggccacagagctgaggaaataggattcactctagacaataaggagagactgtttttccaagtactagcttagagcttgtggaaaggtggtccaactttgatatcaaaaaaggattctttttgagttggttaatctgtcaaaatgtgaaatgagaagccacctggggtagtacccaaagcatcagattcaaggttgaagtcctatctctgtagcttaacaactgagtgactttgagcaactcagctgctttgaggctcagtttcctaatagaaatatagggttactggtatccattttgccctagctcacatgatttttagatgatgaggagaagacatttattcaatgcctgctatgtatcagtcaccttactaagtattaaacattacttcatttaatttaccacccatttactgagctagttgtcattttaccgagacagaaccaaggccatagatggcaccagatcgagaactcacagcttatgcatctccctctctccaaagcctgcccgctatcccgtgcttgttcctggagctcagctcaaattcaaagacagaggggcccagtgtgattggagttactttgggcttctctgctcagtttattttcttgggttgttattttttttttctgttggactcttttatactagttatacacatatgcacgtgcacacagaaaagcactaacatccctttacattcagtctgccttatctgacttaacttcatagcagctgggttcatctcatatgcagttctaggtaaccccagaacagttctctggacaaagcacgtgctatttatatatgcctatgtgaatgattacattatttgcattcttttagtttcacagcctgcttttcaggcaactgacaagttcctactatttacttcttaataatctgtcaccatgttccaccaggtgcttacttcttattacataagcagtgtttcatcacactgttgtatgcagcagaatggtggggtcattccctaacccccaaactgagactcaaacactggtgactcaccagctctcctaaacgtctaattaattacagcagcactggagcagaacagcgctagttcagggtatgtcaagcagtttccctggcatgactgatggcattggagtggtaggattgacttggaccagataatattggtaagaatccagatagctttcatggtcatatttcataaatttcactgaagttggttgaaaaaaatcaaagaatggaaaaatgatgtgtagcattctttttcttcaccatgtactcatgatcttcatctcttatttagtatggggagaacttcaaattactcagtcccagtggaactccataaccacggtgtatgttcaaagggagatgaggggatgggaagtgggaataccaggtaggcttagcagaaaatagagttagtcaaacacttgttatcacggcccggtcttcctccacctaggaaggctgttgtctttgtctaagtttgttactttggtttcgtagagcaaagaagtggtttatcactttattagccaactcagcaccagtaatcactgggggagggaatggggccacaagctctgaaaagaaagcaaaagaactaaaagattctgccaaaggagaaccccaaactgatcattgtcaggatctaaaaatagtccacttaaatcagaattagtgatgaacgactaactagagcagaactatgcaaatgaatacacagaggagatgaaaagagccctcaattacttacttatatgtttacgtctcatattagcctatgcatttcttaaaacaaggtctgtatcttagttttttgactttctatccctaaggcttggcatgatgtctagtacttaatagatgctcaataaatgattaatcgaattcagtatactacaagtataagctcatcctaggatgttacattattattattaccattactttagagacaaagtcttgctctgttgcccaggctggagtgcagtggtgtgatcacagtgagcctcgacttcctgggctcaagcaatctgcccacctcaaacttctgagtagctgggactacaggtgcacaccaccttgcccaactaagttttaatttttctgtagagccagcatctcccaatgttgcccaggctggtctcaaactcctgggctcaagtgattctcccacattggcctcccaaagtattgggattacaggtatgaaccactgtgcctggccctccaaagatgttatattaatctgatgttcaatactgccccaaatagcaaagcatgaaaaatgtgttatttaaggcatgaagcagtgttttacagtgaactccaccaggatgagacaccctggagcctggaccgaagaagcctattctagggatgaagagctgtctcaggtgctgagccctggaaaggcctaggatctggtgtctgaaggacatggcactagacacctggttatgcaggtgttatgaagggaaagtggccctgcaaaagaaagaagcatgtcaacaagaaagccaatagcaggcaatgctcacacatgcaggaaggtggaaaatctttaggtatcagaaacatggttgttgcaccacatgctggccgggactccaaacctggaacatggggacaggctcttgacttataggaactagggcatgggccagggattcatgtaccatggaataaagcagaagctaggtatcatccctggggacaagggacaaaggattagagctggctaggcagcgagtatgccttgatgctaaatcccagaatattcagtgcttctgaaattgtccgtgccaagtcagagctggagctagagatagggaagagctgaggccgcaagcagcccagcagggtcatatgaccttggccttgggcggaggaggggctaacactcagcgtggcctggctagcagagtcagatggtgtgttaatatgctgttctggatcatttagtagcattccaataatctgaaagtgttcacgtgccaggtcaatgttggggaaaaaggagtttaaatacttgtcatatacttaggccactggttctcaaagtgtggtccctagatcagcggcatcagcatcatctggggacttgttagaaatgcaaattattaggcctcgttccagcctagagtcagagacttgggaggtgatggtgggtgtggggagggggttttaacagacccctcagaggattccaacacatactcaactttgagaaccactgtgttcgacaacatctaaatcaggcccttggattttatggatgccacgggcctctttggcagactggtgaagtacatagattccccagagtaatgttttcaaatatgtaaaactacaaaggaaaccagttatactgaaatatagtcattaaaaagttatgctgcaataatgtatgtgtttgtttataaacacatgaaataaccatctcatggcagatctaataacatctgtaattttgatgtagtgatgagcttcagtagtatttcaagatgtctgcaacagctgtcatgtgatttctattactgacaaaatcacacagactcctattactatagtagtagtaaatttttacctgcatttacaatggaagaaatgctacatttcagtgagaagtaatcaaaataaaaatgtcattctttccatccatgttcataggcccctcaattctttccagggtcctctgaggatccatggtccccaaattaagaactacgctataagtccttaataaacattatcttattttattcttttaaaagttttactcctaatattcccattttatggatcaggaaactgaggctcagagaactgaagaaacatgtctaatgtctcatgtggttagtcagatatggagtgtgggctcaaagcccctgtagagacaggtttccgtggctgatccattagtgcctctcagagtgcctagaacagggccgagttcataatatgtactcagtaagtatgcgttgattgcatgaatgaatgaattgaattgaacgtcaagcctgtgtacctcaaaattccatgctgtctctactctccatctatcccatgcaactatgtatgaaaaggagacttttctccttattcatccagcaggtagggaagggtaagttcagttccctgatctactagacctgacaacggagctttgattctaaaattgatgttgaatacacatagcacgagcaacattattccgacaaaattggaaaacaattcaacaaattgaggagaggagtgtctcagcaaggaacgccagtccctctggtttctcttggaagcagctgagcttgttaatgaaacaggttgttactttcacttaacgtgtgtccttctttaactgacaaattagttagtgccagcaggagaggcaagaaggcagtgactaaaggggcagggagtgctgagaacccaggctcggagagaagcacaaaatgagagaagagaaacataccaggccttctcttcttctaagcaaaacaaatttttctcaggcacttttcacagatgtctaatgttcttaactaaccacacttaatttaattaccttaaagtgaattggatggctgaaaattcatttacataacagcaattctaatacttataaattgcacaatcaattaaatccttaagaacaaatgtatagactgtaaatgaaatatctatctagtaggattaatcaaaagctaatcatgaaaaatatcatcctgggtctggctcaaagaatatgccatggttaccattaccaattacagtattgtagggcctgctttaataggtaatcatattaattgacaacactatatttaatgtgtttccataatcctttctttctgaatcagagattcatttatctttaggctgtgtcttgctgcaacccatcatcaacattgtcatcaatgttacaagtgtgtatttgagtgtgttttccatggaagacatggagctagccactggggatgcactgagaaataaaatatagtgcctgaccttataagaagagagacaaggatgaaggcccttgatggctcgggtgaggattgcttaaaaagagtgagagaaagtcattaggagtgggaagagggaatcagggcctaaagggtagactccatatcgtcccacactggaccctattcagtgctggatatgtccagggcctagctgtttctgcacacggtcagtaggtgtttagcccaagtttgatgacttcagtttggtccagtagttctgcctgataagaaaaaagccaagaatatgggtgaggaacttcctcctgctgttcgtaaggattcttaaagatgatttttgagagcagatgtaaataacatcaagggtttgtttgtctaagctagggatggaacccatggctttccagctatgcagatgccagttgcagattagacgtaggtaactgttttgattcaaaaaatcaacttcatagtggtaatattggcaaagatccttgaacaaatttaaaaacagatttctaaccagatggtatgggagtatttagaaaagaatgcaggaatcattgaaaagccactgtgggtaaactcagaatcaagcagacaaaccaatctcgttttctcttctgataggcttggcacttggcaggtcaaggaatgcagtggagagcatgcatctcatttcagcttttgatgaaatctctcctgctgtccttttgagtaatatgatagatgtggattagttgataacagtattaagtggatttacacttacttgagcgtcaatagcaaggagtgtggattggtgtctctctgtcctctgccctgtcctgtctcacatttttttccaacactgggatgaagactggatggctatagcccattggattttcaaatggctccacctgggtaactcattcctgtgatctgggcatctccagttgccttaattactccgctgtttcaggtcctaatttcgcctcatccccaaactctgctccacaactcagccaaggccaaaggcgtacacatcagagagtcacgtatcgtgttttctccagatgtcccataacagaatgagctgtctgttccataacaaaacgagtccttgttaggatgtttctaggaggtccctgcatcactgagaggttgactaggatgctctgtctagccttcctgttttctcttttattctctgagggagtggcatgcagtgaaaagaacactggctttcaaaacaaaactgacttcactctttgctctttgggtaggtctcagtttcctcatctgtataatggggataataattcctacttcccgaggttgtgggaggattaagtgatgaggcctgtctagtgcagcaagcacataggtgtgccctctgtcaatgttagttcctttctgtcttctagagagcactttggaagcaggtgaacaggctccctggaggtaccatgcgaagcccttaggacttggttggtgaggcagcccagtgaggccctctttgcaaggccaggactgtcaggatgaaacggcctcaagcacaatgaaggagaaggctctttcacccttccatgtctaattctgacagagaggaggagacacagtggggtggatgcagaaagatatactggctctccactaacttgtcgtgggccctcaggcaggttgctcagtgtctgaggacctgtctaagggtcctcctatgggcaataagaagcagaatccaccaatgtgatgggaggcttagatgtgtggcttagatccaccaatgtgatgggtggcttagatgagattaggtatttggatttcctggctcagagcctgtcacccagaaggtgcagtataaatggcagttttgtttctattaagatttgtgataataatagtatcaagagaacagcttcaagctttgaggcctccagacctggtactggtctgctctgggtctctgttcatggtgagggagagcagaatttttaaaaatgaaacaggagctgcgggagaaatctgggatgagaggcagatgctaacactacagagagcttggtgaatgagggtctttagaaggcccactcagtttggggctctgagatctttaaaacagcaaactttcccacactcacgagggccatgatcctatgagagacagtgagtcttaaggggtgggtgggggagtgacagctgtagatggcttccacacaggtgctgccccttctgcgcggtgccaggcatgtccagcccctctgcagtttgaggtaacccagcctggaacataaaggggtgagttgtgctagctgctccctcaagtcattcccaggcctagaatccttgggttccaggtctgcctggcctttgaggtggcattacaataggaccctttggatgccttgatgggttttgcctcaaggttggagtcccaggactgacttcctgcctagtaaattccatgctattgtgagaagctcaaagctctttagagactcgtgtgtgtgtgtgtgtgtgtgtgtgtgtgtgtgcatgcatgtgtatgctgcacatagtctcttagttcctcactattagacctcagaagggactattttgtttgtttcatgtatttattcattcaaaacatagatatcgctcacctgcgatagcagactgtgctttatgatgctttcacccaagatgctagcatgttctctactcaaaaaaataataattctcctaagacatctaacatttggcatctggaagagaacaggatgtttaatgtgcatgaagtatgttcacagagccggggtggacttaggaagtgagccagctccctcctgcctaccccagctctgctccctgctccttccctgcctgcttcgtgctgcaggaggctgaaggggatgaagtgcatcctgcctccctggctctctggcttctggttgtgtttggccaatgggaacaccacagtagatcagagcaagggtggagggtggcattggagtgtttatttctctagttcctttcccgtggcactgcacggtatgttcccgagtcaaggtctcttcccctctcaagacaaccttctctacaaaactcttctccctttggattctagcaatcacgccttccccactgaggactgggctagtgatggttactagccctggcatactagtgctagttactagccctggtggttttcttaccctccccacacctttgtaaagaatctccctgattagactcacctcaaattatccaatttgaatgtgccatctctttcttcctgggaccttgagtgataaagatcatctattccttattttgacagaggaggaaacacaggaagtgacttacccaaagttactcaattagagagaaagccaggactcaagctgactaagactatcatgaatatgtagaacattgacccagatttttctgttttcttgtgtttcgtcttttcttcttggtccctggaagatgctgtcaggaggtttcagtgtaattaattatgctggcacatccaatgaatggagctatgatttagcaagtctacttgagatgctgataaattaaacaatgaaatgcacatttcagtttcagttaagagaatcctaacctagttgaggaaaagagcacaacctcacatttcctttctaaaagaggaacgttttacagaactcctatgttgagatccccctccctttgcggccgcctttttcccatgtcagttctctgctcaggaatagactatagccatgtagggatcaaatgaaataacttatctgaggtatttttaaacactgtaatgttctttataaaatgcaaaagattatagctattcaatctataaatatctgaatgtaggatagcatatgcttataaacagcttttttgctcattgtttattacatcagatccaagcttatttgtcaaaatgttaaggtcttataaaaatgtactgcctttcctccacaactcactcactttttcatcaggcagtgtgggctcgtggaactaatacagacaaactagattcacacttggttcagggtcactgcatatggcagtgcaggctgtgtcctgcacaggatgccacatctaaggtatttgcatcatcactgctatagatctttatgttttttaatgacagttttccagaggatagtagtagagtggctggctttgttaaacttagtatattatgacaattttacaataaataaaaaaaaatgccttgaggaagagataactttttctaatatgaccttctcctagcttcataataaagcaatcatatataagtttatgaaaatcacttacttcaggttgtataatctaatcaagggaaatctcttagaatagagatgacaaatatttgccatgtacaccaccacactttgcccatggaagaccccagtagccaccatggctcccttcctcaagtctggatgcaacttacaccatgtgccaagcaaccattgccaaccaaatggggctggcatactggctgatatccatttgctgtcactgctcaaaaaggttgttgtaaggatttcaggatagtgaatccacagcacctggaacaatgaccacaatcatcatcacattccgggcactatagattcaccatcttaaaatcctgatgaggccaggcatggtggctcacgcctgtaatcccagcactttgggtggctgaggcgggtttatcacctgaggtgaggagttcgagaccagcctagtcaacatggtgaaaccccgtctctactaaaaaatatgaaaattatccaggcatggtggtgggcgcctgtaatctcagctactagggaggatgaggcaggagaatcgcttgaacctgggagacggaggttgcagtgagccgaaatagtgccactgcactcctgcctgggcaacaagagtgaaactccatctcaaaaaagaaaaaaaaaaatctgatgattgtggtcatcacaggctctgccaccagagccctgtgaatgttctccaggtctgcgtaccactcccttggttggcaatacctggctccctccctaccaccggcctatgctcagcctcaattcattgctcaaatagaaacagaaccttggtctaggtcagcatggtgcttgctactgagtgcaccagggctcccagcagcacacacatccccactgacctcagctcactctctttcctcctctcctctctaaactccacacagacccatgctctgttgctgctaatcagcactcaatggtaatttgtaaatgtctgcaaaactcattataattcttttgtgtgtccaggcgctgcattcctatcaagagggcaaatcccttgaagacagaatctttttcttccttttaggttcaatattctgctcacatgggaactcaacaaatcatattgtttcggtcatgtagggtgccttgaaaaataaggcatgatcatttgttataactagtccctggtcaccttcttcatatgaggctaagaaaatgaatatagtcatgaaatgattattgctctcctggtccaaaaagtaaatttaaattcttttctttcttaagtccaaaagatacaaaactaattgagaactcctgatattgttataatactattacttataataagtaataatagtagaagtcaaaatacaatttctaatgccattactactaacttcattaggattcatttcttcctctcccccactctcatttggccaaatgcatttcagtaagtgcacatgggagctgagaggatgataaagaattatgagtctcagtatttattctatgctctcccaatattgcagctctattccttccagatgagatggcattttgactgtgggtgatatgattaatgcccaaatatgacctaaaaaattgaaagggaggcacagtgactgggtttgggggaggaggttgggagatatccttcattatttgtcaggctacttaggcaaggaaatacacttattgatgataaatatgcaaaaatgaaacaataaaattttgaactgtgattttttttttcaaaatctaaagcctgtagggtcttggtatgtgggtggagggcctatgagatatagaggaaattactgatgctttctctgtgtcgacctcatccgtaaaatgggagtaatggagccaccatcagtgccatgtctattgtcttgagggttgaaatcagggtcttgggtgcagttgtacaggttgggcctgctctggaacattctgctgaggggagcagaggggccccaatggagcggggctccacttgccaagccatggccttttgcttatgcatctttgctcatttgctcatttgtctgccaagagcagaggggctttttctaatttacaggaagaagctgtttgtgctcacagccgccctgattgagataagtatgtaatgacattattattcaaccaagggctttcactttttcctaatgagtgtctattcatcgcactagtgaggagagtgtggagttggatcatcactataattgagcacagtcagagacggtggcatgaaaaagccaaggacgcagattcacaggagtatagcatttggaagctagaagatcacctactccaaacactcccattttgcagaaaaggagtccaagactcagagtaaacttctcctccccatcaaaaagaaaaggcttgttagttaagttcatgaagctggctggtggtagttggaatgagacctgtggtggcctgcctggcagtcctacaaattagaaggcaggagttctccattcccaagatatacgttcctcaccccggttttgtggcatttgagaatccaacatctgagtatttcttgagggtccttctccagggtctcctttttttttgagacagggtcttgctgttacccaggctggagttcaatggtgtggtctcggctcactgtaacctctgcctctcaggttcaagtgattctcctgcctcagcctcccaagtagctggaattacaggtgtgcaccaccatgcccagttaattttttgtatttttagtaaacaaggtttcatcactttggtcaggttggttttgaacccctggcctcaagtgatccacctgccttggcctcccaaagtgttgggattacaggtatgagccactgcacccggctcctagggtcttctacgttcaggttgagggctgactagttttacaaatactcgaagttcagatacttttctcccacacatctccctggttccactctctagaccctctcgcctccctccagccaacctctttatcagattgttcatcattattgctcaggctgaaaatccaaaccccagctctcctcttccaaccctcatttctccccgggtggactcattttcaccaccgtgaaccaccttgcatggagttccctctgctgccagcccatgtcttcctgactgattgagtcttgcggtgcctccaggtgtcttcctagccatagatctgactccagcttcagcaggccctttctcttgtcacccttgccagccaagtataccttcccctctccttcccctgttcttccctccccagtggttgcttttcttattcatggaacacttgtccccatctcatcacccagtcaccaacactggggacattgtgacacccccatacacttgggtctcgctgttccttaaggttggatggtgcccactcctcctcaacacggctcctcaacatggctccttccccacagtggctccttggccatgatttccgatcccagagttccttgatggctgatatggtttggatctgtgtcccccacccaaatctcatgtggaattgtaatacccagtgttggaggtgggacctggtgggaggcaactggatcatgggggtggaatcctcatgaaaggtttcgcaccatcccctcggtactgttcttgtgatagtgagtgagtgagttatcacaaagtttggttgtttaaaagtgtgtggcacgtccctgctaccgctcttgctcttgctccaccgtgtaagatgcctgctccccctctgtcttcagccatgattctaagtttcctcaggcctcctgagaagccaagtggaagctactatacttcctgtgcagcctgcagaaccatgacctaattaaacctctttcctttataaattacctaatctcagaactaatacaatggccacctattctttttcttctacctggtctagcctcttctttttttttctggaaccatccctttatcctcatcatgtgctctagtccctgacttcacctcctccctgctccctgctttccttgtcatccaggaacttcatggacatcagcgccatccatggtcttgcctaccctagagaagcatgttcctctggcctgtgctgaccctgtctcatccatccccagctggttaaatcttcccttcgctcttctccttcaggctaccaggagcccaatgctgccatttctccaggctttctgggatccttgcatacacaggggctctggtctcagctggatctaatgctttgctcatctctgatttgctccctaccacattgacacaaccccagtccccaactccccacctcctttctggcatattcttgtcttcccactatcagcacttggtcttgcttcctgcattgctgagaagggagactgggctgtcccccaggagcccttaaataccctcttcttccccttgctttttcctgacacctctcttctctcatcttcttatactgacctctgatgcatggggagaagaactcccccagctcatccttccaagcccttctggatccttctagaacatctcttcagtccctctgtcccttgctaagtcttccttctgtcctctccactgattctttcaagtccccaccatcattccccttccttcactactgaatgtcaatgtcttattcctcatttacttggcattcatcctgtgagcctcacttccatgccgacaattctctggagatgctctaccagaggtcatctgttacctcttacttgtcaaagccaaaggcctttgcacactgctgaaatccttgaaagaactgtccttgaaactctccgacgcttcatttccatgtccttactggtttgctgctcctgcaaattctcaccactcttcccgtggcctcctttctttggaggatgcccagggggtgtccttagcactgcttcatgtcctcttcttcctccttccgggggaaagtacaggttcccctcaatagcctcatctctgtggaaagctccatttcatcccttgcctcaagctctctctggatttcttgctagcccttttgaaaacatttttttttattgtggtaaaatatccataacataaaatataccagctcaaccatttaaagtatacagtttagtggcatgaagttcatttgcactgtggtgcaatgatcactgccatccatctctagaacatttctcgttttgcaaaattgaaacttcgtaccagttaagcagtcactccccattccctcctactcccagccctgggtagctaccattctactttctgtccatatggtgcctcacatgagtggaattgtatagtatttgtctttatgtgtctggttagcataatgtcttcaaggttcacacacattgtagcaggtgtcagaatttccttcctttccaaggttgaataatattccattgtaccacattttgtttatccatttatctcttgatggacacttaccatttaacaaatttttaatgagctcctctttgccaggtcctgtaataggcacaggtacacgctggagaataaaacaggcatcatccctgctcttgcgaagcatatagtccatgcagcacccttagtaacgaatttgagtcacaacttctctaatgcgagtcccttgagggtacagaccattgctggcttctttggtggtccccaaacccctaacagagctttgtacagagttaatgcatagttaagatttgctgaatgaatggatgaatgaatgaacccaataagcacttgtaaaagatcagttttgtaaatgcataacttctcttgaaatccttctcttgaagtttcatccccagagagtgtttgcagtagaagtgacttccaaacagagcatggatcactcaacgttttattactcagaggttcttgttacttcataaatcttgagctcccccaatgtaaattgccatcaaacaagcagaacaatgactcaggcattctttttatcaagggcttggtattaagacagattaacttggaggaacagcaccggcctgggtatctgccccatccctcattcttattgtgattaatgagatggggcacatattttttttttactccgcctgaaagcatattgagtttatgcctcatcctacaatgttaaatattggcttagaattacattatctctttacacagatggatgggctgggtgctgtgtgtactgctgacagttttcttgaagtggaaccaggattggtgagggaatcattcagccgtgattacagctggaatgcatgcagagacctccagtaaaactagagtaaacaggtatgcagtgaatccaaaagcaaaagattaatgcaaagatgctgcagaccaagaactaagacagttcagggtagattgtctttatgcagggtgggcaactaactagtaatcatatgccagtatgaagacgtggaactcttcaagggatgatgtcttcgcagttgtaactcaagtgcctcagcactgagtaaggacttaatagatattgtttaaatgaatgaatttatagttttcaaactattttggtatttactattttattttcatcttaaactgacttatgagatagataggtaacaaattatgattcccattttacagttgaagaaactgagacacaagtggtattacgggtcactcaggttaccagggagctgggattagggatctggtctattggatttatatccagggactgctcttccacttaattcattcatcatttcaacaaatgtttgttgaacaactaatatgctccaggttctgtatttgattatgagtgaaggttggtggagatggaaaagccgtgatatctttcatcagggaaattagatctcacagaggatacagatatgaaaaagcatcattacaaccaagtttccaagagaaagaacaatgcatgggcaccgtaccatggcacatagagatctgggcaaatgactttgcttggggaacctggaaatgctttagagaggaggtaacatttccatcagtggagttttctggcttaagaatcccagcccaggggcatgagtgaaggcagagacctaaaacagctgcatcttcaggaatcccaggcaacatggctgggatgtgggcatggggtgaggcgtggcagaaggaacactggagaagcagcaggggctggatttatttggcattaaattaacaaaatttatcgagcttctactaagtgctatgaatggtgtttagtgctgtgttactgtggatataatgagatccataaagttcttgccctcatggagctttctttctataggttggtgcaaaagtaattgtggtttttaccattactttcagtggcaaaaactgcaattacttttgcaccaacctaatagtgaggtgatttggacaataaacaaggaaccaaatatattaattaattaccagttgttggtggtgctaaaaggagctaaacacaacactgagacagaggaaaacacagatcacagtgggaattcctgaggtggtggttttccagctgagctccaaaggatgagtgggaggtgacagtatagagccaagggaaggtgttgcatgctagggagcagtgagtacaaagggccagtggccaggagaaacagatgggcagccagtgtggggacgctgtgtgagagaaggtcagagaggtgggcagagccaggtcacacagggctttaggctgagatttttttctgagaccaatgggaagccatgcaaaggttttatagtgaggtggcctgctggcataacttgatctacatttttgatgtttattatgctggctgctgtgcagagaaagaagggagcaaaagtggagctagaaaggccagtcaggaggtactgctgtatcagttgaccaggtgagagattatggtggcttgggctaggatggtaggagggaggggcaagtgggtaagtgtatattttggagatggaattgacagggtttgctctcatgggggatatggggtgaagagtgaagaggagatgaggaagaatcgcagccttgggtaatgcttgaacaaggagagaggcagtgaagggtggagtaaaatggagaaatgagagagacctcgaggctcatcagcaaggctggacttgatcccatagcagatagggagccagtgactgatgctaagcagaagaataacacagtcaagctggcattttattaggttggtccaaatgttattgcggtttttgccattacttccaacgggaaaaaccacaattacctttgcaccatcctaatagaaggccactttgacggctgggtagagagggggaggcaaggagcctggaggcatggggtgagtccagggtgactgtgacagtgagcaagcaaggatgagggctggaggtggggcagagaccccagactacttgtggcctgtggtcactccaaggtccagtgtggttaggattgtgaaggaaaatgcagttattatctgggaggcattagtaattggaccagggtgagggaggcaagatgggctgagagtaaattgatagcctttgggctctcagtggagcagccagcctgctctgggttctcaggtgagaaggctgtgaattctctactgggtgggacaccctgatgggttgcctgggagccacacagcccccagcatgcctctgggggaggggaagggggtccagggacctgctgctgtgtagactgttgggtcatcaatggtgcctgagtgaatgtgctatctcaagatgattgaactatctttgggggcggtgagcttcctgttacaagagaagttcaagtggactgataagtacttggcaggggcttcaaatgccaggtggaagtcgtactagatgtcctgaatatctccttctgccagcactcctggttccatcaggttctggggagcttagggggagttctacgttaggccaggcactcctgagatgactgaaaccttgttgtgggtggaagaggttgaaaggaccctgaaactgggctcctggttgtcccaggccctgtttacagtggctgtaggcttcaggcacttgcttcataccaataaatgggtgcagggcagcccagggcagccacatcagataattcatggaatggcagagaaatcaccattctaaaaggccaacaccagcaccattcagctctttccataatctaaggcagctacactaattgaaaaaaaaaaaaaaagtcagtttggtttggttcagcagtcagcaacatccattcatggggtgaatgaatatagaagaaaactcaggcctgacataatgtaagtggctgcatatattgtaataaaacccacatggactcgtgcagcaatcccccgaaataatgagttcaggtttgctacagatttgcggctagctcttccagagccagtttttttctgagaggcatctcacctcacccgatgatctttagggccagtgatcccctaggtaactgtggccaggaaggaacggctgactaggtgggtacagaggctctacgtaagtctctgcgagagatagttttctggtggcaagaggacttgatttcctttgcccttgtacagagttctcagatcagggatcaaactttgggcatttaatccctttttccaattctgcatggttcttgcttttctttatattattctatcaaacaagctacaacaaataccaattgctttttactgctagatcaagccaaggagcatagaatatgatctctagtggggtaatagaaggcgattagagaatgagacactcatgatcaggtataaacagggtgagctcatcaggggataatgctttgcactttttagaaaatatgagacttagctttagaagttgagcaggattggctcatgtctgtaatcccagcactttgggaggccgaggcgggtggatcatgaggtcgggagattgagaccatcctggccaacacggtgaaaccccatctttactaaaaatacaaaaaattagccaggcctggtggtgggtgcctgtagtcccagctcctcaggaggctgaggcaggagaatggtgtgaacccaggaggcagagcttgcggtgagccgagattgtgccactgccctccagcctgggtgacggagcaagactccgtctcaaaaacaaaacaaaaaaaaaaagttaagcaggatttggatggggtaaagaagaccgaaacagtgttttgggtgggacactggggaatgacccagcttgtaactgacaaagacacttaaaggaagaggtgaaaatatcagtgaggatgtagagacattggaatccttgtgcactgctggtaggaatgtaaaatgatgcagccactatggaaacatcatggtaactccttagaaaattaaaagccaaattaccgtaggatccagcaattccacttctaggtatatatccaagaaaagggaaagcagggtcttgaagaggtatttgcacaaccatgattatagcagcattattcacaatagtcaaatgttgaaagcaactcaagtctccattgacagatgaatgaataaaccaaatgtggtatatacatacaatggaatattattcagcattaaaaaaggaagaaaactctgacacacgttacaatatgaatgaaccttgagcacattatgctaagtgaaatgtcaatcacaaaacgacaaataccatcgaattctacatttttgaggtacctagagtagtcaaattcatatagacagaaagtatagtggtggttgcctggggttggaggtagggggaagtggggaactattgtttattgggtacacagtttcagtttgggatgatgaaaaggttctagagatagatggtggtgatagttgcaaagcaatgtgaatgtactttaacactattgaactgtacatttaaagatgattaagatggtaaattttatgtgcattttaccactgttaaataattaaaaatggaaaaaactaagaggcagaaatgacttccaggccaggcccaaatcaggaggagcagggtttgactaaaattaacatttctatggcctctgtgctcaggatagcacctggggtttaggagggattaggatgcaataatgagttgaacacaaacaaatctagagaagcaagaacttcctagaataggagcaggaaaggcaggacaagctgactgagtcctgacttaagatggccctcatggtacagagaggggccatgatgtcaatgagttgatgtatctgaaggcctgttcaccaaaccacctactgatcataatcagttatcttggcccccagcgtggctctgccggcagtcagagaatgcactgattggtcaaggagtgaattcacaccaatcactgtatgttttattggacatttcaaaatcctattcatgacttacatgtcttgcgtgagtgtggttagcctgagtcctgagcatgtttggccccaccaaactgagggtctgatctagaacttggggagtgcactgagaaactgccaccctacagggtctggctggctttcttgagaggcttttccaccgtcactgatctgatgttcaaggcaagcagaaagtacacgtggaccctctgaaactgttctggcctctagcttcagttaacatctgcatgtggacacccaacgcatttcctttctgactcctgctactgaaagtggtctgttcagagcagtataggcgtcagcttgttagaaatgcagaaaatgtggcacatatacaccatggaatactatgcagccataaaaaatgatgagttcatgtcctttgtagggacatggatgaagctggaaaccatcattctcagcaaactatcgcagggacaaaaaaccaaacaccgcgtgttctcactcataggtgggaattgaacaatgagaacacatggacaccagaaggggaacatcacacactggtgcctgtcatggggtgtggggagcgggaagggatagcattaggagatatacctaatgttaaatgatgagttaatgggtgcagcacaccaacatggcacatgtatacatacgtaactaacctgcatgttgtgcacatgtaccctaaaacttagagtataataaaaaaaaaacccaaaaaaatcccatatctgcaactcaaaaaaaaaaaaaaaaaaaaaaaaagaaatccagacttccagcccatccctgacctattgaatcagaacatgcattttactagatccccaggtgattcacaggcacaacaaatgctgagaagttctgcttaagccatctaattcagcgtctcccaagcgtgcccagtcatggagatcatcaaggtgtgcattattaaaaagatgcccaggctcctttcttggtgattctaattcagtgtgtatttttattttaatagaaagggaaaaagaaatggatgtgagtagcgtgtgcaggtatgcccatctgtggacggaggggaacagtgatacataagccctgctatgagaagaccaggtgcccatggtcatgtgtggaggcttttctgtcatggaaacttctagagggaaaagagagtcaattttgtaaatgtttataagcaacttgtagtaaatttggggacactcaacatttaaataacaattctagctttgacctttttcagcattattgatttcggcttcatctctcacagaagcatcctcaacacatccctggtttcccctgatagattaaaagaagcttatttttcaaaaatgtagctgagatagaaaggcttaaggagaacaggggttccttcaaccatggagaaggctgttttaagagtaaattagatcagcgaaagctttctgtacttgcttgtacaatccctttcagtccctccttctctcatgcttttcagtgaatattaagtctgaaatctggaagaaaagagcctttctaccttccaggcaactatctctctctgagtcctcatgaatcctaggaacttttatacttttattcatgaatgaatccttacctcctctgccaactgcttcatcaaagaaccatgactcaccctaagttatgcaaaaatcaaagacacatagttggaatctatatttcttaacatgtctctcttcttttattccaatttatttctaatggaatgccttttacaacaactaaaataaccttttagatatgcaattatagtgcagactttggggacactggagaaccagaaagaataaaggtagggttggggagaagcatttaaaaagagaaagagagctagagagggggctttatttacaaggcaatcgaaaggtagtttttaggtttagcaattgtgatctgtttgtggttcaggtttgggacttggcactttgtaagaagaagaatgaccacccagtggctttagttaccactctctagtccaggattgcctatgggatcatgggtgtaaaggaagcttgacactgggtttgggccaaggtggccagtggaggtggccacagtccctgacattcttgtggcttctctcacagggaaggagaagaaatcctagaagaagtaaaaaggctgctgggtaagcagagaggaggaagctgactccatttctttcatcccacccaggcagtgacacaaaacctgtggctcctttaattccttcatctggtctggcaagtatgaaatgtccctagcaattggcattcttaagtccccttaagagtccctgatggcaggtgtttgctattttaaatcataaaaataatagttgaaggaattaatcaatgaataaaccaatatttgtttagcatcttgcaatggtgggccaacaaagcataaaacatggccccaaaatagaagaagcttgtttctacaatgattatgaataggctcagttcatcttttttgggaagttgcttaatttccttgagccttagttttatttgctgtaaatggaaattaatagtatttacttcataggctgctataagtatttattgtgtacaataattataatatgtttgcagcaaaaagaaatcaataactaatagtgaaacaacagtctctttggggaaaccagaaacacctatacaaaacaatttgcaaacaaagagagtattggatgtttatagactgaggaaacagagtatggttgaacaacttccaggtattacctgatcaggtgggacactggagttttattttgtggtctagacagttttacagagttgagagaggaagagaacagagtgggctgatgttttctgagaagtcttcatgaggaaggtgattcgtgaatcagaggcccaggaataccactcatgttctctagctgtgtctgcactgtgcaaggcagactgaagggtaggtaaggctaaataagtgggctctgatcctttgcctctctgctctgccaccatctctctcactagcccttcacccttacactcaatgcacttgtctgtacatacatgtatcacttcctcatctccttttcactaattttactctcacctcttttttctaggtatttttacaaaatgtcagctttattgaggcaaaacttatgtgcaataaatggtatccatttaaagtgtacaggttgatgagttttaatagttgttacactgagaaaccacaactacattccaaatatagaacatttccatcatctccaaccctctctctaccttccaaaaagttatcttgtccctttgcagtcaatcctgccctgcttcctggggaaccactgccttgctctctgtcattagagattagtagattagtttgcattttctggaattacatataaatggaagcacaaactatgtggtctttgtgcctggcttctttctcttagcataataattttgagattcatccatgttatcatatatatcagtattttatttatttttattgttggatagtgttccatagtatagataaaccacaatttctttatctattcacctgttgatacacatttgggtgcagttttaaactactgtgaataatgctgctcttaattttaatgcataaagttttgtggggacatacgttttcatcctcttgagtaaatgtccagacagggagtagaatggctgggttgtatggtaggcatatgtctagtttttaaagaaatgttccaattgtttttccaaagtgattataccatgttgtattctcaccagtagtatatgaaagttctagttcctttatatccttaacaacacttggtatggttagtctttctaattttagctattgtaattttactaatgactagcgatgttgagcatcttttcatatgtttcatggccatttgtatatcttctttagtgtaacgtctattaaaatattttgcccacttaattgggtgggtacaagttcttttcagatgtaagtatagctaatattttctcccacactgtggcttgtattttgatttttcaaatggaatcttttgaatatttaaaagttttaaattttgataaattcctattgatcaatattttgttttatagtttatgctttttgtatgctatctaaaaaagttttttcttacccaagtctgcaataattttctcttatgttttattccagaaatgttataatagctttagattttgtttaggtctagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaggcctttgacaaaattcaacaagacttcatgctaaaaactctcaataaattaggaattgatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggtgaaggaaataaagggtattcaattaggaaaagaggaagtcaaattgtccctgtttgcagacgacatgattgtatatctagaaaaccccactgtctcagcccaaaatctccttaagctgataagcaacttcagcaaagtctcaggatacaaaatcaatgtacaaaaatcacaagcattcttacacaccaacaacagacaaacagagagccaaatcatgagtgaactcccattcacaattgcttcaaagagaataaaaatacctaggaatccaccttacaagggacgtgaaggacctcttcaaggagaactacaaaccactgctcaatgaaataaaagaggatgcaaacaaatggaagaacattccatgctcatgggtaggaagaatcaatatcgtgaaaatggccatactgcccaaggtaatttatagattcaatgccgtccccatcaagctaccaatgactttcttcacataattggaaaaaactactttaaagttcatacggaaccaaaaaagagcccacatcgccaagtcaatcctaagccaaaagaacaaagttggaggcatcacactacctgacttcaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacttaggcacgggcaaggacttcatgtctaaaacaccaaaagcaatggcaacaaaagacaaaattgacaaatgggatctaattaaactaaacagcttctgcacagcaaaagaaactaccatcagagtgaacaggcaacccacaaaatgggagaaaattttcacaacctactcatctgacaaagggctaatatccagaatctacaatgaactcaaacaaatttacaagaaaaaaacaaacaaccccatcaaaaagtgggcaaaggaaatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagttaggaaacaacaggtgctggagaggatgtggagaaacaggaacacttttacactgttggtgagactgtaaactagttcaaccattgtggaagtcagtgtggcgattcctcagggatctagaactagaaataccatttgacccagccatcccattactgggtatatatccaaaggactataaatcatgctgctataaagacacatgcacacgtatgtttattgtggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagaatttcctagaccttttaatacactcccagggcttgaagactactcctgcatgccaacaactcctggtttttggagtttggaaagatggtccacatctttcctccaaactccagacccttgtgtccacatgcgtttcctcttggatgtttataagtttcaaaaaactcaacatctcaaaactgaagtttgtacttttctctccacacatgtgcctccgtcatttttgcctgttttggtgaatggctctgtctacccagttggtcaagctaaaaatatcttctcctctttcccacctgtatccaacccatcactaatcctgcccattgtctcttgtacatatctgcaagtcattcacttttctctatgcctcactctgtattcaggactaccctccctttccttgtggtgctgcaaaggtctggggttcccatacccatccctaccctacctccaactgacttgcagttccatccttaaactctacatcagctttccttggctttgaagataaggattatgatcctaaatattcctgatcagtcctctgcctgtcctttcccctggccttctctccagccagtctcctcttttctttcagactcagatgcatgttttccctgatttcctaaaaaatatcctacctctttcccttcaggtccttcatatgctgttcccactcccagaaagggtcttgctacttgtcacttctactcatctttcacacttgagttcaaatgccacctcctgggggaaggctcccctgagcccctggcctagctcaggtccctacttgcaagagctcctgcaagcctgtacccctctgtcatgtatcactgtggcaatgacataattatacatataattgtaatgtagtatatatttcactctctagcatgtgagcttcctgaggatagtgactgtttctgcttgtcccctgttctattttcaccatctagctaatttccctgcacataatagaggaattcgtattgaaataagtatttaatgactgaatggatgaatgagtgaatgaaggcaaagagatgggtaatcctggataggatgaagggtaggggtgatccatggggtaagacctcaccaagatggtaggggtggggatagggggaggcataatgggatcatgtggttgtgggaaacacttttgtagatgtcctttttgaattggaaatcaataaacaattttctttccccaatcatgtagcagactatcaattatagcaaaactggtgggacttaacattactctcatcaaaatcaacctgtaaccaactttagaagcatacggtaaaatagtttcagcacggaagatgcagatgtaactaaattcttatcacactagcttcctgtttagaaacaattaagtataggcatcaaaaggcacaggcaagaggggaaagttcaattagaggaagatgttttcataagccaattagaaaacagggagatattttcacccttcctctggagattttggaaatcctatttacacagctgtgaaaggccagctcaagcttggccgagtgggctaaggtgagttctgggtccagtgacctgggtgagggctctgacagtgacagtgctggagtcgggtctgtgttcagagtgagctcctgcagggcagcagaatgcatgcagactcagtcaccctcatcttgcctcagtttacctaagaatacattatgtacatgtctctcctcttagtggttcattacccaattttacctatgaatagaatgaaacaactcctctgctaagtgcactgttggggtttggtgggagtatagatcagacactgcctttagtcccccacacctgtcctgaaacagggcacagcatgaaacatctctccagcttgcaatggttctgctctcagttttcccatacagataccatatgtggtgaggctttgcctaggatcctgcctcccaggtcctagtggtagctgaacgaagggggtccactgggtaggtggtggagatgctgttccatctggtacatgtcggggagatggtctcttctcacgggtacttttccctgtgcatctggcatgtcacctgccagggccactgtgaagtcccctgctaagggggaggaatagtggggagccacctctctacatctcttctggaggggtcacatcatatagtgcagtggtgtctgtgggatcaaatcccaactctgttcattactagctgtgtgactgaacaagttcagtctcttcatttgtgaaatggggataataatatgttacctcacaggcccattgtgaaaattaaatgggtaaagataggtaaaggcatttagaacaatgtccagcatatagtaagtgctataaacgtggtagctgttgttatttgacagcaatgagctgggttagcagtgagtatgttagcagtgagtatgtcttgttttctatctctggtcagggatgctactgtttcaggcctgcctggcacaaaatacatcagatatccttatcatcatctactttcactcacacattcgcatgacactaattttgagttttaatttggaaatactgcccagtcaacaaaaatttattgaatacttcttctgtgtcaggcactcttttggactttggggaccccacaatgaaagttcagtgtatgttttgatgaagttgaggctgtagtggaaaaaatggatagaaacacacacagccagtgaatttccatgggactggggctgtcacatacagagaggtttaggggcagcacagagagaagtgaccctcaggaacggggagtccaggttaatctcccccagaaggtgccatccttacgttgctgataatcatacatctcagagcttcaagatcttcattatacaactgtcattttatttctcttgtgtatctagtgggtcattatatctctgaacatatattaaaatagacggaatagattcaagcagcttttactggggcactgtgctaagagctttcatccacattaaatcatttaaccaatcctctatgaggacgtccagatttcttcagaaaccaggatgccagatagaataattttttgatggatggagtccattaccagtttaggccatgagcccaggtgattgaaaaagcattaatcaggctattgtcctggtgttgccactctctccaatttttaaacctcctgctactaatggagatattatctgactctcctgatgataaaagaattatctcatcaaatcaccacatgattatcaggattgcagccttgctttttcaccagttccagaacatcacttaatttttaaactacagcgttggctggtgtcctttgtgtttttgtgtatgctttgttttacctccaaagacttctggccgtatgatttgtatttaaagctagatgtcaagtgtgtgcatggtgtgtgacagacagagaaggagaacctcgcctccccttcatctcctccttcacctgtctttacttcactctgagaccaccaagtcaaactccgtttgtaaatttacttcccaaatctgagctcttagaagttctcacctagttcaagccctccctggagatatggagaataaaacagggttggtggtgggctgtagggctccccagttcccttctgtgcagtccaatagcagagaatgagtcagaataggcatgaggcagtctctctggcatgaactccaggcccattttaaataacgcatctaaatgttaatgcacacttaagacaacagtgcagctcatactcttcccaaattgattcattttgcagtgggcctgatgcaatttactcagtataaaaatgtctctggcaattaggggaacaaaggggcaaagctggcaggctacagggatgacaaacaaagcaagatgatgtgaaagctggggccagaattgaatttctttccgaatcagacatttttgggaatgtcaatagcaaacaagaaaggccttctttgcctgcaagaaaaacttgaggattctccattcagaaaaaagaatcaaatagtctaagaaatggttttagtgaaatgctacagcagctttcatggttcctaacggtgtcaactttaggtggctggggttcaaacgcagaataaagctagcgaaagggtgagccaggcttaagccacatcagcgggtggaggttccagatcactgaagaacaagtcccctgacccctttgctggtaagaatccctctgaacaatatggctgtggcaactatgctgtagaagagactaaaatcacttagcctgggaaaacaagtgaagaagagatataaaaactatcctcaaagggaagacagactgccttgttaggagaaagtaagcttcctctgtatgactctagaggacaaatagaggatcaaccagatcatggtgaaataggagaaggaactatcatgtgttgggtgctgatatgattctaggtgctttgtatgcattatcatagtactacttcatagggaaactgtagtattaaatgaaatcatatgtctttgtattaagaacatggtaaatactctatacacattggctatcgttgttaaaagcattattttcacaaagagcctacaaggtaagcaggtattactattgccattttgtgtataaaacacaagaggtttggagatattgaataactttttagagacagtcattacctttccaaagttacaaagccaaggggatatcagcaagttctacctgggagctaaagctgctgtacaatggggtgatctgttttgcaaggtggtgagcattctactgctggagtcaggcaagtcaaagccagatgggctttggaagagcctcttgcattgttttggggtaggggataaagaatttgaattcaattacttttaaggttcatttctggttcatgattccatgattgaaatatttttcaagttctgctagctagattatgcctttaacccacaaacagtcatgtaggattgtgaaattggagaggcagtcatgggtgaaggccaagaactaaggaccttgggtatatgatgaaatacaggagtttttatttccatctgatttctggctttgccaacaaccacattttctggctcacatcccacacacaatgtacctgctgccaccacctcctggaaccctggagactgtccgtaagttagacaaggtggcagaggttaaacaagaaagttgatagacaagtgaggctttttagaaatggaagtcatctggatctactgagaggatgagccaatggtcactaggaagctcccagggcaggtgaccaggccactgcgagaaaggctggaagactccagatagggaaatcactctgaggcctgcaggtgaacatccagcagactgccgattagaatttcatgcagtcacagagaaattttagtcctaagacagagaaacaaaatcatggagggaatatttaggaaacagttggacagaatgtaattggaattcatcttagattatctgaaaagataaaacactcaacagaagtcagtgtggttaagtggtgatgtaaagactagtaaactaaggagaaggaggaattgggggaaaattactaagtagaagtcctgactggaagaacaggaaatatgcaggaaatagctcaggaaattagaggaactaaaaggcacacacggacagggcaatcaccaagcatgggaaccacctcatttccaagactaacataggccagcatttgctcggcagtgtaggatggttaaggccacaaatggagataacccaggctgaagacagtccttcgattggaggttgagtagaaggaagtgagtcgttatgaagaacagagatggaattttggtcaagagcattatagatgcattcttaaaaccatgtcgcaagttttcaaagagtttctggtccaattaatttgggaatttgttcatttcataagcatttattgactgtgagacaagtactgtgctaggcattgcagatacagtgataaataatgcccatccctattcttggggtacctggttggtgaggaagacatgtgaaagaacaaatgtggcccagggctgtgagaacactcatagagatgtggaacaggcagcaaatggtggtgcaatcagctctgctcacagaaggtctggggtctcaagaaaggctttgtggaaaaggagctaagagattccttcttggaggagaagacctattgttcttgatggtcgggaaggtgagggaaggcaaaatggcttgaactggcttgcttcacttgggggcaactgtgggtagtttgatacaaacgaatcatgggtccagagaaatggggtgagccaggctcaggaggggtgaggcttgatcagtggctttgagtgccatactaataaacagctcagacttgatcctgggtttcacagggatcccctaaaggatttgaggctgaagattaacagcccgtgatattcacttgtcagttctctcatccgggtcttcatttattccaacatggggcttcctgatggccaggagaagtcactgagatgatcattctaggactgcaaggaacgtcccacagaatgaacagcacaatgcaaaataccaatttgactgtgggttctccttcacactccttttggtgaattgaaagcctggatcacacagtggggctaagaaaaaagcagcatggcccacaggtctttccttagactcccattatgtgtgcatcatttgagctaagttgccctatagggtggagcaaggtcctggatcctcaggtaacctggtgccctcaggtgagtgatctgaagaaacatcttcagcttctggcaatggtaggtctcatgccctgggctcagcctgctctcagtggcctcccctagggaccctcccttttctcaccaccacaagacttccccactggcagggggaacacaatcagtcattggaaaggagtgggaacactcattcactgagcttactgatgtaagattctcccaggaatagacattgcaccaaatctttgtgtagactttgtgaagccctttaaattcaaaatcccaaggctgctatggctcttcactaaggctctgaaccataagagaatgcatttctgtaaaagcaaggagtttagccaggcatatgtgtgtcgttccctaaataaaacaaagaggaaaaggcaaacttagaaacaggccaagtaatgagaaagaaggaggtttgctttgaggctgggcatgaatgcagaggggaactgggctactaagtgggtcatggtgtttcctcactcttgggccatcagctccagttgcctggacagtttccttatggctcaaagagctggcaattccatcacccgattccatctcctcaatgcagacttggtttttgaaggtgaaggcaactgggttggaatggagcttcagaagacaggagagcggaggccagcctttctggataggctctctatgaccttcggcagtgccagacataagtctcaggactgcctgctctctaaaacaggcctcttctgtgcatcaaagccttataactttgccatttattgcggacaggaaggactgtatgcacaccatagaaaaatgcagctgggatttataaacaataaataatggttaataatgataaataaataagactgcatccttaattatcagctggcaatagggtagttaccatccatagagtggtgattgggagcagggacagtggagctggattagctgggctcagatccagtctactccttacaagctgtgcaactctaggcaggttacttaacctcactgagcctcagcttccccactgtaaaagtagtagtgctagggcctccctcaccaagtggtggtacacataatattagatgagctgacacatgcaaagcacttagaacaatgctgagaccagagagtaagcatcaagtgattcttcctctttctcttcctcattatcatacaaattacggggaatgaaggaagggacgtgaattcctatctgggatgccaggtcctgtcccgtccccagccagcagcctcattctctccctgtctttcatgtgttggcacttatgagtcaacagggagaggaccctgggtccctgttgactgtagggagagacaagctggtaactgaatggtcacaaggctacatggtcaatgctatttgagaaaccctaaaagggcttctcagaggaggggacattgcatgtgtaggggtttttgtagtggaaaaggggttaagggcagtccacaaagaacccccaccccatctccatggctactcttcttgcaaagtggggactgaagggacaacaggccattcctggagtcctggctcatccactgaaacccacttgtgctggtgtaaaaaatagttgtatgcacagattgtccatataggtacttggagttttcgttagggaagaagatactaccagagagaaagtgaaagcgaggggagagcctgcactcagagggaggtcttctgggcatttgcagcaggacatttgctacaagaagaggtagtggtgattgtggggcttagggatgaggctttgctgtctgaggactgcttttgtggagagggatgggctttcttgctacataagccagtggccacaaacacatgaaagtgagcactcagagagccaggataaggaaccccgggcaggagggggaggaagaaaccaagagaatcacgtggccacagctcatcatctgtgtcctcaggcggtcctttgcacacgtgcactctctgtgtggaatgtcttcctctcatcatccacctgacaccccttgcccctgcagagccagctcaagtgtccttctcagggctagcttgcctgacagccacaagcattcccatagcacccaatgcacagcacccattacacccctttccttatggcctcataactgtgtctgtcgtccaactccaaaccttgttctgagcccctggaaggctgaatgagcttccagagtccaaccagtgcctgggactgagcatgactcatagacatttgttgacagaatgcatacatgaactatgagtgaatttcttgacaccagtgttctatcactaaaattcttgcacctatttttaccatctccctccccactgggaaacagtgaggctcagtaaacacttctgagatgagaagtgtctgtttctatgcattttgacttctctttgtatacaatatatatttatcattatgggattggccaagatgccattctgacaagcacggggttacaggtattcacagttctctcatcgtcctggtgttcaatccatcaaacatccagggcagagtgagaaagcaaaagcagcagctcaaaagagcctcactacaagccttcagctgtcaaatctcgaaggtcagaactggcagaagctgaaggtttttttttttttttttttttttttttttttttatgcccatcaatgaaagcaatcgtgagtaaaagttgtacctgccaggaaaggaattgtcctttgtacttcatgacaaccttcacagttgaggtgcattttgacagctgcttcctgagccccagggagggttgcacatttattcctgggtgtgggtggagggcagggagaaaatacttttcatcttttcatcgattggagactcttctgtgatcttgaacggggctttaatttttagacccagagcttaggctttagaagaggtgcatcctagaactagcttcaattgatatgttatccatccacctaatatagaacccctactatgtgctaggcagtgtgccagacattgctagcataaaaaggtgtgcaacccaaagtctccatcttcaagacttgtgggccagaattagatgaccaaatttcagaggagtcctcctgagaagagcttttcctgactggataagaacagctcttagtttcctcggagccaggcgtgacgccaaggttcaactgcaaggctttcttgggaaaacaacacaagaaaagaaatggacccagaagatctgtttccctgtgttacccatgactataagcaaattatggaagctctctgagattcggtttactcttctataaaggaggtgaataatatgaatggtacagatcatagtaaaggtgaaatgagttgatagaggttgactcacttggcaaactgaacatgcactgtacagatatttaccatgaatattaacaacatagtatctgtttcatgagaacaaaaaggagggctgtggctctgttgttaacctgggacctagatgagagtcaatatgtgaagtacaaagagaatggatggatgggtggatggatggatcaatggatgatagatggattaatggatgaatggattgatggatggatggatggatggatgaatggatggatggtagatggatgagtggatggatggatggatggatgaacggatggatggatgggtagatggatggatggataggtgggtagatgggatgtatggatggataatggatagatggttggtggatgaatggatggatggatggttagttaaatggaagaatgggatggagcttccttctggctttaagaggtttggcttctctagtccatctgtattcttctcattcccctgtggctttggaagccatagtccttctagagacagaataacagatgtgtcaggagtatatccacctgtggagaccagtgacattcatgaccttggataccctccagctacctcagctcagggactatgtaggcaggattaggccagggttggaaaccttgtcactagcctgtccacccataagtgggagaaaaatggctctccaccttaaacacaagtccctcccaagtctttaagctttcttttttacttttcttcctagtgcttagtaaatggttatataaagctacccgcttatgtgatcaaccaattcaagctgagatgttagagccatgattcttaacttttggtgcacacccagaatccctgcagagctttctaaacatacatatgctcatggcccactccaagacgagtaaaatcagaatagctcaagatgagactcgggccgggtgcggtggctcatgcctgtaatcccagcactttgggaggctgaggtgggtggatcacaaggtcaggagtttgagaccagcctggccaagatggtaaaaccctgtctctactaaaaatacaaaaattagccaggtgtggtggtgggggcctgtaatcccagctactcaggaggctgaggcaggaaaatcacttgaacccaggagacggaggctggcagtgagctgagatcacgccactacactccagcctgggtgacaagagcaagactccatctcaaaaaaaaaaaaaaaaaaaaaaaagatgagactcaattgtatgaagtttgtaaaatgtgtagttctcacttgtattactaaagcttgagacctactatgttaatcgctgaaggtccagttcctcttaagaggactagcattttagtagttgcttcaatattactacttaaagtggggaggaatatggtaaatccaggtatactcaatgggactggtactttgggatctatcttggagaacacaagtggttactctgagaaggaggggtttaagtgaaatctgtaaccctggctctcttcctgcccactctcccatgaccctgagcagcctgagaggagagtgtcccttagacagacagcctgggaggcagggggttaggcactatcagcacctgctctgcttgttgatctaatttaaacccacgacaaccccgtgagtggcacaattactaccatttgacaaagatgaggcttgtagagattctgagacttgtccaagctcatattgtgtgtgaagaatttcctccaagaatacttagagctcaagtctcctgcccactgtgtgctcagagaacttcgagctacgtgattgctcctgtaacaaggtgtctgagaaatatccccctgacaagcctgggtgtgagttttaaggcttttaaaaattacctttagagcctttgaatggctctctctttttagtgtaaatcacctagacattaaaggccttattgtatatttattagtgtgttattcagaccatgggggaaaagagagaagctgactctatgaatgactttgaaagtgagaaaaagctgggcctgaaatcattgtgacactgccacttgagggcatcagtttcaataaatgatcaccttttttatttctgatctcatttatcatgcaggcaagattcgaagagaacttttgaccatggaggctgaatgccacaggctctgatttcctcagctgtcaagacttgccacattgcactgggctgactgaagttcaacccagagcagcctgggaaaagcaatcaggtcccttttcagaagcaaatacctggtggcatctttccacaggtgccctgccctgagaccatctctcgcttggcctgtctactgacaggaacagccagggttctgtgcattagtggtgaaggtatcagtgggccagtagggaggttcctctttgtccagggagcaggagtctggggtggggagaattacttcctgctgccctagtcctggatggcatctgaggataggttgctggcattgccaggacagaagaggggagcagagggcaaccagagcttccactttagaaggtaagaagctacggctgggcaatactgtggttgtccataaccatgctgcaaattagcggtggaatcaggattgaaaccatacctcctgatggccacaaatcaatatctttttgagttaaattaccttggcacatttcctattaggattgctactggttttaaagctgggatctttggtcagaactgactgccttaagtaagcgcggcagctgtgtgggtacccagcatgaatgcaaatttttcttcacttggggagggtggctgcagattttaatctaagggcagtgagtttgagggtttcctgatgcagctgggcagctgggaaacagacctttccagggtgccactgtggagatgagtcctggctttgccacgagcaggcagttttgtttcttagtttgtttttttgagacagggtcttgctctgtcacccaggctggagtgcagtggcatgatcacagtttactgcagcctcaacctcttgggctcaagcaagcctcctgcctcagcctcatgaatagctgggattacaggcatgtaccaccatgcctggctaactaaaaatatattttttttgtagaggttgggggtctcgctatgttgcccaggctggtcttgaactcctggccccaagtgatcctcccgccttggtctcccaaagtgctgggattacaggtgtgagccattgtgccgggtctgagcctgcagtttgaccttcatcacgtcacattacatcacatcacccgcctgggcttcatgttccccatcaggaaaccaacatggaaaggggaggaggttagactcccgtatcttccgggtctaggggttgaggtcctgcagaaaggcaaggctttgtgctgagaatttcaattcaccaccaccctctggactgaggcttatttgtgctttaaaatgccctgacagcttatcttggctcaagcctgagtttcctcaacgacttccggtttaaaatatcttttcaagtattagtaatccaaatgattggcaacttctatccccttgaggcccaattcttccctccacacactgtgtagttctggtcatacataataaagtccccagatacccgctgctgtgggaaaaagtcatgtgcttcgaaaggaaacaagacacgaggtggccttctgggtaggagccctggagagtgtctcctatagccctacacgccacccaccatcaagcttgcgttcttgcatccgggagaggaccaattttacacagacaattgctgctggattgatcttctgagacacatcagaatggcagtgtggtgcagtgggtggctccctagccggctgcttctgctggatctgccactagcgatcttagctcagcctcttaataatacgagcctcaattttaaaacattcacataagcatgtgctgttgctattctgcttgtgtcttccttactggactagatgttccttgaaagctgtgaccttgttgtctttggctgtgtcatctttggcacctgccacacaagaggcactcaatccatgatggtgagatgaatgtttgaacccaaaaggacctagcacttattagtgccaatgatagccaggcactgtgcgagccattttccatatgccatttcacagctcaccattttacataagtattatcctattcattcagttcatggggactttatggccactaatttctagctaagatgtcctatgcctatgtgactctgtgatcagccgggcctaggctgtttggtagcccctatttctctgcttccttgcttctctggtcattctggccatgcagatgagcaggctgggcactcatctgtctgtcccctgcgagactccagccaaagcccggcagccttggccaacgtggccactcatgctctgtgattcattagacctcatatactctgctgctttccaggcaaccaggaaggcagcagctgctgtgcttctccaactgcctttcccctgccttctgcctccgggtgcttccaaccagtctgctgctcctgccccacccgtgcacgacagccggcaccacctgctcacgacacagtggtttccggggaacttggtggcgtctgacttgtcattcctcagcccactcctctgagtcaggctctccccagccgactttattattacaacttcctccctcgttactacaaacacggaatgttgttttccaaatagtggtccccaaaccaccgtctcctgttatgagaggaagccagccccattcgtaatcatcacattcaacatcaccaggatatcactgtgtccccctcgctgctctgagcactatgctagtgaggtcatctctgacattaaacagagcaagctttcggcaaggcaaactgctgagtactgcaaatccaaagattcttgagactagcagcgaccccataatcagagagcaggcaaatctccatcctttgtgatcccaaactctgaacagtgcaaagctgggcaagttttgatttgctgggcaaatgccctgttccttgcagctggccaaggcacccacaagagtagctctgcgctgcagtggatggtccattgattgtcctttctgctgccaccttctaccctcaccacacagatctcatgggaggtgaggaggctggtccaggcatctttaaatctggaatcactccagctcatcactaaactctgccccagacaaagccatcaagtcactgaatttgcctcagctcagtcccaattcctctctcctgctcaactcacaccctccagaggacagagcagctcctctggtgatggaggcattgccttgggaagaggataagttgggtggccaggtggacgttgaggcaggtgaccatggcatcatgtggagggaaggctgcccctgaaggcactgacatggcaagtcccagggctcatttgtcttgaaggatcaaataatcaaaataatcgctcttttttttttttttttttttttgcaagattctttcatatttccctttctctttcccaactccaccctttctccctaagaggcttcaggtctcctggaaagagtccagtttggaccacatcacttcctatttcctctctctgcctcagttttctcctcttttaaatgagaattgacttcctatatgagcatagaaaggtaaagagggaaaaactatttgcaaggccctatggccagtcatacccgaggagttattttcctgactatgctacacagggaaacaggccaggccacacaagaagtgctgaaacccctctggcaccttttctcacactcatgggtattctcagactccaactccacctctcccagccacatcagtgaatcctcccacccgccaccagcaccacaatggactgatgcctgagggctcagaagcctcaagcagcactccctggtctctgccagtcctggtagggaaggaaggaatgttgagagtgataagtcagaatatgcagctctcagaatatgaggctgggcaaatacctataggatggcacatagccctgccctcagataagaagtcttcccatccaggcttcttactggaaagagaagccgtgctggagggaggcttggtgccagaagatagctggtcccaaacaaggggcagcccagacacctgctatgccacactgatatctggtgaatagagcaagagtccttggtagctgggaccttctcagccagcccagagaggcatttcagaggcaagaagatggatatgagtttaggaatggggagagcattctttttgatgtcaagatttcattcctgatgagactgcagcagcttgtagtccttctaagtgcaactaaatacagatgggttaatggctgggagtggggagaagactttcaagaaattacgaaggaggccattcagccttattgccaaagcaacaggcaggatctctcccctgcacaccatggggatggacaatgggtaacagttatcgttcaggtgggacccttctgaaaaggtattctcttagaaggaagccaagtctaagcatagctagacagttgggctttttctcctgtaaacaagtcacaaagaaggatccttgttgctaaagtaatcagatctggggtccctcaacgctgaggtcataggatggtatttatacttatggaatggaaaaacaaaagccaggcacagaagtgccctagtttaagtttgctttccaatgtcactaccgcagaggcctgatggatcactgagtaagcaagtatctccagaaagcttagaggattccactgtcatatgtcttggtggttgtagcacaaagctctgttccaatctctactgaattacattggcgtagtatccatgactaatcctgctctggggtaccaaactcccatagaacccgcttggatggccaaagtactttgtcctttcccttcctgcccaacttctgctggtaaaacccagtttctaccatattaaattactttcattctggccttttaacatttctttgactgttttcttcttggctgtatctgaactttgggaaatgaacatctttaacacccactcatgaaatccccactctggcagctggtcctctggcttctggaagggccactagccagggaagtcagagggacccacaaatcagtacccaagacactacctaagggatattagtagtaattgctcaacctggacctaccgattaaaggacaatcatgagtttgtaagtagatgtcacagactctggaaatgtgtaaccaaaagccaaatcacctggtataaaatcaattttggacatggagaagtacttacccatgcttccctggagtgggcatcaggaggatctctcttgcagcctcgttgtggggcagcagctgggcaatgtaccttccagagggctgcaggtgcctgtgcaccgagacggccagtgtgcagtgctcactgctgctcctcatccacggactcaggatggtgtgcttggagtcagctgaggtgttgagaaggagaaaggagcctggaaagagacagggaaaacgaatctgcagatgtgttcaggtaagaccagcagtagctctgtggcaagacttagagacaaatggcatcaaaatcagagatactggaggccattatctccttctctgcatgcacccagccttcttcctccattcttagattttctttgtaaatagtatagcctgatgcaggtggacagtggctggagacataggccttataatcaggcagaccaaggttcgaaccttagctcccctacttcctacttctgtgtcctagagccttcgatttttcatctgcaaaacaggaataaaaacatctatttcaaaagactcttgttccttcccttactagttgaatgatctttggaaaagcattaactttcttaggtttcagtttcctcccttgtaaaatggggtgagagggttggctgaactcaataatctcttaatgttcatttcagctcttgagcctatgagtcatgtgaacttgcaactggtctccacagaaaaagccctacaaatctcccctgttgttgtgcccatggcagagtttccctctggagcaagccaatcttgattccagtagcacaggccaaatgacctgcgagaaacctacattcatggggattactgtcagtgtaaaagcacaccaccattatattgttccaggcattccttctgatacattaattttacttgctcacttctgctttgaagttttgggccattagatgctgctccttttgcagtagaaatctgtttcaacaagatccctgacttccacagtgggaagcagctaatgagtactcagtcttcttaaactactcctggcacttccaaggtctccttctgcagataacccagtttcccaaataggcaaataaactagcagcctgcaataaacaatggtgcagataaaagagggggattcctaccaaggcaaagcattactcaaaaggaaggtgttgttccaggaattggaggtttccaactttcttaaagtaagtaaaagcgacttctggttaaaatcaggatgaagcataagaccgtgtctgagctggatcgagaacgtgaaccctctgtacttgttgggaagcttcagcatggcatataagaaaagtgatctacaactgtcataaataatctacattatgacagtattttgcagcagaggaaatgttcttatcatgggcacagaggaaaagaaaagggattagaaccaaagacaaagaattgggaagatcatctaattcagtcctcttgctttcctagggaagcagactggagatccagatagggaaatgacttgtccaaagtcttagtttgaaagttaagaccatactccagatttctggacttctaagcagtactcttctccttgtttctttttcactggcccactgtgtacttcagcctaaaacatggccaaggtaacttgtggccaggatgtatagctttggaagtcagaggggcaggaaggggaatgagaggcacatggacaccagaccaaatccatttattcggtcccttccttactcctttctgccctcagattccatttaatggatgcctattttgagcaaacatccaagcactggctctgccctgaggacatagatgtgacagacacagttgtggccttcaaggaactccaggtctggcaggggtgcacagatgtctgcaagaactatcagcacaaatagaggtcataaagtcagacacacatccaggcaaaacatgttgggagccttcaggaaggaggagacaggaggtccaggtgggaagatccgtaaagaggaagacccttgagccaggtcttacagggagagaaaaacaaagatactggcagaatggactgtgcaaaagttgaagggaagaggagtcaggacaaaggtagatgatgtttggctgcagagtaggacactggagagaagactgagaaataaggagggccagggagataggaggtgtaaccagaccacagagagcattgcttcttggctgaagatttccagcttcattttgtggataatagagagccagatattttgagcaggtgagtggcaccatcagagtggtgcagcaggagaactgatctgttatggtgggggcaagagggaattaatattgacccaacctcatcttgcaccacaagtccacacaagggcaagaatgtgactaaatgcaaattcgaagtgtttgctatattactgttgtaagcaaaggcaatgtgttgagggtggatgactggggtttccagtactagggtagtgtgtatctgtgcagagcacgtgaggaccctggaagtatctctggggacagagtcttgctccagactctttgggggtatggcctggggttaggatgaagacagtcccatgtccaataataatttacacataagggagcagcagcaactgtgtcctggtctgagaccattctctgatgttctcaggttggcagaatgttgagtagaaaccaggagttttctgagctactgaagggaagaatgggggcaaaataaagaaagtatctccattcttctcaggaagattactgctatgcacatgtgcacatgcatgagaagctcaaaaatccagctgaaggtgttgaggtattggactaggggctctttctgtgtcactgctcctctccacccttgggtgtggccatgcatgtaaattctgtccccgaaatttggcacctcaataatggaaccctttcaaagctgactggaagatttttccagttctaatatgtgagatgatgtttatatgaatcttattttctgcaaccggactatcaataagcgactgagcttattttcactctcaatggaactctatagttgagagctatctcttcatcagcagctttcctctaccaaaaataagggaaaaaatacatttcataagctccttgggatattgtcagtataaatcttttaaagtcagtaagaatttatctctcctctctctctttttggtttctatttattttgctcaggatagcttggggctaggcaaagtctcctggggtcctttctaactaagaaggatggtctagcagcacacagaccttcacccagtgtggccatgggggtgtggagaggcagatcaaagagctctgctcatacagcgccacaaccatgtttcttttattatgcatcttgttgatatgtttaatgattaaatatgaaatgatttttatttttacctctggtcaccagtgtaggaatgtgctgctctcatctcaaccagcagggctcacattatgggccaaaacccaagggtcatgaacttagaggtcaaactcttttgtatctgttcagttattgaccttagacaaattatttaaacactttaaatattaatttgctcaaatttaatatgggcagagcctacctcatatggctgttgtgaagattaaattaaataacatgaatcaagtaggcagtactgtgcctgctcaaggtaggtatgtaataaaaatcagttccctgtgttgacaggtgtcttagtctggaattcctttgatctaggactaaacctggaatcagaaggactaaactggagtagctctgctactaccaaccttccttggtaaaatgaagtgttggatacagtctctctaaggattcttacagccccaaactgtcagtaattctatctgcctgcctagaatattattaatctaaagaaattgagtcaagtctccaagcccccaagtcctaaactcttcttctcataattcacctctctgagggttatataccaacagttttaatcgattggccaaatactccatgaactttcccgctaagatgtaaggaagtaagctgtggttccctgccctgccttcctctctcccgatttacacacatacatccctaggaagggctcctgtactagcatcatttgtttcttagatgcttctgctataaggctgctaccacctctaaatgtctggtatgcaacacaatgcttgccacatggtaggtactcaatgatcctaaaaatcaaattgatatgatggtaacatggtgatgtagtttggttgtgtttgttcctccaaatctcatgttcaaatatgattcccagtgttggaggtgaggcctggtgggaggtgactggatcatgggggcagatccctcatgaatggtttagctccatccccttggtatatgtgagttcttactcagttatgtgagatctggttatttaaaagagtctaggacctcccctcctttctctctcgctctcactctcaccatgtggcatgctggttccttgttgccttctgccatgattgcaagcttcctgaggccctcactagaaacagatgtcattgccatgcttccagtacagcctgcagaaccatgagccaattaaatctcttttctttataaattacccagccttaggtattcctttacagtgacacaagcatggactaatacagaaaattggcaccaatgagtggtgttttgctataaaaatacctgaaaatatagaagtaactttggaactgagtaacgggcaggggttggaggaatttgggcgggagaagctcacaagacaggaagacgagggaaagtttggaacttcttagagactaattaaatagttttgaccaaaatgctgatagaaatatggacagtgaagacaaagctaaggaagtatcaaatggaaataaaaaagttattgaaaactggaataaaggtaacctgtgttacacctcagcaaataattgggctgcattcatgttcatgccttagggatctgtggaaggttgaacttaagagtgataacttagggtatgtggcagaagaaatttctcagtagcagagtgttcatgagtggtctagctgcttctaacagtctatgatcagatatgggagcaaagaaatgacaaacttgaaacttatatttaaaaggaaagcagagcgtaagggtttggaaaatttgcagactactcaggtagtagaaaggaaaagaactttttcaggggaggaattcaagtggcctgtggagcaactcgctaagcgaatagcatgactaaaagggagccaagggctaatatccaagacaataaaaaaaagatcgcaagggcatttcaaaactatttgggacagcccctctgatcacaggctcagaggcctaagaggctaagaggcaagaatggtttcaggggccaggcccagggtgctgttgccctgctcagcctcatgacactgctccttacattctggctgtaccagctctagccatggctcaaaagggcccaggtacggctccagacaccactttggataacataagccatgcttccatgtggtattcagcctacagacacacagaatgcaagagtgaagaaggcttggcagctcccatctaaatgccataggaggcatgggcagaagtctaccactggggcagagccctggcaaagaaactctactaggtccatatcaagggaaaatgcggggttggagcctctacacagagtccccactggggcacttcctagtggagctgtgggaagggggctgctgccttctatatccaagaatggtagagacactggcagctagacactggcagcttgaagcctcagcatggaaaagctgcagacactcaactccaatctgtgggagcagccatggaggacgcacactgcaaagtcataggggtggagctgcctaaggccctgggagcctacccgttgcagcagcgtgccctggatgtgggacatggtgtcaaagaagattattttgaagctttaagatttaatgactgccctgctgtgttccacacttgtgtgatgcctattacccctttgttttggtcagtttctccactttggaacaagaatgtttacccaatgcctgtaccaccatcgtatcttagaagtaaattacttgttctgattttataggcacataggtgagtcccacatgaggctttggactgtggacatggaacatttgtgttaatattggaatgagttaatacttttgaggaactattgtgaaggcataatcatattttgaaatgtaaggacatgatatttggggggggcaggggtgaaataatatggtttggatgtgtttgtccctccaaatctcacgttgaaatgtgattcccaatgttggaggtggagtctggtgggaggtgattggatcatgggggcaaatccctcatgaatggtttaatacaacccccttggtgataagtgagttcttgctcagttagttatgtgagatctggttgtttaaaagagtctgggacctcctcattctctttcacttgctcttgctgtcactatgtgacatgctggctccttgttgccttctgtcatgattgtaagtttcctgaggccctcactcaggaaacagatgccattgccttgcttccagtacagcctgcagaaccatgagccaattacacctcttttctttataagttacccagactcaggtgttcctttacagtgacacaagcatgaactaatacacatgacaaggaatcaaatagtacagaattgcttataattttttttaaaacagcctctaacctctgctccacctgaccacattccacacactggaaaatttttttttaaggatttctaacttctttaggttgctgccttcataattctaaatattataatcatagttttccttgcaggtgtgacaactttagacatggataggacaataagaaaaataacaatatctctttcataattcttgatttttaaaatgttcttgattttaaaaattatcttctacaccttacgtttttaactttatgtgatatatttatgacttcttccaacagctccaggcagtatcacttgactcttctcactataaagatgaggctatttagtcttcctgccctttcctgtactttttctcttccacacccccctcccaaatcagctgtacttttcctttaccttgtcaagattgtgtaagaatgattaagtattttgtgttttgtttataggttgatgctaagtgtggaaaatcaataaacagatcttttatactgatggctatatatttctcactgcagtgaataagggttatatttataatcttctctatagatccaagaatgcattctactccaagcaggatatatttccagcatcaggatcaaatgaattctctctcttgcattgttacttgtcaaaattgtggcacattttaatttgtctcatatttgaaataagtcttggtatatgttatcagcaataattaagattattatgttaaattgtcgtgtgccacaaaaataaccaaatttcattgccagttgtgtctttaagtatagctatttctgtctttctttaatctacagacaattattgttttactttgattattctcaaaaaaaggtttgtaatcagctactgtccaaaatttgcttcctctttaaggtaattcattgaaaggactctgacaggttctcttgagcacagggtagatcatatcattcgactaggtaaaaaaagttcaagactctaattttaataatctgaagtgttcatgaaaattgccaacacaacatcaagtgggacaagaattaattacatgggactgaactaataaaggactaaaataatttctaatgacttctttttgtttgaaacattgttgattctttttatgctttattgtctaaagttaagaaaactttttcttttgagctacttagagcttacaacaacaactgggtaaagtatagttttgtgagcaaaattaaaacatttagttttttctttacctgatttctccagaattttgaaaagttgtgagtattcttaatttatggcaatatagttatttacgcaagttcagttagaatctgttttcttttgtaggacaaaatagtggatatagtagttaatagtggatatagtggttattggatatagtggttattttaccaaggccttgactgaaatggtatattttcaaatatgatcagactgctttgaggaatttagattggctttattgagctgataagaagccctttaaaaagtctgacctgatatcttttctacacagtttctttatagggttcctgacctgtggtaagtaaaagatgtcactttctgacaggcccagaaacctcaagatattttaagaccttgagaagggaaaaattcacccaatttgtacaggtattacagatatagataagtggcacatccttggcttggctttctagcctcgaggttttaaaaagtctaatcttagattccttgtaaaaaagttccaacaaagctaacttataagagcctctatgaccaatcaccgttcttgctatgctttatatgaataatcaggccaaatattatcaaactaatacttattttgcaaataagtttgtcataccattatttgtctttggtagaaataaaggactaaagagaagaattatgttttttttttttaaaaaaaaaaaaccctataggtttttctcctcataactctgttatgagattccagccttgtccattatttttgagtttttattattttctcacaatgtagactgaatcctgacttctttcttggctacaagtctccaaaaataacattttcaaattttcttccatttttctaacttgaaattattagaaattaaaactgtgcttttcttataaccctgcaaactaaagataggccacttaaataaccttcaagaaaaattaccacagcaaattatatataaacagccagtaatacatgaactcacaaagttcgtttaaacacccaattcaaactacaatccagaaatatgtgtcagattgtcactgaaatctgaagatgcttcagagactctaaaaaaaaagtagtttatagactattccagacattagccttttttccctgtttccatagaaataccttttatttatgatctgtttgcctgcatcatatatagagcctagcctacctgcaatgccacctcctggaatgggacacaactgtttaaccaaactgatctattctcaggactaaaagactgatttaaagagagatgggatggtatatttaaatgtattcttttctgcatatcccaatttgttttccactcttttgtctatctctaataatctctaacccaaacctctccaaagctatcaacttggcttttaatatgtgaaacattttttgttcgagacagagtcttgctctggagtgcagtggcaccatctcagttcactgtaacctctgccatgaaggttcaagcaattctcctgcctcagcctcctgagtaggtgggattacaggctcactaccacacccagctaatttttgtatttttactagagatggggtttcaccatgttgaacaggctggtcttgaactcctgacctcaagtgatccacctgccttagcttcccaaagtgctgggattacaggtgtgagccaccacacatggccaaacatgtgaaacttgttaaggcttcaaagtggggactgaaggaaataaaaatattttaccccaaactatatctatttgacatattttcaaatggctgcttggagagtcagaaaacaaaagtattcctgcaaagctgtcttttgtggggcagatttgcatctgtagaaaatctgcactgatgcaaccagctcttcccttgtccagagctaggaaaaattaacggagaggttgatacctttaaaagtctgaaaaatacatttattatttattctatttgaaagctgctaccgtgagatttcatctacataacaagaccaccattgctagccaagcctcctcttcccttcctcccataacctgtcttgcaactataacctgttttggccatactccaagtccccattctttttgtaacttcaagatggcaaataagcttctgcatcccactgaggggtgggttaatcactctgtgactttcctttgtgtgcacattaataaattggtgtgctttttctccaattaatctgccctttgtgggttaatttttccatgaaccttcagagggagggcaaagggaaagttttccctcggtccccacagaatcagtttttgttttgttttgttttttttcagtttgtctttccaggaatttctagctgatttttttctatttattttatatctgtcttctttaccatatcactaacacatccatatactccttgaaaaaattactcccttcgtcttgaagacactgatttcctcttttaatttgtatcagttgctttctgggcctacggtacagctattattctgaaatttcttttcactgggacttttatgttagtcccaccatcctcaggaaacttcttcagggggaaatttcttagtgaatcattgaatatttgaaatgtttatttcatctttacatttggttggtagcttttctggttatggtttgcagattagaaactttgcctcaaaaatttgaagacctagtttcagcgttttctagtgtcagtgttactaagaagaagtctaacgctggttttatttgtaatttctttgtaattgatctgtttttcctatttggaagcttttgggatctttctttaactttaaagttctaaaatttcaatacattgtatctaggtagggatctagataaaaattcatccgtggcattttgcaatgcatatagctacagatctgtacaaaaatttatccgtggcatttgctggcctctgtcaatcagaaaacacatgcctctttcatctctagcaaatcttgttttattatttctctgataatttaattaccccatgcttaatcttgaatctttcttaagagatttatctttcaagttagcttctgttagttatctgatttatctttgttttctctggggtcagctttttttatatatattgatctttctttttctcttttcttcttcttttaacagaagaaaaagcatataaatttatttatgtgcaaatgcatgggagccacacaaaatatgagacttgaaggaccagaggacagaagtttttatactatgcagaaatgaacagaggcttggagctcctggggagaggtggcagcagattatggaagggtgaggggaggaaacatatggcaagaaaaggctgtcttgctatgcatgatctttctttttcatgctgctggattattcacatgttgagtgatcattgatcagtccctcacatttaaacaggagagactagggaggctaacaggagctatatgtgtacagatggtgtttgtcctttatgcataatttgcctgatggacagtttcaggagcaagccattttgcaggtgactgcttcccagtgccagcccaaagggcacgtcaccctgagtatgaacactcccactagcagccataagtctatcactccacttgaagttttagaggctttttcctagccctatggttaagcatcctgctaccctctgctttgggaaaatgatattgaaaaaggaatgaaggccatctgggttaaccatagagaaatttccattcttcttctttaccttcatcctttctttcaggtgatcttttacctgcactctcagcagataggacacctcctctattctaaacctttttggcacattctgggctctggccactttgtttttccatggacagcttctgtctcctctatgtgctctagaaattgctcatgcctcccctcctgctctgtttgctattcagaatttgttcctccgttgatagttctctatttaatataacttcagtgggatcttaaaagaggagacaaatgttcaatccacttttctgaaccagaggcctcttaatcatattctctgagtgagaacataaatacacacatgcatggatggatggatttccatctcaatcaatcaaacaggatccaggcatcattggctaattgtccatagtacaataaactattaaatcattattatctgctattactctttcagttgatcacaatgccactcatgttaggtgggaactaaggaaaagcagaggtttaatgggttggaatctggacagaaggagtgcagtgtaatgcatgcaggcctcacccagatgcatgccccgagatatcagtgttggggaataatgctgtgccaactccagagtaccttccgcagaacaccagccccatggatgtcaacaggtattatgagaaggctctgtgggcgaatgagtctggggactcctgggtacaacaagaagtaaacaggctctttcactgaagacttctcagagccttgatatgccaataagagttgtggctcttcaagagtggaatataaaatgaaacatttcccaaactcctttgtgcacagaacccttttgttactgtgtataatgttctatggaacacactttggataccctcctctaatctatttctgctgcaaagaccgtttgcagaaaataggaaaggaagaaatcatggaaaaaaaggagaaacaacatatccttatccatatctatctatataaatatctatgtgtatgtctaatctatatctatatctgtatcatctctcaagtcttttctgcttgtctgactttcaaactgtcctttcataagacctcagctccttctggcagaatcacgctcctggaaacctcctctgagttactgcactggtctcgctacctgaggagacttaaaaatgctacattccatatctggctttcagaatgtcgtaactagacataaacatgattgtcacgtagcttaatcgcttgttgtactggggagaaaaccaagaagcaaagaagttcaggacttgcccaaggtcacacagcatattggtggtggatctgcaattagaagcaaggtttccagacttctgtccagtagaacactcactgggtatatgcctgtccatgatagaaatctacgaaggtgtttcagtcagatgccctgtggtttggtccccagatgcctgcagatgttcctttcacttttcagcactctcaccactctgtggatcaggcccagcagctggtctcaagctcttctttctgactgtccccagaggtcacagactaacgcatgggcaggtgggacccagacagtgggtcctccttttgaaatcactcacagggcttagatggcctcaccatggctgagcagtatttgagggtttcctttgttcatgtggtcttatgaattgttcaaagcaaactggggccactgaaagaggctccttattgtttatttttcaaacttgaattctactatcctgtgtagcctcaactcatgttttagttgttagagcagaattttgacatttagaataaagaggaggtgggaccgtgctcattggcatgctttgcctaatattgagataatggaaagacagaacttcaaagctctagaggctcttggaaatcatttggtccaacctgttcaccttgcagctgaggaaacagtccagtgggtgaagggctatgcctggcttccatagcagagctgagccatgtgggcactcagtccctgtgcacttttactgtctccctctgtctcgatgtcaaatatttggaattagctctgttactctccaccaccaggacttacatgtattgcttttctgcaccttcattcggaagcactttgaagagaaatggtattcgtttttgagactgaatcattagaaaaaccaagtgtgttcattaagagagagaaggggagtagagggagttgatttttcttgatagtattattaatcttaagataatgagttagttgtagcctagaagtagtagtacaatttgcacaattaggagcctctgcaaactgaaaaggcaaaacaacctttcgggtcctacttaactgaggcagaagttccctagaaataatatatatttatgctcatgtgtgtgtgtagtaaaatacgcgtatgtgtgtgtgcgtatatacgtgtacatcaatagatggatacacataaacatacacatatgtacggatgtatatgtatgtctatgtgtggaggagtacgtttttatatattcccttttagatctctgaccctgttaaaatctgaccctgttagatctcacctcatttttaggtgagacacaaaggtggtttttttcttttacatcaatggatttcatttagaaaaaaggggcagagccaataatctctacatactgcatgcgtgccctggggtgtcagcaaaaaaagataataaaaggcaaagcaaataaatagaaagaaacagaagacaaagtgctgagaaatcctttttccctaagagctcattttggtaatcctcaaggaaaatagaaaagcacttgatctgactagaaggagaaaggggaacaaaatgaaaactaaagaattgatttaattcaatgagaaacaggaggaaggagagataaaagcacctgctggaggaggaggacggaagggagggagctgggcgaccagggtgccttcagtggaacaaaacccactagagagagagagaagcacaaagtcaggttttccctttcccacgtgggttttttagctctggaatcggattgttcaatttttgctttaagtcccagatgtcaagggataaacatcttctatgttacttttaaaatttttgctaagaggtagcggcttttattgctttctctgggcattccattgatttttttaattaaatattttaaaaagcaattttttgcccatttccttgcaggagtctcataaaatctcaaccttattataacaagttctgatgttccatctactgtggttctcagatacccgctgctgaagaaggagcatggaacgtgggtggatgttaataaccaagccatgcagctgagaagcaaagggaagctgagaatgcatcactgtttgtcacctgctgccactctgggagagctgcatggagcacccatgggcctctcacccattcctcttcatttttcggaagagtcaatgcacatgcaggaagctgaggtatctgcatggcaagatggctaggctgagttctcaaaggttctagaatgttctaggcttctaacagatcttttcacttcaggtctaaacttcctcctcatacattctacacacagaagtcagaaccatcttcttacatttaatttaggttatccttcccttcttttaaactcttcaattccttctcactgaatacagattaaaacagaaattccataatacggggccaggcgaggtggctcatgcctgtaatcccagcattttgggaggccgaggtgggcagattgcctcagctcaggagttcgagatcagcctgggcaacatggtgaaaccccatctctactaaaatacaaaagattagccgggcatggtggcgtgcgcctgtagtcctaggtactcaggaggctgaggcaggagaatcgcttgaaccagggaggcggaggttgcagtgagcagagatcgtgccactgcactctagcctgggcaacagagtgagactctgtctcaaacaaaaacaaaaacaaattccataatatgatctataagaaaggccagaggggaactgaactgcggtggatttcataggctggctcactcaggtccccaaccaacttccttctctcttgcctccttcttttattgagactggaagtttaaaaaaaagacttgatttaaccaggcttccttgcagataggaacagccatgtgacacagttctggtggtgaaatgtgagcagaattatgctcgtatggttgccaggttcagcaaataaacatatagaacacccagttcaatgtgcatttcacattaataacgaacaattttattagtgaaaatatatcttaaatatcgcatgagacatgcttatgctaaaaaacaattttgttgttcatctgaaactcacatttaactggacatcctgtgttttatctggcagccctctggtgcggggaactgtggggaaagtttcccctttctgcttctttcttctttttcttgcctagaatatgaacataatgcctggaggtgtggcagctgtcttgtaaccagggattgacaacatgggatgtggactagtaaagtaataagagttaagtcacagccgagcgcggtggctcacgcctgtaatcccagcactttgggaggccaaggcagacggatcacgaggtcaggagactgggaccgtcctggctaacacggtgaaaccctgtctctactaaaaatacaaaaacttagccgggcgtggtggcgtgcacctgtaatcccagctactccggaggttgaggcaggagaatcgcttgaacccggaaggtggaagttgcagtgagccaagatcatgccactgcactccagcatgggcgacagagcaagactcggtctcaaaaaaaaaaaaaagagttaagtcactaatggtgtcattggatatctatgccagtgctgaactgcctgtctccgctcttcttgtgggaaacacacagcaaaacacccaagatccttatctggctaagtcatcgcagcgaaggcttctgttgttttggagctgaacttctataagcacagggatcccgcctgtcttgggccggggctcactagtacctggtgcaatgccaagtacagtgtttcttcaataaacatttgctgaatgaataaattaataatatttaacaaaaaagtgggcaactcacttattttcttatatcttatctaaagcagtgtcatatttcttatttaccttgggggggatgtttttcctttttgaacattatgacgagtggctacagagggttactctttgcaacataaaacaaatcaatttttaaaatgccttgaagtttggactcttaagatcagtgtttctcaacttgtggtttgtaacccattaatgggccatgaaatcaatttagtgggtcatgaccagcactaaacagagaggaggagaaggaggaggaggagaagaccagcaggaggaagaagcagaattaatttataaaatatcctcattgtaactctcttttgggaaataacagtggctgctgatctacaggtacacacacacacacacacacacacgcacacacacacggacacacacatgcacaggtgtatgtgtctttcattgtgatgtgaaatatatttcttactgtgaatcacagttttaaaaagattgaaagccaggttcaagatgagtagtgttcaaatttcaaatgtccatatgtggaaatcacattggcctgattcttgttcctgagccacctctcattagttgggtgaccttggaggagaagtaatttatttggacagcgttttatgatttgtaaaactctctcatgcaatcttagaacaacccagtgaaatagatgctatccccagttgtagttgtgtgtctaataatggcagccaatagccacatgtggtttttgagtatttgaaatgtggctgacgtgactgaagaactgaatttattttatttaattttaattaatttaagtttaagtactgaaacttaattcagttattggaaaaatatgtttggaacaacttgggtatgtgaatatgattttccaagaataaattttataaaatacatctcaagtatttcagatgaaaatttagtctctaaactgaaatggctatcagtataaaatgcatactggatttcaaagatttagtacagaagacatacaatgttttattaataatttttatattgagtacaagtcaaaatgaaaatattggatctcttgggttaaatgtttattaaaatgaagttctttttacttcttatgatgtggtttctagaaaatccaaaaggacatttttggctcatattgtatttctattagcactactttaaggattaagtatcttgccctaagcccctggataaaaaagtgcttcaattactattacaattcaggtccctttacaaatctatggctcttcccgctaaactaggacaagtcacatctccctaggccttgctgttcttatctttaacaacagcaagtaaactagtgtatgacgataataataataatggctaatgcttatccagtgcctattagtcccgagcaatatgttaacattttgcaaggtttactgcattttaatttgcaacaaccctgtaaggtagttatatgattattaaacctactttttagttgagaaaactgagactcggagatatcaattaacttgcctatcagctcaagatggtgtagactgaggggcccagagcccaggagctccatgaagatgactagacagctagagcctttccctggaccttggcctttatgaaagcagctggactctgtttgagagatggtatattgcttttatttctagagtctttttagattcatttcctttgagaaataatggctgtctgatcttgttgctgattccaacactatatggcagaaatctccaatctctacagtttttgaatacatagataaggctgaagaaggtgactttgtatctgaaaattttcaaccagaaaattgaaatttgggctttgttatcatgggtgcttatttaaagttctacttgcaatgtcagactacatctcaatgaaagctttcaaatatagggacaaataatactttcccaggaaaattatttttcctttgttatcaatcttgtttatgtgcattaaatataatttagaaaagaaatggtaagaaaaaatttatctgtagtcctaccaattaaccattccattttggttttttatttcaccacctgcataggattttaaaaatttaaaatatttttttctcttattctttcacttaacattgtcgtaagcatcctctatgtttttatgtaggacttgcaaacatatttataaatatttgtgtaatagtccaataactggacatcacatttaatctgttgttttaaacaattaggttgtttccagtttcttgctattgataaagttgttctcctgcttctgtgaatatcatactctttctggaagatagtccaccaaaatatgtacagtttaaaaaccttaaactgtgcatattcttttacccaataatttcctttctaggaattgctttaaagaaatggagttatttctaaagacatgtttgcaaagtttcccagcattatttacgggagtaaatatttagaaatggtaaatgttcaatacataagattagttatgtaaagtatggtgtatccacataataaagtacttcatggagtcattaaaattattctctggaagaataggtgaggatttttaaatattaataacaatagctttcttttactgagtaccagacactgtgcttatatatatatttaggatataatttaatcctgaactatgcatgtgcttggtattattattactgtctctttcacacagatgaagaaacaaatttagagggttaggtgacctcccatagccacaaagctgataactgagtaagcaatagaactaagacaaaaaaaccctggtggtttttctccaggacttacatccttaaccaccatgctgtataaacaactaggaagttcataagctctcattagaagagagaggcagttataaaacagcatggatagtgtgacctcagtctagcaaaatctaataaatatatgactctacacacagaacaacttgagaaaattcaccaaaatgtaaaatgggtaactctggaggttagaatatttttctttacactttcttgaattttccaaaacacctgctacttaaaaaaaaatactgtttacagtgataagatatacacagcacaaaatgtaccattttaaccatttttcagtataccattcagtggcattatgtacattcccaatgttgtgcaactatcatcacaacccaattttagatattttcaccatcccaaacaaaacctctgtactcacttaacaataactttccattaatccctcccctcagcacctggtaacctctattctactttctgtctctgtgaattggcctattctagataccttgtaaaattggagtcaaatgatgtttgccctttcaggtctggtttatttcatttaacacaatgttttcaagttcatctatttcacagcatgtatctgaatttccttcctttttaaggtcatggtatgtgtataccacatttcgtttatccattcatctgctgatggacatttgggttatttctatcttttgactaatgtaaatgatattgccatgaatgttggtgtacaagtatgtttgagtctctgttttgaatttttgggggtgtatatgcaggaatggaattgctgggtcatgtgatacttctatgtctaaccctgtgaggagccaccagactgttttccatggcaactacaccactttacattcccacgagcaatacacaaagattctaatttctctccatacatcctcaccaatatttgttgtattactttaaaaaaataatagacaaactaatggatgcgaagtggtatcccatggttgatttgatatgcatttccctaatgactaatgatgttgagcatatttttatgtgcttattggtcatttgcatatcttccctggagaaatgtctactcaagtcccttgcccattttttagttgggttgtttgcttttatctgtcacttcttgaattagaaaaacaaaccacagtgacttttgtgcagaattttaaaaagtaaacatcggattgtatccattccctgcttccgtatctcaatctgcctctgggataaaaagttcacactaccagagcatgggctgcctgggctccctctccagcctcccatcctgcctgtccacctcacacttgcttctgaagctgttctcaatgcccccacagttcttgtagacaccatgccttcatccatgctgtgccatatgctgagaaagcctcctcatcttctcttcctgttatttcccttctttattcagcgaaattctaatcatccttccagattcagctcaggatcatttcaaataaaactcttgctatggtgtaaatgtgtctcttccaaaactcatgttgaaactttatttccattgtggtggtattaagagaggccattttgggaagcgatttagtcatgagggctccaccctcatgaatgaattagtgccttgtaaaaaggctggagggaactagcttagcctcctttttcccttagccccttctgacatctgaagacacaacagcaaggcaccatcttgaagcagagagcagccctcaccagacactaacggtctcagtgccttgatgttgaactttgcagcttccagaactgcgagaaataaaatttcaattgtttataaaccattcagtctcaggtattttgttgtagcagcacaaatcgactaagataccttccaaactctttggctttactcctgcatttgccacatgtgtgaatgcttctgacatttacctcctaataatggagttacctgtgtctgtctctctcatgaaacatgctcactccttgacagcaggggtgggtttttgtcatttgcatacactcaatgcctagcgcatagaaaaagctcaatattgcctaatagaactgaactcttgatttatattagctaattgcttaccgatgaggctttatattttgtctatcagtaatgcacggcagtacctgtttcattgcacccctgtctgaactgggaattatatttgttgtttcaatttgcatgtctttaattactagtgaggttgagtcatttccccatatgttctttaattagttgcttctcatcttttgtgaattgtctgttttttttgttcagttatctattggaggcttagtgttttccttgttgatttgtaagaacttcttaaaactaggctcttaattaaccctttatctattatatttgctaaaagaaattattccatgtgtcctttgccatttagttttgtttttaatgtaaacaatttggacaattttatgctatcaaatcttatatatgaagtttactgatttgcctttttatatttatgaacttgagtgtctgtaatagctttccatagtattactttcattaatatgtgacaaaaatagtcactgtaaaggtataccttgctttatggatctttggctggaaattttaagcataattatattcatagatatcattaagtggggggaaaaagggaaaacctttgtaaagagtcactaactttgtgttgtaaattgagctttctttaggacttccttagctattagagctagagagagaaaaaagccctaaattttaagtgagatctaaattgcaaaacaatagcaaggctgggagaagaagatttagaaaagagcttgcaaattgtcagcctttcagagcacattgattgttcttggatgggttttcatttggccaaaggcttggtctgcactgacttttagatttggattggtcttcaatgcttaaaagtcaggaaacagtaaccacttgaatatctggagctgttctggatttggaaaagggaaggaagatctggcaatgttgggcctattgtttcttttttggtggcaataaatggctggatttgaatacctgctactgtcagaggtgtttgaaccagagcaactccatcttgaatagggtctgggtaaaatgaggctgagacctactgggctgcattcccagacagttcaggcattctatgccacaggatgagataggaggtcagtacaagatacaggtcataaagaccttgctgataaaacaggtttcatttcagtaaagaagccagcccaaccccaccaaaaccaagatggtgacgagagtggcctctggccatcctcactgctatactcccaccagcaccatgacagtttacaaatgccagggcaacatcaggaagttaccctatattgtctaaaaaggggaagcatgaataatctaccccttgtttagcatatcatcaagaaataaccttaaaaaagggcaacagcagccctcagggctgctctgtctatggagtaaccattcttttattcttctactttcttaataaacttgctttcactttactctatggactcaccctgaattcttcttgtatgagatctgagaaccctctcttgggttctgcatggggacccctttcctgtaacactaccccctcagatggccatgtctctccaattccccatagtccccacaatttcctaatgtccccctcactgaggctgagggtcagtggccatttatcatcttaccattggcccacttcactcatttactttacctgctaggctgctgtgggcatttgagttttttttgaggacctcaggctgggctgctgaaatttactgggtaatctccccagtcatggaaatatggggattaaatttaaatctagttctgactgtttaattgggaacagtcaatctgtgagtatttgctctgtccatttctgtaagtggaaattgatgtctgttctctccacccctgccctccacctttctctccttccccttcccttggtttggatttaatgaatatgatttatattgacttcaattcataaattctgtaacaaaagcccaactgaagaagcagatagtgaaatgacctcaattgaacgagcctgaagatacagctggtatcttgcatcttacatcctaatggctgcaggtagtgatggtaaataaataggggcagactcccaatttctttggaaagcagaaatgcttgaactttgaaaatcagaagagaaaacagagtgaaaaaaatggtcagttgtttaggactaaagaaaaggaaaaagataactgttaaatatttataaacatgacttagacaaaaattttggttgtggtagaaaaaatgtctttcagactgttaaaagtataatcttgtgtagaaagaaacaatctaaaatgccaggctcaaggatccgaacattcaagaggctggatttgaaatcctgagcatctgtatgccccctcagtgaggagatggtcaaaatgcaccccaagccaaacctggcatcaggaatttgtacctgtgatagcccaactagtatctgcagagcctatctgggagatgccgcagcctagggggttatttccccactgttcagagctctgaccacctatgccaagtcctggctctgccattacttgctgtgtgatcttactgtaggacaaggcatgtagcgtttctaaagtgtctatgaaatagggacagtgacaggactctcttgtagaactatggagaagtctcacggaggaaacccatgtaaaatgcttagcacactgtgtggcattcagcaagggttcaagaactgttcactcctgttattattgtcatcacagtccttactattgcaaacaagactgtcttgaggatttgtgttactgtcaagacaactttcaatgacgagggatacaagaaatgtagcaagaatcaattctcaaggttgtagtctctatataaggacttgaatggtggcaggtaaggcagggcaaatagaaaggtggccactgtgatttcatgaattcactctcatttaaatacagaagctattatcaagaagccttagggttttgctattgattttagtggggcctgtgagaaccatccaggtttcatttaaatgtggaagtgacatttagcttagggttttctgatcaatattctacctgcacaggtatatactgatgacattttctaggtttctcaaggcttattactagccctcaagggccatgaggtagcctccatttggtgtttataagcttacactattcagtctgtgtcataagctgtaaatatttctcctccagacaatttgtagtaaattatatttccaaattttgatttttctccttttattaataatactaacttgtgaaatcaaaaatatctctacaaatactttagcttcattatcagactcttttctacaatgtttcttaaagaaagtggtctgtctatgcatagaaacatttgtcacacaaatgtgtaataaaaccacatatattttgttctctagtactgtgtaggttctgaacaggcagatgttcactgactgactgatagatgaaaaaagcaaatgcaacaatttttaatggaaaaaataaaagaataagggaactaagcatcactctgaaattgagaccttgctctaaattctgttcttaagcagcctggagcagataatcaagtagcacatttagaaacactaaggcatattgaaagtgcttgattctcaggaaccaaatggtcatgagaaatgtatttccaacctagccaagaatgctgatactctcttagagaacgatttctgaaataattccagccagattctcagggctcagggctcagagctcactgatctcagatcctgggtcttttggcaagagatatgaaggttgccacactgggcataaatagcagaggtaggtcagtatcctttattttgaccttttaactaacaaatgggcatgagacaaaacttcacaccaagggtcctacatgaatgcattctctttcattggaaacacccattgataggtcaagaaatagactgtaagtacctccaagatatagcaatatattagtggggtgggggatgtataaagtggtatatataccctcctagtcctcagggaatatataatatagtgtgaaaacaagcaagaacaaaacaaaaggtatacataggtcctaagtgccacataatagtaataatggagattgagattttagggtgtgggttagggtggacatttgcatgtatctagtctcccgtcctctccctccaagttgactccagagagtctaagcttatactcatgcgctctttcgaagccctggcaaaggagtcctctagactgagagcccttaaatcctctattgagatgaaaggctgtctctttcctcctccaggtctggccagtgatgtctacactgcattccttgtttgattccttttgctttaaaaactcttctggtttctggaagactgacaccaactaaatcttctgtaaaaagtcctcccttctttctggcatctctacatactacaggattgtcctcaatcaagagctgatctttccttcatttgcaaacatacttgtttgtttatggcatgtgctataacacttgagattactcacagagacagaaaactttagacctggccagtactgttagaattggattaggctttctggtttcatgctgatatattcctgcttatctcagggttaggccttggcccagtgacttcattgcctctccttggagctttgtggctttttgttttgcctatagaatgaagtccaaactctttagcctggcccaacattatctttacagctccctgctttctgaccctttggtttactctgtggcccacctcccaacccacaagactggtcactgctacctgaggacgacattcttcttaaggccaccaagcctttgcacacacccctccctaccctctctgcccttcttcccctgctctaccttggaatctgctcacccttcaaggtccatttaagggtcacctcctctgggatgacttttccaacttcctcaagcagagttggccttattcccctttcctgtagccaaatctttgggtgcaatattttctaaaacttagtgcgttattatgaccgtatgcctgtgtttccagctatccatgttctttctccccaaggcatgaactaccatttgttcattcagcattcattcattctctgcaccatttattccagttctggcatacggtggacacccataaatgactcctgaattgaactgaaagggactataggggtttagaaatgtgaaataatctatcaattattttaagaagtcaaatatgaaaatttaagagggtagactataattttctgtccatatacactcctataaacatgcacaggtgggcaagttatctttctagtcaatatgcatccagtacctaacataccttgaagggttcagacagaagaaccttgaagggttcagacaagtctacccagatctgagggcaaaaagtgtttctggaagtgctggatggacttttgcttatctgcctgaaatggtacagagagcccccaactgagctttaacggcctttccaggaatctgtatattgaagggaatccatctgatggccttaggaccctcactctgtaggtggttttggggactcagaattacatccaagtctgtttattagaaatttagagagccaagagaccaagcatcttgggatctgagtaggactgattaaataggtaggagaagcagccccaaacgtctgcccagcagaggcgtatgggctgaattctgcatcactgacaaataatagagaactccagaattatgacacagtttttaatatgttcagctttctaatcttccttgtctctccacattcttaatatttgccatcaactcttaatgaggttctatatcttcattttggggggtatatttctgttaatttatcaccttcaatcccatgagaaatgtgtttcaagaagacatggatgaattattgtaaagcatatttatttagcacaatctaattattgcaacattctgtaaaggcaaatgaataaatcataaatgaagagtaatgagggtggagctgctgtgcctgtgttcatgatgtgtgtgggtcacaggggagcatgtacgtgtgtgtgtgtgtgtgtgtgtgtgtgtgtgtgtattagttcacacattatcctgacttggcttgggattctagataagatatctgggcagaaacactttcacttgctctgtgccatagtgacctcagccccacatggctattaaacatttaaaatgtggctagtcttaatatgaatgtattagaagtataatatacacaccagattttgaagccttgggttttttaaaaagatatataaaatatttcattatttggaaagcagttttgaagtttcctaaaatattaagcatgtggttaacatatatctagcaattccattcttagacagctacccaagtgcaatgaaaacatatgtctacataaagatttgtacatgactgtccatagcagctttatcagtacgtaatagccaaagagtggaaataactcaaatgttcagtaactggtgaatggataaacaatggtggtatatccatgcaatggaatattattcaacaatctaaaggaaccaaggactgatacatgatacaatatatatgaaggccaaaaacactaggctaaatgaaagaagctagacacaaaagaccatgtattttattattgtctttacagctgtagagacaagaaatagattaagggttgcctggggcttgggatgggaattgagaatgactgcaaatgagccgaaggcctttttttggggtgataaaaaatgttttaaaattagattgtggtgacagttgcacaactctgtaattttctttcttttcttttctcttctccttcttttcttccttccttctttctttttttctttttttggcaggatcttgctctgttgcccaggctggagtgcagtggcataatttcggctcactgcagccttgaccttccagattcaaactatcctcccacctcagcccgttgagtagctgggactacaggtgtacactaccatgcctggctaattttggtattttttatagagactgggttttggcatgttgcccaggctggtctcgaactcctggactcaagtgatccacctaacttggcctcccaaaatgctgggattacaagcatgagccacggcacccggcccaactctgtaaaatttactaaaaattattgattttttttttttacctaaaacaagtaaattttatagtatacaaattgtacctgaaatgtcattaatatgtaataaatttaaatgtgattttagtctaatattattctcattaatatgtaataattcttaatgtaattttaatgtagtaagttttaaattgtttacatgttgaaataatattttggctatattgagttaaataaaatgtattattaaaattaattttacttatttacttttacttttttaagtggctactagacaattttgaattaagtatgtagctcgcattatatttctattgggcagcacagctttagatgatcccacgatagctgttaaacaatccccatgcctccattccattccagagattgtgcttcctctcttcttggctcacaaccagccccatatggaaactgagtgcttgcatcatccagaagatgctaaaaaagggggaagttgcccagtttgtagctgtttaggcccctggctatacaacagtagcccggtgattggaggaggggtgttgggctgggcgtggaggaagctgctggccttttgcaagctgagggacaggagcacaagagaataccaagttcactgtcaatggcacatccatcgcgtctgaaaatggagcatgttcactgtccatccaaatgttcatataaccttcacatgtgttcataaatgttcatatacccttcaaagccagtgatctgtgctaaaataatgtaagcatggaagctactaaaaccatctaggaggatctaagcttaaatgctactaatttgagacaaaactgttttatttttaaaaatatcatacgatatgtttagaggagcgaggttgttatcacattctctttttgtctgaagcagttgttcccaaccctggctccccatgaaaatgaccggggccgggcatggggggtagtggtggtggttaaagcatgtggatgcctcagtcccacccctagatatattgatttaactattctggggtggggtctaagtagtgatgtttcaaaaggttttcaacagatactactgagaatcactgacccagggccttgctcagcaaggacttctagtgaactttggattaatagagagaggaggatggacaaggatgagccatcaaatccagcaggccaagcaaagtttataaccaatccccttcccaactaggtccagcatcccctttgctcttctaggcagacagccagtttctgctggacaaccatgggtgggtgccgtctgtggcttacgagacagcttctctgtgttggatgagctttaattgttagacatgtctttcccagtctaaactcaaccctgctgctctctaatgtccatttatgggtcctagtcctgccatctggacaaagactgattcagtctagccccttttcacatgagagtccttccactatttgaacacaattaccaggacttctctactcttttctacactatacatcccatttccttgatctgttcactgcatggcctcctttccaggcctgtaaccatctctcagctctagtttatcagttttctctctaagctgggaaacttccaaatgctcaccctccagatggtgtctgcccagggccagtacagcaggacaattacattccttgataaggccattacactcctagtaatgaaccaccacactgcattggctcaatagcagaacaattggaaagaagagagtgaagaagggggaaaaaaaatctgaaacttctcatccataaaccttttacatttgagtatgacacttcacaaaatactcatccagtgaatgtggacccaatttactggaatgcaaagactgtctacagagaaggaattctcattattacaacttatttcttaagtattagccttctgtcaagtgctccagtgaccaaagtttggggatgctggcaaaatgacaatactcaacagagggcttaacagattcgaaaggattgggtctatcttaagtagggtaccttctatttggggaaatgatttgtttcccaaaggtaagctaagatcaaatgcaaatcacatctcctgcatggagaggccatttaaactccaggctgtgaattgaagctgctccttatgtggctttactcacaaaaacatggtctcccaaagaggaggggctatgctggactcctctctgctggcgcagagcccagactgtggtaggatatatttgcttcttaggcagcctaactatccacatctctgtccaaagataattcatttcaaattcaatgtaggtatattgaatactcataatctgtgctagatacctgggtagggtgtctttacatatggttttgttttaaatttgttgcagcagggtttacttggattacagaacgggaacacctagcgctattcagaaaggatcactagattccacggggtggagagtctatataggaattgggagaggagcagggaagtaccagaaaaactcaggaatatcttcctgcctgattttgagaatattaataaaaaagaagcattttcaaaacctagcacatgcccttccacagtgaccttgctcatgtgggtcatggccttcacctgagatcagccaaattctgtagacagacatggcagaggctgaaagagatatcaaagggatggagaggaatttatggttttgtaacatacaaaccaagaggctctttctgatgtgggtataacagtgaaaaggaggcctaacatggctaactccatgttgctcctgacccccaactctcaccatctgcgatgatatcttttaggttaactgttcttgcttatctctgcacataggccaaatgaactatggggggagttaagtttatagtttaactctaagacaaggatgagaatagtcccttcctaaaactagccctcaaagagataaggagcatacacacaagtaataatgtttttctaatgatttacagaagcactgtggcctgaccaagggcaaagaagttatgcaacccttttagactcctgctgatgcccaaacatttgtggtcacctgccacctcctaacctcagccgcctcctttttcccccttcccaatataaaaagaagcttgagatttatgccctttaaggtggttctttaggacattagcccaccatcttctcagattgctggctccctgaaatattatggggacatcttccataatggggcatcttccttgccccaacaccttgtctcttgacttactggctgtcgtgcggtgagtggtgcgagctttggactcagctacatgggaagctaccttctcccaactccctgggataatacttggcaccccatgaacaaacaattctaacttggactctcaaaggccaatctcaaggggtgacaggtgcttcttcttacccaactatcctaactatcaaaatcaaaacaaaatcaaataatcagaaaaacagacactgtcaaatggatcttccaataaaaatgagtgaacatagaatattcaaccctgtgccttgcataaaggatccctaccaccacccccaccgccacccttgtaagagaagactctcttcctagctattttgagaccttgtggcaaaacgccatctcctagaagatttcctgtcgctactgttgtcattctgaggagctgcctcacactggactggtcaacctgccctctcatccactcctcttctttctccatttccctcttaaaaatagaaatgataaaaggcactcatatttgcagagtcttggaatagcataactcagagaaaccactgaggtcattatgcgtgaggaattgcaggcctcaggaagggagggggtatctcaggttccactcagaggtggagggaggctgagccactcttgtcatctttccgttgttgctttatttttagtgtgtttgtgtggccacaacttggttcctgcatggttattttctagggttcaatctgagaggacccctgtgttctcttgctttattacagagagactgggaacccaggcttgcaggccagttataaccagggcattcactagaatacccttaggggtaacagcacagcaagtgacttgaggtagctttcagaaaaaagcagaacaaaaaataatatcgacaataaccacagcttccatttgccaattgcctactctgtacagacacggagctggagaagggactaatgtacaactctaggtgacaacgtgatatggtgccctttggggtcatgaagtgacattgccctctgtggcagaagatttactatattctcacttaacccttccataaatgctaggaaagattactgtgccaatttttgcaaatgacaaaactgaagcaaagaagatctaagagcaaggacataaagaccctaactggtggaactgagatttgaactcgggtcttccggcgttagcttcctactggtgagcacggaagggcaggaagatggatacatatacatcccaagaccctgcttagtgtttagcaagcccaaaggaagctcacagttattgaggggaggccggtggaaaggaaaggggaacagaggagtgctagaaaccaggtatcaagcaggtggattatggaaaagcaatctcagatagccacagcagcagagaataacaacagcagagcctaaacaaacaagaagagcccttgggatccactttttcatgaggttcttcagtggagcactcctgaggtagtggccaagctctcctaatcaccagccaccacgttgccctgggcaaggcttgtcacaaagaagagcagggccacagacaaaggcagccagcctcacctcgcctcagcacactgcacagcagccatctaatagcaccctgcaaaactgacagattgttcctctcaacataaactctgcttcactcctaaaaggattttattacctctcgcataggagtttgatattggcgagattaaattaacacagttaaaaaagggaggaaagaaaaagaagagaaaagaaagagaaaccctatgggcaggtgaggggactgctattagcactcagagctttgtgggacagcacctgtcagctcttacttcttcgagtgactctcccagtgtgtcaagctgtggaaggtctccaggagatgctccgtatgagaggttaaggctggttgagtgacaaacttacagggacaaaagccgggacaggatgccatgtgaagtttggagccagggccacccacccagggtcaccctgcctggatcactttatgagcggtccaatttatttctgcatgttcgcgagggccattcaccatggccaaatcctagttagtcattaaagaggtccacatgatttgattggccacaacaggcttagtctaggcatcttgggtttacaccgagtttgccagaacttccaggaggggctgctagcctgcctcattttatttaagatgctaacaatagtagcaacatcaatttgctgcaccccaaaacaagaaataagaagctctgcatatactgattcgggtctgcatggaactttgatgatagttgggagtagggtatcccaagtacactcatgtgttgttaagaagtgaactctagacagtcaaaggaaccaaggcaagaatgtgggagaacaaattgtcacatacatggccggtaggaacatacattggttggagatttctggaggaaaatttggcaaaaaccttgagatttggcaaaaatcctagcctcagcaattaaaacccaaatttagtggaaatgattatggaagtgaataaaaatgtattttccaaaatattataggaaatattgattgtaatggcaaaagataattggaaacagcttaaaaaggagaatagttaaatgaactaattcatgcatataatgagaatgggagataaggttgaaggaaagtaattaatgacctgggagatgatcatcatatatatctacataataaataaagccacaaaacagaatgcaatatgatatataaaccatgtatgtaaatatatacaaagaaaaaaaactgaaagaataagcatcaaaacattaaatgtagaaatctttaagtcataagctatgagtaattttctgtttatcttcattttcttaattttctacaatgaatatgttagttttgtcaacttaaattatataattgattttttatttttttatgttttaagattcaaggaactctggggtggtgctctatgtaaatgaagaagtcacagtgcaggagggatctttaagaaaagccagctgttctcaacaaccaaaggcaacacagaccaggtaacaccttttggttgtcttactgggcgtcagcattcttgcagcatttaggatttgatagatactccatccttgttgacagattattaatgtcttctagaaagagtaagatcatatgactaggccccagaaatactggcctttccaagagccaagaagcagcttctgccagtgttttccatctcattccagtcgctcataaatgggcaggggtcaagtccatattctccacatccccagacctgtcctgtgcttggcacttagtacgtattcaagtattctcttgaattgacacagcttttgtctactctctgtttctagcaggggtaatatttggaagactcttgccttcagacaggaggttcacaatcacacaatatcattaacttattgcttcacctgaaaaagttttataaactttgcatgcttgctccttttggggtatcattgcacagactccccgaaaccattcccaaggtgcgtctggccacgtttccactctccaagagaagaaaaaaaataaagcaattatctggacagttcaggtaaaatgtaagctttcttctgaactccctttctagtctaaatcccattccgtttctaagaaagcattttcctgattcattctgctatattttctcaattccaagtttagtttcagagaaagctcagcctattagcgttaaatactaggcttggggatgtgtgtaccttgtgccatctcttggaggaatattttaccatgaaaaatggactttaataacagaacattgagagaaatgacacagagatgatttaccagcgtatatactgagatatattaaattgcagacagtttgggtgagactctgagccttaaatgaaacatccaatatctgtaccagcacacagcaaaagtgactgcagaaaagcaaaaacacagagacatccatatgtcactgggagcagcagggcccccgccctcttcagaaatggctctgcagtgggtttctgcctggctgcggagcactgaactgaaaaagtggttaattaatgaaaaacttaaaattcaagcaatgaaattaccttttgcagtgactgacaaaggcactataaataattcaatctctctcacagttgattgaacagagtgcctttcctcttttgacaacggcatagtgacattttttctttccattgccacattctgtagtggctacaacaagtgtcactgccgaaatctagctagggaactgacaaggggcagtgaaaacctaattgagagccggctgcagtcaggaattcaaatgtctagtgtgctttcaggtgggtgactcaaagtgtagggagggcaggcttttcaagtcgagagttctttaggggtccctggaactccacacccactccagaaggggaaaaacctgggtaccagattgtctcccttccctcccctgctctgtaagctcactaactgcagaacctccaaagtgcaggaaggaagagaaagcatgggtgtgggttcggttagcagaggtggtcaaagaaggggaaagaactaactggaatctgagagaagctcttctcccctttggggtcctgttttgtcatctataaagatgctgtgtgttgccagtgttttctcagtgggactaggtggaaaaacaatcgcttggcagtggtgtcgccatgggcaatgacagcactttgaactgacccttgtgtatggtctgtaggaggggctgacagtgcactccctaaagttatgctgggtctctccaccttttaccttgggtgggacagggcgggggatgagtctttcttttcagaccttagccttggctctctgcagtacccctgtttccatccaaagaggaaggccagagactgagcacccagagggcttccaatcacatgccacattgccccaccagcaagccctctgggcactgactgttaacttgaacctgcctatggcttaaactgcttgaatttatccaacctgtgaggctcatcatcctgcccgtctcaaggaattttgcaagtttcctttcattcacccttagagcatggggttggaaatcaaatagcctgactttctataattacagcaacagctgcagcaggagcagcagcagcagcagcaatgattaacacctagtgagcccttccagtgacattctgcatccttacatagccaagtaatcccatctgtatccctaataatgcattacttgggtaaatcacttaatctcagtttccttgtctatagaatgggttggatacttacatgtaccttgtaggtgggtaataatgaatgggaaagtacctaacacagaatatgactcaaagaacatgcccagtaaatgtgactttctttcccttttcttccccccccctagtgaggtccagagacagtgtctccttttacagatgaggacgtggcagcacatgaaaactgatagggtttcttggccatcactcaaacaatcaaagggcaccagagggctctggtggggtggtgctgattccaccatcaactgactaacatgattattctactagggtattcccttcagtccctagcacagatcctgggcaagcagggatccctgctttccagttgaaagttcttcaggggtccctggaaccccacatccactctaggaggggaagaacctgggttccaggttgtcccccttccctcctctgcattataagcttgctgatcacagagcctccagctcaggtcctgcttgcccaggctcagagctccagaggaaagggaacaccctagtaggataagaaatgataagaaatgaccccaggcctgaaggaaccacctgcttaattggggagtagcctaacactgtggaaacaactagcaaagtctccttaacaacagagcctctgggtagagtttatccttcattcctaagggaggctacttaggattatttatttctcattagactctctagggcatgctaagagctgcacaattaaactccttatatcaaggaaacaactattaaaacctaggattctaatggatttctaaaaagaaagagaagataaagaaataggagcgatcaatgctccggatgtcacaaagacactggacttggaagatgatgttttaggaaaagagttgataagtgtgtatgtagtcatctgtgcctatgaagttggcttaatttttagggcctgttttccaaggaagcttggcaggtgtgcccaggtaggaccgacagtgctcaagaatgttaaaattctgggagagctgcatgggaagagggaaacattagaacagaaagtgttcagagattctggattgtgagggattgtaaaggtcaaacagcctgagacacagggtctcaccctaagatagaaacagggtctgcaggagcaggctctgaggctgagtcctgggagaacatttctctctcttagaacttgttaaatgccagctccagggcaaggatcctcaaagcctctgacgggcatagcttatctcttttagacgtttcgctctctcgacagtaaagctggctggtcaggagtgattttgatgaaagcagggttccctggcagagggcttccttgtgcagagtgcagatggcgaacattttatccaaccagggctcatcagcaaagcaaaacttttatttacctgtttctgagaaaggaattagacactgttctctcagcagccttttaaactagaagcaggaaacacaaaatcttttcaaatacttataacaaataataaaatctgtttatattatggataattacagagcagagactcagggagaaaggaaggagaaaaaggagggggaagaaagagttggaggagagaaaaatagacataaagaaacataggaagagcccacagtcctggagggagatagtggagggggcaccttaccatgtgttctctctccctgtttgtgaaagatgaaaatgaacagctttgcagagagagctaaggacacctaaggggccacaaagaagtcagagataaactctcaggggcacctagagacctacagagaggggctcagccacacacagaggtagtttatagactagtgatgtggtttggttctgtgtccccacccaaatctcatctccaattgtaatccccacatgtcgagggagggacctgcaatccccacgtgtcaagggaggaggtgattggatcatgggggaagtttcccctgtgctgttcttgtgatagtgagttctcacaagatctgatggttttataagaatctggcatttcccctgctattgtgaagaacatccttgtttcccctttgctttctgccatgattctaagtttcctgaggcctccccagccatgtggaactgtgagtcaattaaacctctttcctttataaattacctagtcttggctcatatcttttttttttttttttttttttttttttttttgagatgttgtctcattttgtcgcccaggctagagtgcagtggcatgctcttggctcactgcaacctccgtctcctgggttcaagcgattcttctgcctcagcctcctgagtagctcagactacaggtgtgcaccaccgtgcctagctcatttttgtatttttagtagaaacgggtttcaccatattggccaggctggtctcgaactcctgacctcgtgatccacctgcctcggcctcccaaagtgctgggattacaggtgtgaactagagcaccccactggcaagtacctttatagcagtgtgagaacagactaataccatgagaatatctgcaaacacaaagaaagcccaggtgaagaatgggctgagccttgctagactgagggatgaaaagaccaagaaccaatgttagggaaaggagctcagctccctggaggcaacgcttaactttgtatcctgcaaggtgggaagtcaagtcacattttcaagaatctaaggcctgtgttgagtatcatttccaaattgtggcacttgagggtctctctgctgatgtcacttaaagccattttggatttgtttatcctgaattagttatgaagatttcttttcttggaaattgccaggtgaggcatatttgtggagaggtcttgagccctggaaggagacgtcagcgttgtgggccattcagaaacatggtcggccaccgtttaaatgaaacgtttcagacttcaggattgaactcaaactcctcagcttagtaagcaaggtcctagggaagcagcacacttcttgcagtctggtcatactgatggctcagttcctgagcacgcctggctctcttgtgccatggcgacttgtcacttgccctgcatgcctggtatgcccccctgaccttgtgtgccaggaaaatccatcccctttgtggcgcctatctgggtggttattatattctcatagcagcctctatttcttcaccagagcacctcccacaaatttaacacaataacctttagcgtctatgatcccctttctactgtcatcccttaaaggtgaggaccatgcctgcctgttcttcagctccaatccccacgcctctcaaaacatgggagctgaacagatgaatgaagacttctctcaaatattttgtcttgggaaaatgcccctcatccacccattccttcagtctgtaggaggggcctcttcctcccctccccactatgtccagtgcattccttcacgcagccctggacagcgggattgtggtggtccatgcatctctgtggcaagcattctgtggtgtctctctggagcaccaggcccccaagacaacactgtcctcctcaggccctggcttctgagctcaccatcccgtctctagttccaaagcagtttttaccaagggaactcaatttctgggtaagctgcagggaaactaggatatctgcctggcttctcttttcctgatgaacttctacagctccctcctttctctccctccccttacttgtaaaacaagactgtggctccctgagaactgggctggatctgacttctagagcatccctcagagcacccagctgctccataaacacctgatggctgattacctgttgcttgatgcaatttcatgatatagttatgcgttggtttggtcactccttcaacaattatttactaggcacctgctctgtgccagccactaatttggatcagaggtccgtctgcaaagtatggcatcaaggccaaatccagtctaacacctgtttttgtacagcccatgggtaagaatgttatatgcttatcttttgcatttgtaaatgggtttaaaagcaaacaaaagaagactatttcttaaaatgtaaaaaaaattttttgagacaggatctcactctattgcccaggtgacatgtaaaaattatatgaaattcaaacttcagtgtccaccaaaatttcactggaacaccgtcaggcccattcatacacgtatcattcatgtattattcgtactactatggcagagtttaacagctgcaacagagagcgtgcgggccacaaaacctaaaatatttactatcaggccttttacaaaaacagccaactcctaaccttgacagtgggaatagaacaacaaacatgacaaggtgtcagtgctcatgactacactcacaggaaggaaacagacagtatacaaataaagactgattcatgcaataagggaaaatggaatgtgatgggcatgggtgggtggtaagaaaagatctcactgaagaaaagatctcactgatgagctgacatttgagcagagacctgcacaataaaaaggagagagagatggatatatagtgggtagaatttcaggtagtgagaataccaagtacaaagacctcgagggaggagagtccttggccagaaccccctatctgaaaaaaataaaaaaaaaaatgtccttgcagcatttactgatgccggagcagaacaagtaagtcccactgcatgcaagctggtatggtgagggactgtggtgcagtggttagagcatggctctggtgtcagcagatctgtgtttggatcccagctgtgcaaaaaagatttgctcttaccactgcatctccctaagcctgggcttcttgctggctgagcagggccatgacaccacttctccatccaccttccaggacggcgagggagatcctgaataagaaggctctttctaaaccgaaacgtacatgagggggttaagtatcaccaacatgggcctcttcccacctgtctgtgctggtgttctctgcttttgattttaagcccccatgggttggctaccatttagcttgaattttctgggacagacttgattttatatgtttggtcctgccggccctataaaccgttgaaatgtctgagaaagactcatatttcagcttccaaacagcatctctctgactgcttctggtatgaagcgcctcttggcaggaccttgttaatgaagatttggtgagaaaagcttgacctctgggcgtgcaggcaggaatgggtacaagttccctagacttgctttgaggcagggcctcctgcgggttggtgtttctaccttttgctgatgaggaggggaggccgtgctgaactcttctctcagctactgcttaggtacttggggaggttcttctaagcccgcattttctgctctggaaaatgggacgcagcacagtcccacacacaccctttccaaaaaggatgaaggtgagcctgctgaagtgccctttgatgctggggagatgactgccagaaaaacacatgtgaaaccaggtgttacattattaatacctgcacggcaacttcagagaattcaggcaggcacaaccagcggcactccagctgcaaacacagccccgtttcctcctgcaagtccctgtgagagcctctctaaatcagactctatttctgattgcctcaacgttgtatgctgatgaactttgattcatgaagtggcctctctaggtgaaaattttcatagaactcaattaaaccaaattgattgtggttggttataagggtgaacggtgttgcggggggaggtggaaatccaagagaggacaccagcaatgtaaaaattaccctgaagaaaactgccaaaaataatacattttgcttcttgcgagattccattgacacggccttctacagacttattttatggaaagctgcgaatgttttcaccaggtttcatctgtttttattctctttagttatctaagttgcagctgaggcaggagaccaattgataggcttcctacccccactgcaacctccctcatccccacctgacccagtctcctaaaggatggctatagctctgtgacattttaatttgctagaatgagacagaataaagcacgaaggctcgggtcagtgcatttatcttgctagggggaaattagtgctggctctagcacacacccactatatacaccaatgaaaaaatacaattcaatttgtgttggcagctttaggagagcagggcaaccatttgttaagtgcagggtaattcagcgcctgattttgcagagaagcagtgctgaattcccaagctggcaattttgccggcagataagtgagttcccagtcctttggaaagtttctaagcagaagattgctcttctgcagtgctgtggccccagcatggtgtttcttttggtcaagtctgctggggttgccaaatgctccaacagagtggagtccagggggctttgcagcaggggtgtggctgatgggctcatgaaaggcatattctgaacaccagaggttgatgcagaggaaatgtgtttatatgagagcatactgtgcacctcctgagcctcccagttaagatgtgcctatgtgctcctgaagctggaataaggaagaacctgcaagagcctgcagttatcccatttcataattagccagtgggtgcacggggtgcagtcaggaactggggctgactgattggctgctctaggtcatttgaagtgaaacagagacacatttttgagactaagaaatgaatgaagcagagagctaggatgtgctgaaaagcaaatccctaaataatcacaaggcattaagaaatagtctggcttacaagtgtgcttgtcaacaactccactgcccattaagctcccagagatcaggagcagaaccatgagcctctccttcctgcctcctctagggccatgctgccggcccgtctgggtgttgctctacattttccttcctaccaccatgcacactgccttccaactgcaggctaacttggcaaatgccctcaactgtcaatgccaacttggtaagggcagggcccatgtcctcagcaggtgctctgttgacatttgtccctccctgttcagctcggttctctgcctgatgactgctctcagtgaagccccatgctgattgcagatgcctctgacagccatgctagcaggtcctctggagcacaggtccccaacccccagggccacagaccatccaggaggaggtgagtggtgggtgagtgagcgaagctacatctgtatttacagccagtccccattgctcacatcaccgcctgagctccacctcctgtcagatcagtggctgcattagattctcataggagtgcaaaccctacagtaaactgcacattcgggggatctaggttgcatgctccttatgagaatctaatgcctgatgatccatcactgtctcccaccacccccagatgggaccatctagttgcaggaaaacaagctcagggcttccaccaattctacattatggtgaattgtataattatttcattacatattatgatataatgataatagaaataaaatgcacaataattggaatgtgcatgaatcatcctgaaaccactctgcacccctggtctgtggaaaaatcatcttccacgaaaccagtccccagtgccaaaaaggttggagaccgctgctctggagaacttcttagatgcctgtcagcccatgcatggcacccgcctcgggagcccaagacttcacccacattctcgcaggaagtggcattggatgtttgtaaaataaactctggggtgtttgggttcagatctttggcctgcccttcactctctttgagtcattttacccttctgagcctcagtttcttcatatggaagtaaataaagatgcctacttcagatacgcttaaagcagatgacatctgtcatggtccttgtatgctctgctcagtcacttcctcccctccctcaggtgtgacaaaaggcaaaaagaaatttaacgagcagtctgaatggtgggaaggtggtaggaatgtgtctaattgccttaaataacagataataatagatgcatgggaagggatgggaccggtaagtctacacggaggagatctgtggccatgacgataaaggattagtaaaggtagaaaaaggagatgagggccctgccccaggggatgctacagttctaggcatcactgcccatcatgggaccatccttctagcaagtgcaacctcccccagctctgcaaacacaggagtgactggctcctcaccacatctttgtctcccagatggcctaaaacactgatgtgagacaaaagcacatgcttggtgaatctctgctctcgttctcacatgagctgacagttgatgaatcttttctggcaacctaaatggacactataagccaattcgtcagacacccaagacctgtctttttgcaggatatggtcttcaatcctcgaagccagactgtttcttaggtcaggggaaagttgaggggtggcggcactggcaggcccagggtggcaccccctagttgcattgggctctttcctctaggtaaagaggaagaagagtgaatcttgatctacactaactgatagggtttggctgtgtccccacccaaatcgcatcttgaattcccacgtgttatgggagggacccagtgggagataactgaatcatggggtgggcctttcccatgctgttctcatgatagtgaataagtctcacgagatctgatggttttaaaaacgagtttccctacacaagctctctttttgcctgctgctgttcatgtaagacatgacttgcccctccttgcctttcaccataattgtgaggcctccccagccatctggagctgtaagtccattaaacctctttcttttgtaaattgcccagtctcaggtatgtctttatcagcagcatgagaacagactaatactgtagctcagggagaggttgcagggtatggtgccctaatttacatagtctctgtctggacacctgactccaggctgttaatagaatcatgaagtgctgatgccgaaagggtctttgaggatggttattccagtgttttcctaactctgtggagtcctaagcttgaggagggccctcagggcctgtttgggggtaggggggctcccatgtgaaggcattctctggctttcttccttgtcttcaactagaaccaccataccctgtctctttctttcttgcaggggtatgtgatgatgaaggggtcacccggaataaagggttccactgcagcaaagcaaaaactgcctcaaaagccacagagatggttgatttcatgtccacgtttcagagtcaaaggagtctaagggccagagcagtgaagagacttgcccaaggtcacccgctggttagtgcagatcccagcctgggactgcatctaccctggagtccagctcttctccccacccctggacctgcccttcagacaatctgagcactgtctctgtgctttcctggctggtgatgccaggaagccaaggcatggactgctgaatggggagggagaaagtctaaaaagcaatgtcagcaggagaatgcacactcttgaagaagtactagctatctgcactttgatgttctggagagcacctggcttgccaggccctttcttcagcatctctaggtagccctgctgaatgggtctggaaatccacagggcaccaagtagcacaacagaaaatgcccaaagcccagggccatagccttgacactgtggccaatttgccgtgtgaccttgtgttagcaattttgtctttgacttgcctcacctatggatggtttatgcctaagttccgttccagctttagcgttccaggctctttctgatctttaaagatgaacttattcctgcaccaatagctgtctttctatcaacttgccatgaaaaatagtatccgctcttcctttgtatcccacaagcttcagaggccttaaagatccccatggcttatttaatttgaacttcaacaaaatgaaattcttatccacatgggaatgatgtgatagcaaatgttcagctagactttgatttttatgtgcattgttatatgcaaagaaatccctgacagcctcccagatgtcctcagcgatgtcctctatacactttggtgatattttgctcttttcctctacgctctgggaactaactcatcatatatgagccatcctgaggcttctccaagagcacccactacatgccagatttgaaaaactgtcaactcatcagattgagagctgtttcatttgcttcagatgccggatatgtagagggaaggttgaaagaccccctcagcaaaatacttcagtcttgacgaagctgggcacaccgatatacagctcccaaagagggcgtaattctaggagtcaacagcttaaggttctgcaccccccagaacccagactcattgtaggaaaagcaatgattcactctgaggcttcagaacagtattaaattacttgtccattattctgtgatttatgctggggttgggctgagaggtccctgcattgctttctcctcctcaacccactcaccccagtttcaaccactgcccaaacagccacagaatttataacgcagaaattggctctgagacccagcacagtggcattttctttctgccagggatttttgctactgtgtcggttttatgcatatgtccacatgattcttatattaagccacaggaaaaaaaatccaatttgttttttatgaaagtccaaccgctgccctgccagtcaaacccatttatctcacccagcatggattgctcatgtcaacccgtgattaccgtgcactaccttgataacagcctgctaattatcccaacatctgaaaagctgccttttgtaaattacattgccactaatgaagcccagatgcactcgcttcggtgtcctctcccgctccccctttctctgtaatgcacaggagccaaaccgcaaggccaccgctggcatctgagcaaccttataaccaaagcgtaggatttcaggcccagccacagcacacgtctccggttgacataacccccatttgattcaatctgctttctcccagtttgactgggtgtcagattagagccccgttattacagtccatgcagaaaacccagataccaggcaacactttaatttgggataataaggaagatgagcaacatgtggcaccgatcatgtaggtgcaagggctgtgatttctaaattacgctaaacagatgtggagcggaaaattgccatccagatgacagtttggttcagcttgaacaaaaacgggccctgacgtggtttggggctatttatgccatcctgctgcccaatggcggggagtcagaggggctgacgcttatgccacaggttcagcagtggtcagctctatggggttttgctgagggacggctcctatgcccttcctgttgtagtttccttatgtctcaggcaggcagaaagaagtgttgagggctaggaagcaaggatgagtcagtgtgggtggacatggggtgcctctttccacaaggtccgatcttctgcccatctctatggccataccatgtggttctgccaaagcctggcatcaagattcctttccaagaagttgtcacacatgtttcagagacagaaatagagacaaagtggccaggcatggtggctcatgcctataatcccagcactttgggaggccaaggtgggcggatcacgagatcaagagatcgagaccatcctggccaacatggtgaaaccccatctctactaaaaatacaaaaattagcttggtgtggtgacacgcgcctatagtcccagctgctcgggaggctgaggcaggagaatcgcttgaacccgggaggtggaggttgcagtgagccgagattgtgccactgcactccagcctgggcgacagagtgaggatccatctcaaataaaataaaataaaataaaagagtcaaagcatgagcagagcccgtgcagagcagctgctcaaagggagggccacacctggtggaacccgcccctagccccagagccaggggaacacctcctaggaccacttcgtcatatccacttcccaccagctctgctctcctctccctgctgtcagtgcactggagggaggaggctgggaaggtgaagtgtggcctgggcgccttgaggcctgtattgcccgtcttggctaaagaagtgggagttgcttgcaccaagacccagagctccaggagatggtgaccatcctagatgaccagggcagtgagggacctcagccctctggatccccaaaacaggaaggagttcctttcttctctcttcttacttctttctttccaaattggaaagactgggcatttgcctctgctgagtttttgctcagtgatggcttaaatgtccatcctgccttgtttccttacctcttaggcagagagaaacatgtagaaaggatgatactaagggaagactgggcatgggtggtgcctctgcagagtaggctgcaggaggtggccatggcacaatcctgcctccaccccttccttgcgtgcagactcaagtcgagcattcattcaacaagcatttattgggccttcactgtacaaagcatggggccagtgtatgaagacaaagaaatatctcccacttaagccctgaccttgagttgctcagtcttcatgagaagggagatctgcctagatagagccacttctggagggaagaagaggatgagtgcctatgagtgacagaaacagagcaccatgcaggtgcagcagagggaaacggccttcctgctcaggcagtcatagaggaggaagatatttgaatagtactcagaaaccccacccaaaatcctacaagaatgggtatctcacttccttctaactgcttctaaaggcacaatctcattttgttcagtatctcagtaacagggcctgggagggaatttgagccaggagctcataggaccagtctgataattgagaacctaaaattggggtctcgggattgggtgagtgccatggatgtgacagattgttcagataccatgtcctggacattcttacttgtcttacgcctgctaggcttctgcggggcatttgcagattaaaggcacactgtgatgtgacttcattttgttagtttctgtgttgatgctctaaagaacatttacctgcacagtcattccgaggaacaggatcttccaaagcctggcatcaagattcctttccaagaagttatcacacgtgtttcatagacagagaccaagtgtgagagagacagagagagtataaaatacagatgcagagaaagagacagagacggaaccagagagaactagaatttttttccagtgtcaacttcacacaaggaaaagaacaaaagtcagaattcaaacccagcactcctttttttttttttttctattgagatagagtcttgcttttttacccactctggagtgtggtagtatgatctcagctcactgcaacctccacctcctgggttcaagcctttagcctgcctcagcctcccaagtagctgggactacaggcatgtgccaccatgcctggctaacttttgttttttgtttttttgttttttttagtaaagatgggattttgccatgttggccaggctggtctcaaactcctaacctcaggtgatccacctgcctcagcctcccagagtgctgggactacaggtgtgagtcaccatgcccagcccaaacccagcactcttaatccagagaaactgttccttccactacactttgcttctgctgttatttacataatattactgtaaaactaaacattgcatcatgctttataatttgcaaggcatttcaaacctcataactgtttgacaatcctttcatcattattagtctctgttagtcatacagataccagatgatttgcccaagaccacaccactggtcaatggggaattttgcagcctgtctctgttaattcaagagagcttccccaatgcaaccgaactcctggctagacccctaagtcaaagcaaaacccttcacaaagaacacaatagatgcatcctcattctaattccaacctctcttgatctcagtttctggacttttaatatcaagataaacatgctccatctgttctcttcctgttccagttaccatgagatccctgcttctgccctccctaagagaactatctagaaggacagtcccctgtaccagtgacctctcttccttgctgtttgtcatttgtcccatctcttgcagtcacactcacctgatgaaccagataagctattctacacaaaacctgggatgttaacagggtaagtagccggcatatgcctctggggcaatgaccagtcttcagtggaaatctcattatctacctaaatttgtttactaaataaatgagacaacctatttatgtatcatgtaaatttaattagaggcctgatttatttactctgtgtctatcaacagtcaccactttctccagctctgcatcttgaacactctttccctggcataaaacaaaaacaattagcttctgtctttcttggatcttagccctggagcataagggagcagaaggctaaaggcaaaagccaaatggggtagggtaagtcagggggtgttcaagagagccccctgaaatacccaggctgctaaaaaaaaattaccagaactgaggggggcctctatgagaaggagaccctaggaaacatctttgagttaaatctagcaagatttactgaagggcaaggatgcagggagtccatgaacattccatgataggaaccctcctcatttattacttgttaaacgatgttcccctaattttaaaggcaatgcgtgttccttggacatttttcccaaataaaatctgagaaaagttaatggttggttcatctggatcttaacaggaattttgcagtgaaattagtcaaataaattggagcaggcctgtattgaacactgtctgatttggtaacataccctgtgactctcagacaggcacacagagtatgcaggcatccacacatccgtgtgaccatggaaacacttgcttgaataccaaacaagatatccaaaaaataggactattcaaggccctgcccttcacttcttcctccctcatcatcggcagtctcacactcacaggaatacttttcttcacagagaaactccaggacctgcagaactccttctatagaatggctggttcggtgttctggagtctagccctggattttgccaagtgatcagaatgcctttctggtttgcacctgagcatggtgacatcagttgtatttgaaaagtcattgtaagcaatgccacataaatgcattgttacaatgattgttcagatgctgttgagtattggtgtctctttaaggatccatataaaagatttctctctggtcatagtttcagaccacatacatttttgttaagcagctggtttgttttgctttagctaaactgtgaattttataatggaaagcacttcgtgtgctttgcttcgtgtgtgctgcttaggaggcccacagccaaacgtgtggcttcctctctcaggtaaattgcatggcatggttttttgtattaaggacattctaaggttcatagtaacttgcttatctatgttttctcctctatctttcttaattattttaaatttattttatgttgctcaattattgatagttttaaaccctatattcttttttagaataaggcaaaatataaatgtataattaaaaaatttttaacatttactttaggtgatgatgcaaagaagaaagtaaaagtcaattgcaattcaaacaccagagaaagttatgcagttaatatttcaatgtattttctgtcagctattattactatttttttgagacagagtcttgctcttgtcacccaagctggagtgcaatggcacaatttcggctcaccacaacctccacctcctgggttcaagtgattctcatgcctcagcttcccaagtagctgggaaaacaggtgcgtgccaccacacctggctatttttttatatttttagtagagatggtgtttcgccatgttggtcagactggtcttgaactcctgacctcaggtgatccacctgcctcggcctcccaaggtgctgagatcacccgcgtgagccactgtgcccaccctgtcaattgtttttacaaaattaaaataatataccatatacaaatttttatcttgatttttccacaaaatatcctgagcatttttctataatattaaatattctctatatttaccattttctcatttgggggcttttagcatcttctcagggttttgctttggtatttttttctattataaataatgttgtattaaaaaatctttctagaaattttttgttcaagtttttaattattatcctaagatacatatgtatcttaatacgtatcctaagatacataactactatgagaattagtagtttaaaatacataacatttttaatacttttgatgaatattatacaactgctttacagttgtaaaatatgtttatgttcttgctaacagcataaaaagcatgcctatttcatcacaacctcattggcattattgtgttattacagttaaaaccttcgccattttgtagtagagaatggtttgttttttaatttgcatctttgaataccagcaattgcaatcatttttcatccttttattaatcttttttaagtattcttctttgaattgttgcttcatatcagttgcccatttttttgggggggatattaacatttttttttttaatgtgaggctttcatacatatattaaatacgatgactattttcttatgtatttatggaaaatatgcttgtgtttccattttgttaagttttttaactataggatttttaattcttatgtaatcatctcgacagatttgttcaatttaattcttatctacatttgagaatgaaataactatccacatatattatcttttaggtctcaaaaaaatgctctgatcttttaaatttaactacatttagttaaaatctagaattaatcttggtgtattttgggcttctgttgcaggctcaaggcctaggcccatgacaatatattaatattggttatctccaagctcctctgggatagtggtcctgttatctacctgggaaataggaacactttcaacactcatttaggctggactctagagaaagtaaagtaggcgacaacttgtgcagtgtgattggaagtgaatcagaaagccccatctccccattgctacctaccaaaatatataaaacactttcaacatccaggaacaggactcaaatttcacctttatagatatatcccttttctttctaccagattccaattaataaaaaactaaagcctgagcagttaagtcctctagtcagttcccacaattaagggtgattatttttgaagatgtttagctgagattcccagactcctgggaccagttccaggacggaggagcactgagatgggggaatctagtaggatgaggtgggtgtacccttacctgcccctcaatgcaaatgaagcctgaatcacttccaccaacacctccctactcttgcctgaaagttagcctagggcctttctcttgggtgaccagttagactactccccagggcaactggagggatgctaatatatttccccttgggggaggggtaggatattctcatgttttagacttgggcacagacaccaagtccctggtcttctggtgcagcagatctgagattcctggctattgcctgatgtctttcaagcagcttcacttcttcctttgacttctttcagtcctgatctcccatacaaataacatctgtctttcatgactggcataggctgtaagcttatttttaagcacaactcaaaagcattgatttcacaaagaagtataaagctcaaggtgaaatagcctttgctattctgagagatcacttcttcttctgcccctacaagagtaaatcaaaatttttgttttcccccctgaggtgaactagttggaggatccaaaggtccaggcccctaaaaaacccttctctttttagttcaagtcacatgctaatgtgtcaactcattcgcctggagctaatacttagcattttgcatttggttttatagaaaatgcataactgtccatagcttcacttcttcctttgacttctttcgatcctgatctcccatacagataacaagagcccgggtgaggggagagttttagtaaacttccaaaaacaaataaagatgagagactgtgtttatgttgtattcaatattttatgagctaaaaataaaaattaaaaaaatgtagcttatccctctaaaagcaacaacatatagaaatatcaaaatattgatttaacagtgaaggcctggttcaggggaaagaggtgggtagagtagagctctgtagcatgtggaaggccaactttccctgcatctaaccctcctcttggttcttgggccaagacatgcctcttctagttcaggaagccagagaatgcatcatcagagtttgggccaacaggaatttctgtccccatcctggacagatttactttgctttgctatcactaaggattttaagtagattgatcttgcatcccagcttttctgggactgtgtccgtttatgcagtgacccctttcactctcaagaacgtctccactgagaccataaattatacattatcctagctattcatggaaaaagagatgagagaaaaattttttatttttatttttatttttgagatagagtctcactctgtcgcccaggctgaagtgaagtggcacatctcagctcattgcaacccccacccaccaggttcaagcgattcttgcgtctcagcctcccgagtagctgggattacaggcacccaccaccatgcctggctaatttttgtatttttagtagagatggggttttgccatgttggtcaggctggtttcgaactcctgacatcaagcgatccaccctccttggcctcccaaagtgttgagattacagacatgagccaccgcacctggccgagaaagaaattaagctctctttttgtctctagatttggggattgtggtaaggtgagtcacatgctatcccagaggttagcaaactttttctataaaggaccagatagtaaatattttatgctttgtgagacagacaggctttgttgcaactacttaactttgccattgtggagaaggtggccacagacaatatgtaagcaaatgagtttggctatttcctaactaaacttcatttatggtcacagacatttgaatttcatataatgttcatgtgtcacaaaatagttttcttcttttgactgtttttccaccatttaaaatgtaaaaaccattcttaacttgcgggccagacaaggcctgcaaattgtagctgccttgtgctgtttcagcaccttactgaatgcattgggtactggtgaacaagcccctcgctcccctccgggggctggttctctgcatacattgggtatcatcatcatcaacaacatttacatttatatagcctgaacacacacatgaggtctgagagctttagaggtgggagaaaccttatcatctctgcagcgttcaaccaccgagcaagcgatgataggtgagatgtatcataagtaatttgctactgataataaactaccaaagcttgcaggtgatttatgcctgtttataagttagagaagatttgatgctgttgctataataatgctattctccctcacttgcatttgccttctccaggtaggagatggggtctgctgcaagatgactaacaggtgagggtcacaggcaggacaaattgccgtgaatataccagagctgtgtgacccgtgacaggagaagttggaggatctctagtcctacctcatggggaaaaatcttcacaacaaccctgcaaggacaggttcaggaaaagtgtggtggtcctgagtttgtacagtgatgaaatcgagggcagagagaccaacaagcttcctcaagtttgtacagcttatgaacagcagagctagaaccataaggcaggtcttttgggtcccaaaatttgcagggtttgctatgacacactcagagaaacctcaaacactcacagcctgctgtctttaggctctgaccggacaacaatatccaaaatcattggctaactccactgctattgtatagagttggggccttctcgttcatggttacagctcgggaagttacactatccccattttatggatgagtaactgtattttcagaatgctattacctagatcaaaagaatctaatgaacatttagagacctggcataaagtactttcataagtcagaatcagctgccaagggagtgggtatccctgtgccaggtggaagcactttggcagaaaggaaagtaaacagtgaagtcccctctagcacgcttgtcaaattgccattctaaaagggctttggaggtcattgtgtcaagctctctgtgtgccagggaataagaaactattgagcatattaggggaaagtcacccctgggacactgcccacccacagccaaagctagtttgtctggcttgtcatcaaatgaacttctccaccagccaacacttgaatacatctccagggccatgggaacggatatgcataattcttccagaggcacactaagaagaacaaataaattcctaatcacgcaactatttaatttctctgaacattcttctgaacatagtgttattggtagctttattatattttaattgattgaaaacgggtcactaatttgtattgcattaattactctacaacggtctacccaaatcatgcatggttccgcggcttgttttcagttgaccatttttaaaggttaaaaaaattttttaccttcaaactcaagttcacgttcagttgacaaagattttttgccagattaaactttagtgaggttcctgaaccttctcctaggcacgtctgtgtcctcgtttataaaacccagtgttattaagaaacttgctaagtcagttcagcaaaaaccctccaccctagatatctgataaggtttctcatcttccaccaggccccaggtaataactgatcatcttggcctgtcttcagcaagaatcctgtgaggtcactttagccagaatccccccattacccgtgatgtttcctccttggaattttccatcctcttacccccatcctgcttcttggctatgtattcccacctgctcatgctatatttggagttgagcctcatctctctccctccctgcaaaaatcccactgcaggccgggcgcggtggctcacgcctgtaatcctagcactttgggaggccgagacgggcggatcacgaggtcaggagatcgagaccatcttggctaacacggtgaaaccccgtttctactaaaaatacaaaaaattagccgggcgtgttggcgggcgcctgtagtcccagctacttgggaggctgaggcaggagaatggcatgaacctgggaggcggagcttgcagtgagccgagatcgcgccaccgcactccaacctgggagacacagcgagactccgtctcaaaaaaaaaaaaaaaaaaaaaaaaaaaaaatcccactgcagtggcccctttccctatcatgatggtcctgaacgaagtcttaccatgcttcagcaagaatcatggaataatttttttttcttcaacacagtacccccatattaaaacaaaacaccagttctgtctaaaccaatttcatttatcaggtccttcagacttcctcattctgacgaactaaattcttcattctttccttttagtccctggaaagaagttcaaagatttaaagctgctcttgaatttgggatcttaaagactacttggcttttggaagcatccgggcagccacagccaggatggtaaacaagggaagcaccgaaagcaagacagagggctggacgtaggcaagtgggcatggccacctccccagtcacaccccagggccgtgaaacattaaggctgatgactaaaaagagggaagaatataaaacgtcagaggagcccaggtgaaggctgggctctgccagaatttaaagagatggaaataaacatagagctctaagatggcattttgaatttttctcactaaaggtcagagagaagagggaggcaaggagtgacagcagggctaacaacgagagagaaatgaaaggagagagggggcctggtaagacaaggaaggaaaaagaaagtttttacaaaaataatcaacgtatgaagtcctggtcacgtagattacatcatcatccctgagtggcagaagcgccctctaattctcggtgtcgtcagagctgagacagaccttctgggccgtcactggcatctttcagcacctgagttcattctgggttttactctttctgtcgtctttctcatgagtccgtctttattcttttcggcttgagatcccttgttgccaatcttaagatcactctctatctcaggtacaaagtcaaggctacccacattgaaggctgggggtattgtcactggagaaccagctccccaaaatccagatgacagtgcttccggaggggcctgggggatggagtgagagttgggcagtggcaggaccctgagtcgccagcagctgatggcttctggggtactcagcgggtcccagagcacctttctgctccctgcgggtctgactctcatattcctcttaatcctcatcctttgttcctggaataccaccaggcccaccctagcctgagacccagccacatcacctgactcattgccactccgaggagctggtcacaaagccctgtgtgctctggggtccagctctctgcttctctcagatcaggcctgagctgaccacaccagccctctctgctccttagtccatgctggctcaagcaggctgcttggagttgcaaagtatccctctcgcctgagctcttggggcacaaacttggtgggagaagggagtgaaagagttgtttattctttccctctacctgggaagagggatgctggaggccacaaagcctccttctcctcacttcctggctagttttcatgttgggaggtcagataagttgaataacttatgaaactagagaaataacccttctcctaatatccctatagtgtgttaaacagtgtccctcagaaagatatgtactagtcctaaccgctggtacctgcaagggagaccttgtgtggtaacagcgtctttgcagatgtaattaagcttacatggactgtaaatccaaagagaggcaggagaagagatttgagacccagggaagacatacatatgaggaaggagcttggagtccttctgcaagtcaaggagctccaggaaccaccagaactggaagaggcaagaatgaattctccctggagtcttgggagggagaatggccccgctgcaacttgacgctggcctccagagctgcgagataatacatttctgctgttttaagccacccagtttgcggtcatttgttgtggcagccctaagaaactagcacatggcctgaagcaaataccaccaatatcagaatatcttctgttgccatacattggacagaggggtatggactgggcctcacgagttcagacaaatgagtccacaggttacgttacgccagtgcctggctggcatgtggggtgagagctttggatgaagccaacgtaacattggtctgtgaaggggccttggggattttgtgggaacaaaggataaggatgtcaggaggtcagaaaagtcccagaagagggatggctggagatgatttccagtatcttaaaggctcgaccattgcctatggagaaacagggagtgaagagatgcaggcagactaggatttctcaccctaggacgtagtttccctgagaatgagggaattgacccctcttcaccgggatcactacctgacactgccttagagaccctgtcccctttcattctataccctgtatttcccactgcaaaacttgtttccagaaagctcctaaggacctacaggaggtccccaactctgacagagcagaaaatcacagtcaccttagagggaactctagggctatgcacctgagaagaatattggccgttagccaagcattctttaattcaaagaaaaccaaaacacagtgaaagaaagatgtcactctgcatttagggatgtgatgaacacagtcattaaatgtagaaaccaaaaagttcagaagtatagcagaatcttgctctttttacttcctctgatatcctatgtgactatggcaaaccagtgtattcttaggacaagcttctctatagtcaatgctgtgagtgttgagctgaagctgacagtaccagcttttaaagttgattgtgacattttcaggaactttgaaagaagattgttaaatacagccattattaaaatatgcgaacttacaattaaatcagtgcttctcactgggggtgattttgtactccatgggacatttggcaatatctggagaggttttcttggtttttacaactgaggattttactagtatctagtgggtagaggccagagattctgctaaacatcctataatcacaaggcagaccccccaaaacaaagaattatcctgcccaaaatgtcaacagtagtaatgttgaaaaattctgaattaactacattatattttataaaggtaataaatcactcaaaactcatcactttccaactatttactagtatctatgtttttgaggttaggtatttacatgcatattgtgtctgtatggtggaaatactatataagggtgtgagctgtgtatctcttcccaactccacattcggtaaaatcacgtcagtagcttaaagtggccatggtggcaacatttacactatgagtatagacaaacagtacaaataaggtctcctcacttttttttttttttttttttgagatggagttttgctctgtcacccaggctggagtgtagtggcacaatctcggctcactgcaatctctgcctcccgggttcaagcgattctcctgcctccgcctcctgagtagctagaattacaggtgtgcactaccatgcttggctaatttttgtgtttttagtagacacggggtttcaccatgttggtcaggctggtctcgaattcctgacctcatgatccatccacctgggcctccgaaagtgctgggattacaggtgtgagccactgcacccagccaagtctcctcacttttttgaagagccagttgttaaacatgccctagctcactactggagaaatgggtatagtgtggctataggggtgtgtgtgggggttctcttctctttctcacttctttcaaaagaatgcagtgaagctgagacctctatttttctaaacaaaaatggggggtggggggcggggggcaaagaaggttgaaataaatgaagtatctgataaaaatgcaaaaggaaggaacagaaggaatagattatttacaagaaataattttaaatggaaaggaagtcatgcgtctaaatatctttttacacgattaaaaacatctgaatgaaaagtgaaaatcaatcctcctcccagatgtcttttcattgtgatgccaagtagacgaatatttgaatatttgcattacacacagcttaatatctcaatattaggaaatattaagattattttctactttttttcttcttcttcagatatttgaaaacaaacacacttttgctaaagtcgcacatggtttcagagtgatcccaggtggaagcagagacacagacagtggtttcttcactgagatctgctgtcttactggatttttttttttttttttttttgagacagagtctcgctgtcacccaggctggggtccagctgcacgatctcggctcactgcaagctctgcctcccgggttcacgccattgtcctgcctcagcctcccgagtaactgggactacaggcgcccaccaccacgcccggctaattttttgtatttttagtatagacggggtttcaccgtgttaggcaggatggtctcgatttcctgacctcatgatccgcccgcctcggcctcccaaagtgctgaaattacaggcgtgagccgccgcgcccagccgtcttattggagtttgagattgatctgtgatgtggtcacattcttaaagagctcctctcaataaaaacacatgggagtagggggaacagagaggaagacggagagagaaaacaaaacattttcaatgaaaggaagaattttacaaattttaaaactaagtaagccaatgaaacaagtctgttgggataaagtggtagctcagaaggggaggcacagggaataagttttctgaagctgagagaattccaggactgaagggaaaaagcagaagaaccctggacactgataggaatgaactctggacgaagataaggtgtcgtgctccagtagcggcaagctggcttgataatgagaaaatgaggctggggccatgtttaagaagtgagagtaaacgagtgtccacttagatcccaggagcccagaccacatgtacatacatcacctaatacagggctggtgcctactccacactcaacaaatgttagctcctctccctaactttcaattgcacacgtttgtgacttacctctcacctctgatctccttcagttaaacctacctctaccatatcctttggccagatttttctttccctaacccaaatagaggctctgtttttaggtcctgcacacttctccctatattcctattgacagcttcaattgccctgtctgtgaaaatgactctggggttcacagcttaagtcccaatatcttgtttctcccatatcctatcttctaagtagtatacagacatcctaaatgtgttgctgccaccttcactcaacatgtccaaaacaaatcaccctctctttccccaaaccatctttccttccctgatagtgttccctgaagagagagtgatttgtcagaagactagaaggtgaggagagtaaagacaccttaagaaacaatagagattcagaatggctgcaaggggcaggtaggggtgtgtggagagaggaaaggggaagctagagaggtgagcagggccagattctgagggccttgagtggcactgaggatttatgacttgatcataaaacccagtggagagtcctaactgaaagggactggaagcaaaatagcctttgataaaatagactctacaagagcgttggcatggtggcaagggctctggccacttgagaattcccctggcaggccagggcacgtccctacttctataagaagaactgagaccatgtggggagcctcctggtaactctgtggactgcagactgcttgctatgtcttgaatgaggtctgccctcttaaagtggtccatgaagtctttcatcattgccctttgtggaggggtccaaccaaactttgcctgatactgaattcctccccagaggggatattctagtctcggctgctgggtctttagttggtgtgactgtgggccagtcaatacctagatctctaagcatcccccactttgaaacagacacaaaaaaaatagcactccctcagaggctgagaataagacaaaggcaaccgcattctttaaggccacaggaaagtacctgggaaatatgagcctattattaaaagtgggtggaggagattggaaggaaagggaaagtctgttggaaatccaatcccctgacgggcagtgacagaggtgggcagcaggcctggtcagcctcacaaatcaggcttctcttaaatagctactgtcaacagagtagcgagggagtggagatttagtgctcactctcaaacccatcatatctgttgtgcttcaaagcatggaaaagatgataaatcaaagaagaatatgaaccaacgccactaatttggtgccgagttgttccatttgccatggagtcctcagaaattcctccacaaagcccagtgcccttttcttaaaatcacataaccaatcaaatattaataaatgtattaattcctaacaggaaaggtgactcatatggattttgcattagggaagaaaaaacctgacaactaagaggtctcaactggttttggtgatctaaccagcaattttgtccatttaggaaagatgtggcttcctgattaatgtggaaccttagccatgattttaataaaagttttaatatgtacagctgcttagctggagtcatgtttaattaaaaccttgaagactcctggagcgttctctcctcttcaccaagggaggagacacagaatggccccagggtaatagggagatagcggggcaggtggagggatattggggtgtggtgcagggctgcagaggggtacagaggagaggagcagagcacccatgtgcctgaggagagtgtgggccactgccagcatctgccaagggaggctggccaatgtggctgttcttcatttgggttttgtcacctgctctagctcctcactttgtggaggggaaaacagaggttcagagagtactgttattttttggagtcagagtatcactcggtcacccagactggagtgcaatggtgcgatcttggctcactgcaacctctgcctcctcggttcaagcgattctcctgcctcacctcctgcgtagctgggattacaggtgtgcgccaccacgccagctaatttttgtatttttagtagagacgaggtttcaccatgttggccaggctgctctcaaactcctgacctcaggtgatccacccacctcggcctcccaaagtgctgggattacaggcgtgagccaccatgcccggtacagagagtacttctaaaaagagaacactagttgtttgttttttgtttgtttgtttgtttgtttgtttgttttgacatggactagtgtaacagaacccagcatagaaacctagaggtgacactaaggcatggcatgatcctaaaacagcttgttcttatcctaacagtttttattagggacatcatgaaagctcatggcttcacagtcttgcaagtaggaatagggcagccatgggtctagagagcaaagggcatcaggctctggttttaatagtacatgacatttagtgaaaaatggtggtctacaaagctatgtataatcagatttcaattacagaatatatactataatgtatactgatgggcatagaaaaaagaatggaaggaaatgctctaaaatattaatattgattaaaagccttgagatgatgggagcatgagaaatttttattttcttatttcatacattagtatatttgatgaatattctataatgggcatgaattgcttttatgactgagagaaataaatattataaacatataatttgtattacaaaataaatattacaaggcaccttaagccatctcttttgttccctgttacaaaatatatggacacttaaaagtacatgtaaaaggacacataaaaaagcatgaaccaaaaaaaaaatttttttcctctactttaaaataacgatgtccaggcacttaagctatgtggtatggaaccctgtaaaatgatatagctgtgtcatcaatagataagttaccctctgaggtagcttaagaaacagtggctggttttaaaatgactacaaagcaaacctgacaataaaattcacttaaatatctgactctgcaaaaaaaaaaaaaacacattacactctgtcctagaggagtactatgtaattggaaggcctgtgctgtaccaagaacatccttagtataaggcacaatcccagatgtgataaaataaaaatgtgagctcttaagtactttttaatgtttcaaagtcaacgaggaactaactgccaggagtaggatggcaactctctcacttcataacatgtttttaagcagaaaaattccttaatagaggacgtggagtcatatttaaggaagggaggaggcttgaattgtgaagcaccaagggggcttttaaatgaagctgttgaatgagttggcttttggggtacaagaatgtgtgtgaccagggctttgtttgcagggcctgcagtacaatgcagattttcagggacctgcctggaccagaagggaagaatttgaacttgaagacacttgagtttcttcttgaagatagaaaattgagcataagctgacacttcatttttccacaccaaacactggcaaaggtagaaaactatttaagtgtaaaaagagttaatagatatatatccatacttgaaagcaagaaagagacatctcatgagaccaaaatggggattccttaaaccctaaaacatgaaaacaaaaggaacatcaaatgggcaatacgccaatgctctttgcctgtagtaaggacaagaccaccctcatgaggctgggggctgggtcaccatgctcactggtgttgaaaagctaagctgtgtggttcccacccctaccatctccctaagattgggggtgatgtgattacccatggcgaggtgaggaaattgctactcacgtgacacaagggcccagagctcactccggtgaggacagagctcagatccacatcacccatccacacgtggggcagaccagtggccagcacaagcctgaatgggaaccacttcccctcaagtctagggctaagaccccccaagactgtttttcctgggataccacccagaacattcagaatggtggcttctggcagaagatgagctcataaaccaaaaattctcaagcctgtgggagagtaacaccacaaaaggcagacaacaaacagaagtcacatggggaaacagagctgatagagtaacattaaattggctcttaaacaagtatctttactcaaagagataaaggacgtaataacatccatggaaaagaataggtgattatggaatgagaggaggtggttatcaaagagaaaacacatagaaattttggaaatgaaggctgaagaagtagaggaagacattaaatcatagtttatgtgggaaacaaaatgctgaggttaaagaagtagctcctggcattggagaagaagcaaatgagagaaacagatcctaagcctgctgggagatgggcaatgcaagtgtttcaggctgatatcgtgggggctgctcacgtgctcaggactgtttgtgtacagtgtcgattgcatggtgggggtggccctgagagctcagaggattcaggccagattgaactttgtgggagccaaagataggttgagatgattcaaaaggacagtctggggacacgttaagagttggggcataaacagtagaagaggtatggtgttggttggtgggtggaggagtaggaaggaacccaggccgtatttctggaaataggcagcttaacttggaggaccatgaaagggctcagtatttctactgggggttagcagcaaatttcttaacagcccagctcagagggacacccacctaggtggaaaggtgaggactgctgggtcaccaactacactgggttaaaggtttcagaattgggttggtagtctattttatgattcctttctggaagtccaaataaccagaactgcattttcacacagctctgcctacatgcagagaaatttgctctctgattcccattctagaagaagtttcaaactagccaattcacagcttggcaaatggcctctgaaagcaatacagaaatatcagggagtgaaggggcaagagagcaggagcctagtgttgcagcaagcccctagacaggttctaatactttacaaatattaatttaatacttatcaagacattgggcacgagttctagctccagtcctatttaatgacttgattctggtgcctcggtttccccatgtgttcacaggggataatcatgtgtcctctgcctatcctaaagtattagggttatcttgagtatcaaatgcaaggatatgaatggaagactttgtgagctgtggcatgattccaggggaggggccggggctgtaacaaagggaagcaggtgcacactgtggcctggatactaacggctccattaatcttggtggaagcatcaagagtaccagtggattttttcttcagtgtcatggccacccagagaggacagggcagaattatggtgctcactcagcttctctgagtgttccatagagtgaagtgagccgtgggaagagttctctgaaaaaacaaaagcaggcaggaaagtcatgcaaatgggtacagcgtgtatccagaggagtgatgccgggttcaagcaactcagaaacagcacctgggcagattcagcagagggtccagacctcgtcctggcattcattgtcaggatgccccttaccagactcagaggccgaagctcattggcctatctggattaggggagatagaaactctgagagaagcatgttcaagctggacagagatagagagccccaggcatgcctctgaggacacctgaaggtgggggcgggggacaggaactctaccagctcagtgtcctgagggtgtgagtgcctcaagggttggatgcagatttactgggaggttaaaaggctaacacctagtttatattactaattgcctgtggcactactgaggcaacggaaagctgagcaaactcgatatgaatcatatatttttgtttttttcttgatattttgccagcaggatgggatttatcattttcctggggaaaatggcttgacttgtccttattctcacagaacaagcttggatggtcactcttatggctcatttgccccagggaggccccagacatattcaggatccaacatggacaggcttggagaagagattctgctcatagaatcccagcagggtcaggcctggggaggacccaaaaaccatcaagtccagtgagctttttatgaaatcctattttgaatgaactctttaatatataagacagacatgagtagggctgatctggttaaagaggcttggagtcccaccaggccacctgcttggagactcttaatatataaaatctcttaattttccagtttagcaaggattaagtgatgtgtctagcattacctaacaaggtggtggtagaacaagatctggaaaccacaatgcctgactaccagacacagagggtcctgtttgcttgataatgtcaccacccctcacctgcctccctcaggggaggtacaacaatgacaaagatcaggttaaagagtcctgaacctctgcaaaaatacataatgatgctaaagaaggtggaaggactatagctggacaatagaggctaccacatttggaggtgagtttgttgatgaaaaagccaagttctataaaaatatttgaaactgtattccgagccagatgtgaagaccatgacctgtgacacagcctcaggagatcctgagaacatgtgcccaaggtggttggctacagcttagttggcatacatattaaggggacataagacatcaatcaatacacgtaagatatacattgattctgtctggaaaggcaggacaacttgaagtgggggcttgcaggtcagaggtagattcaaagattttctgattggcaatttgtcgacagagttaagttatttattatccaaagacttggaatcaatagaaaggcacgtctgggttaagataaggggttacagagaccaaggttcttattatgaagatgaagtctcataggtggccactcatagaagcaatagatcgcaaatgtttcctattcagacctttaaaaggtacctgagtttcagctaatcttgtcaggatcagaaaaatacgtagacagggaaggggattctctaccaaatgtaaatttcccccacaagagacagctctgcaggtccatttcaaaatatgtcacagaaatatattttggggtaaaatacttggatttctttcagggcctgctctctgtcatgtgatgctacactagagtcaggctggaagttagtatcttattactacaaagagtctgttttgtcagccttcaggtctctgttttcatgttaatgccagttagttgtgcctgcattccaaaggaaggagagtatcatgaggcatgactgaccccctccttcccatcatggtctgaactagttttttttaggcttccttggaagcccccttggccaaggggaggggtgcattcagtcggttgggtggctcagaattttgtttttggtttaccagttcatccctcacacttggcccagcaagctcagcaccattcagtctctctggaaacatcctgaagcactggtaggtcagtgatgaaggatagaaaccatccctcagtttatcagtttgagcttatgattccccctatgcctgggatacttccttttctatccactctttcctggctaaatccttaaatctttgcacccacttgacttgccaattctccaatttaaacgatgttttcctgtaatgattcctaatgagacccttttttttccttcctatgcaattggtgattacatgaaaaactcttcaaattatttagtatccacttctcccataagtaagtaccacaaggctaggatcaagttaaatgtggtcacctctgtatactcagggtctagcacagggtgggcaaattacaatctgtagatcaaatctggcccactacctatttttgtataactcaagagctgagaatagagaagttttttttttttttttttacagtttttaactgttggaaagaaatcaaaaagagaatattttatgacgtgaggattacgtgaaattcaaatttcggtgttcataagtaaggttttgttggatgacaggcatgttcattcatttacgtatggtctatggccctttcgtgttacaatggcagagtcgagtagttacaacagaaaaaagaagcagagaagggccatgctgaagttcacacatgtgtcagggattacactcagatctttcaaactcctgcagagtttttacttattgaatttctccaaactggcaacaaagacagcaaaactcatggcccagaatctaacctggtcccctcagcaggttttctaggtatctgggataggtaaatatcctgaggacatgggataaaagatgctttgttaaaagccactttgaacacctccctgagaaaagacatttaaaagataaaagggaaaagaggtctgatgtgtcctgtttgtgccaaagttgagtttggtttccattccattataaaatgcaacaaccctaggagtttcatgttctggcaccacattgctctttcagatcttgctttgttctgctcacatctctgacacaggaacaaagccacaagcctatgcagacagttgtctctggattagagtgccttgtttcagctcaccctgctcaaaccagagctatacaaaggtggcattggtgttaactcttgtctcttaaaagttggtgaatcctctcttcaatcattcctgttgggatattctgacatatttcactccagccaataaatataggtgatatttaatgacagtgggggccagcgcaatagtaggacactatgtgaaagcaataatctacagtctaaagaaaaccatgcttgagtggattacttcagtttcaaaagtcagtagtcccctacctttttggcatcaggaaccggtttcgtggaagacagtttttccacggacaggggggtgggtagcgattacgttctcataaggagtgtgcaactaaatcccctgaatgtgcggtgcacgatagggttcacgcttctatgagaatttaatgccaccactgatctgacaggaggtggagctcaggtggtaacgcttccttgctcgctactcacctcctgctgctgcggcccgattcctaacaggaaccagtatcggtccatggccttggggttgtggaggcctgtcataaatgaccaggattgaaaggggccttaaaaagttatcccactgctatagactaaatgttcaaaattcataggttgaaattctaacccccagtgtgatagcatttggaggcggggcctttgggagatagatgacttagatgaagtcacgaaaggtggggccctcataatgggattagtgtttttataagaagacaaagggagaccagagctttgtctctttcttccacgtgatcacctggcaagaaggtggccgtctacgagccaggaagaaggccctcaccagaaaccggccatgtgagcaccctgatcttgaatgtctttgcctccagaactatgagaaatcaatgtatgttgtttaagccacccagtatatgatacttggttggagcagacccagtgaaggcaccagcttactggcacatctgaattgtgagtgttccttctgtagcctctacctgaaggctcacatggaatgctgcctccccacccctctgacaaaatcaaagtgactcctgcttatcagctgaaatttgctccctgtaagttcaacctgatggtcttggttccatcccttgggtcccaaagaaaaaaatcttcatttcctttccatgaaaaagccccactaccatccttccacctcccacccccactgccacctccccataacctcacaagtgctcttttattcagatccaataggcaaatattttctaatcactcttcatgtgctatggttccaagactcattttttcacaaaagctttcaacagggacaataagcagccaacatggcaggcattcacttcatttcccctcccctgtctccctcacagaaatcaggaaatgaggaggtacacttaagcaaaaggcctactggataagccacaatctggatgattcagagttattttcagtttggacccaaacagttttataaaaatggcaaagaagctggatacctctggtgtgaatcatgaggaaaagggcagggccccagaaaagaaatgggatctacatgggccattctaggtctcagacctttgtgctaaattgcaaagaatttaagcgtatttgagagtgctcctaagtgaaaggtaaagaaaaatagcccctgccaaagagaggtaagtaggaacttggcatccctgtggacagacctgggtgtctctgcaggaagatgagctcatctcttcaggcagattatctggttcaatggttggcaaactactatggctttcaggcctaatctggcccattgcctgtttttgtaaataaagttttattgaaacaaagccatgcccatctgttcacctattgtctatggttgtttttgtgctagaatggcaggcttcagtagttgcaacagagacaatggctcacaaaatctaagatatttgtatctgactctacagaaaagtctgccaacccctgatcttgttcactctttcctgtattgtatgccttgcaacactagtcccctgtcatacttccccaaatgtggtgggaaaaatcctcacactagttgcccctcttagaaatacacagtgctcaccagcctttaaagcctccaagaagtcttgcagccatgcatctgctttcctttttttaactcagcagtccttaaactcacctgacctatcagcattccacagagcatggggagcacaggcagtgaaacaccaatcttgttgcttattactgttctttgaattgattttctattgttttttctaagcctgtagacaggccttacttagattttcaagtttagtgacagttttgctgatgatatctgagggagggctgtggtttccccttaagccagggtaggagaggcgagtagtgctttcctccttgacgggcgtggtaataacagaagtggggagaactgcagcgggcagaggattttccctccaatgtcatcatactttctctccttactggatcatctctctaagcatagaaatagagcatcttttactttaagaaaatcacattcctatccagctacctcccacccatttctgctgacatttgcaatagaactcctctaaagcactgtcaatatacatttcctccaatctccttcccatcctctcttgaacccactctagtcaggctttctccctcaccactcccccgaaatggctcttgtcaaggtcattatgacctccagatagctaaaaccaatagtcaaggctcagcttctgctgcagtcaaaatatctgcagcattctacacagaaaatgaccttcctcttccaagcatctcttctcttggcttctgggaccccactctctcagttctccttctacctccctctcagccactgtacgggttcctctcacctccttgacctatgactgttggatgcctcaaagccttcttggaatgatttttttcttacctacactttctctggtcatctcatcctgtctcgtggctttaataccaagcacctgctagcaactcccacatttctttcttttttttttcaatctcagtagaccttcacctgtagtaagtcttataaaaataattacagcaatttgccaacataatcgtgattgcatctcttttttacaaaggcttttattttaagtttaggggtatgtgtgcaagtttgttacacaggtaaaccacatttctattgctttgtctggaatgctctctccccagaaatccatgtggcttacttctttcatgtttctgctcaaatatcacattagtgaggttctctctgacaactctctataaatatatgtataaagaacacccgcatgccacacctgcctcccagtgctcccttgccatgctttcttttcttcctaccacctattaccatttgatatattctctacatctgcttatatttgttagctgtctgtcttccctcactagaacatatgcttcatgaaggcagggaatattttgttcttggctgcaattccagggcctacagtcctgcaagacacatagtagacactcagcaaatattttaggatggatgaacagaggtgtgagttgtctgacatagggttctagagttcatcatgatttcatagctgatggatctaagattgtgtcttcttgtcctaaatcacatggcttgttagtggcagagctgacatcagacacctggtcatttgttgagtctctcctaagttccaggcactgtaatgaaccgtgtggacataggcgccatttctgctgtcatggagattttcagtgaagactgactttgaatggacgatgcttgctccttgacctctagaccaggctctttctatcataatgtttccaccgtcctaatgaccagttgtgaccaagaagatgtttgtccttaaatagccaccattccctcctgaggcataaatcttagacagaggacttctgcagcaggaaagaaatttacccttcacatttaaggcaactttctcagctctccacagtatgactgttaagagctgggtatcttgggtggtttgtgaggtgtcccagtacctactggctggtctctcataattccatttccagttttgttttgttttgttttgagacagagtcttgctctgtcattcaggctgggtgcagtggcatgatcttggctcactgcaacctccacctgctgggttccagtgattcttgtgcctcagcctctcaagtagctgagatgacaggcacacaccaccatgcctggctaagttttgtatttttagtagagatagagtttcaccatattggccagcctggtcttgaactcctggcctcaaacaatctgcctgcctcggcctcccagagtgctgggattacaggtgtgagccaccatgcccagactatttccagtttttaatgcctgtgccttatctgggtgaatagttgtttttttgtgtgtggttttttttcttttgtccactctctctggtgcccattccaaagtgttgcaagcctgcccttccatgctgagaagatttcattatgtgatagcaagtcgggagaggcaggggctctgtgacaactctacccaatcctggtggcccacagaagagaaatattaagagcttttgtttagaggtcttctctcactcatctacacatccaaaattaataaaattttagaatccagaatattagatttggatgggatctcaaatggcatattgtctcaccatgttgcaccaatgcagtgatccctgaaacatctgtgacatgtgagtcaccttcacttggtgctttttatcaacagaacatatttacatttttttttttttttcagatacagggtcttgctctgtcacccaggttgaagtgcaatagcacaataacagctcactatagctttgaacttctgggctcaagcaattctcccacctcagcctcctgagtagctgggactacaggcacaagccaccacacttggctagttttaatcttttgtagggatgagatctcactgtgttgcccaggctggtcttgaactcctggcctcaagtgaccttcccaatgcagtcccaccaagtgctgggattatgagcatgagccactgcacctggcctagatttactctcatacaattttccttaggttgagataaaaccaacctccctaaagcttccacacattggccctggttttgtccttgacacctattttgagtaaatctcatcgttcacttaattatcaggtcttccagtaggcctgtgaacccagaaaagagcatttagtccattcatgttggatataagtaccagcataactttgttggctattaaagcaaacagatgtttgtaaatctttgttatttcacatgctgcaacaggagtaccaagcgacagttgccattaccagcgtatggatggggaaaccaaggcatatggatggctgatgacttgctgttggctcagtggacaaatgattcccggctgcttgtcctttgctctgacttggactccttaatgtattgcatactccagagaaagctattataataatggctccaagaacattagaatttctattattgagaaagatgcactttcatttaaagggtttcattcgtcttaaatgagttctactttctgctttcctttcattcgaatcccatgtttattatttctgctccacggctggcctgataaatctgaaattccactcacaccagccagcaaactcgattccaagcagcggcagataggagaacttggtctgttggagacaaaggtttctctccagtttggtcagcaagttggatttaaactgacaagatcatagctctacaaaaataagatctattaattgtcctgtgaaaggaaaaggtcactggacaaatgttactctgtatctcattttacagctagagtctgggcatccgcatcaaatcatttctctgtaactagattctgcttctcaacaataattaaaaaaatgactccggataagatcatgtcctagttctgcttgtgagttttgtcacttgaatacatttcacttatgctgaaatcagcctggagttgctgacactgtacttcctctaggaccccactgaaaaatgtatgagaggtgtctgggatcattaattgattctcccagatcccctttgttgcctacttctcagactttggctccaaaagtagaacagaagtttctctaatgtgacctaggtcactaacaccaaaagagtgtgggagagggacaggcatgggaatgttgcccatcagaccaaatgtgatacccctgggaatcaaatgtgatttgggggttccatgctgaagtcaccagggatggctgggctgcaggggaacagccacagacagcatcttggccagagtgataggcattatttgggtggatggtgtgggacagcacaaagggaaaggaggctacagagaagaactttctctggctctccttaaggtaagtgggcagaaccgacagtgcatcagctccttaggctggtaggagcatattttcagactcagcaaacatttactatctactatgtgcccatcaaaaagtaaacactttcataaacagtacatataattctcactacaaccctgtgagataggtagagttttaaatccctggctttccgtgtgcttgtttgtttgctgttaacagttacatgaaatggttatgtcaaccatctgaactcttaccttaaggaaagaggaggttatataaataaatgatatggcttggctctgtgtccccacccaaatctcatcttgaaatgtaatccccacagttagggggaggggcctagtgggaggtgattggatcgtgggcatgggcttccttcccccttgctgttcttgtgatagtgagtgaactctcaggagatctggttgtttgaaggtgtgtggcacttcccccttcgctctatctctctgtctcctgccacaggtgtttgcttcccctttgtatccaccatgattgtaagtttcctgaggtctggcagtcatgcttcctgtgaagcctgcagagctgtgagtcaaatataccctttttcttcgtaaattaccagtctcgggtagttctttatatacagcagtgtgaaaacagactaatacaataaataaacaaagagacagacaaacaggttctttctctacggtatcaatgccaggaacaccttataggaacagatccagacagggtgactcgctcaccagctcagggcctggaagtggccgacttgggacttgacaccagggtgtgcaacagaacccaggcttcctcccttccccctcccactgccttcaatgttaatggcctgttcaatgcctttgtgcttctgagacagatacctttgcagttgccatctcagtagtgtgctaatagcatctctgattttgaaaatgaaaaagtttaaaaaattaagcctttctaaatataatttgcacgtcttcccctcctgtgcttttagctgtgtgtgttgtttttaaagtctttatctgggtgattattaaagtccctggtaggttgcattttactctgcttccttggtttcaatcatccctggagttatttctacgtttcagggttccatgctgaagataaatgtagaaattctacttcaaacatggacaatttctctctgtttccaaagtgatcatgaggtcaactaatgctcagctaaggaggaaccgtcctacccagaagagagttctcccttgaggtcattcactttccaatcaatgctcccgaattcccccaaaacttactgaaacttctctctcttttcacctggcccctagccctgaacgatcgccctcctgttgaggagtctgtgatggcaacatctccaggtagtttagctcatgaagggggtgctgggagtggggatgggaaaatgggagcttcaggatgtttattaagtgctggactgttaatgtcagtgaagaggtgacagaaagaggcagctgtgcccatcctgcagggagtcagtgatgctgtcttccctcctgtcttgctgtagtaccttcggaattttagagttccagactacataacaccttcagaacaattccagaacagtttgggaagaaaggaatcaaaacaaaaaataaagtaggaaccatgacctcctctcactccaggcatacacacaccacggggggtctgagtacaaaagcaaaggcacaatatcaaacatgagttttgtcagagaggaaaaatgttgagaacaaattcatgaattctagtcctatttacatttcaatccccaaactaattgtttactcataagtgttctgtcatgattgtggtcattggtagctttctgtaaataaacctaaaaaactttattatcccaaattatttttcgaatgcctgagccacaaagaagccgagagctaaatttagtgctcaactgcaataatcaatttatcccagatgactggcatttctcattctcttctccttttaattagtcttggctttccttccatttttaattgtccaggtttatttgagatttaacataataaactacctcaatcccttttgcatttctcttcgggaaattaaattagctaacattttcagatgttgactcttccttccaaggcataagcccttcctttaaaaaatcagctttggaaacacaagtatcaatagaaacacagttcaatggcttgggcactgttcttccttgttgcggacctcagctgacatgcagtctttagccagggcgtatgtcacacaggtacacaagcacttcacacatctatatctctttcatgaagaaagtgaaaccttgttctccatggaatggaaatcttaaacactaggtagagcactgatgagttcagtgtttcttcacaataaatacacagcattttataccataaaacgaatttgtactgtctgaacaaaatggctttacatactgccagatgtgattatcaagattgattttctcctgccctgtggtaaccaggttacttagctttgcagattcagctggtcttgcttttccctctggctaagtagagacagatccactcccagcaagtcaggaaaaagggggggttctacagctcagggactaatgggcaatgaaacaggagccagtgtttcctacccaagccatcgtctctcatcctgcttccaatcagcactgatcctgtccagacagccttgtgtgacaggagactcaccgggggcatcaggactcagagaaagtgaggaggagctggggcagagttcacctccccctaccgttccccaggctcctttccctagaccatggccctgcttctctcgggtcctcggatgcctgctgacgagggctgcctgcctcccgaacccttagtatcaactcctacagctagttccagtggcgctggcatcagtgggacctggcttccaatcccagctctgccacttgccagctctggatcatgtcgcctctcgaaagtccagtttgctcaacaggtagaataatcctcacatcactactgaaagtttcacctatttccagtgcctagaaccatggtaggccctgtgaaaggctctgcggttagttcctttcactctactttccagcccctgccctcccaggcttgctgagcctagctccttgctctaagattcccctctctgtagactgacagcatgttccatccactccaaatgatctggagaccgacaagaattctgtctgtgaccaaacattaatcaggctcatctgagccccactaagccccatgcttgggcagggcctccacgagcccaatttcagcaagaatcctgtcacgtcaatttagccagaatcccctactcttcatatctgattgaatttcccatccttcaccatcccccaggtcatgtctgattaccctggcctgcatggctcctgttgggtcagtttggccagaatccccccatccctgatgtttcttcttagtaattttctatacacagacaacttccccctcccctggtttttggctatcaattcccactttttcttgttggattctgagttgagcacattctccagcccgtatggtgaaacctctgttgcagtcatccggaataaactctgccttacagttctttaacaagtatcatggataatttttttaagttttatttattcattttttaagagacagagtcttgctatgttgcccaggctggtcttgaactcctgaactcaagcaatccacctgccccaacctcccgaagtactgggcctgcaggcttgagccaccgcacccagccaatgcttttctttaacaagacctggagtatctatgctcttgcttgtgactttaaggatgctgttccctcttctcctccttcctacttggttacatgatatttactcttccagatatcatgccacctcctttgtgaaattttcactggacagcccccgcacccctgactcttgtcctagggtaaagctaacccctctttcttctgttcttctagtgcaaagctctggcaccagactgtctggagtcacattccagctccacctttctctaattgtttactttgggcaaatggtttaacctgtctgtgctgtggttcccttgttaaaaaatgaggatagcaataatgcctagctcattggcttatagcactaacgcatttattctgttaagtgcttcgagatagtgtcgaactcatagtaagtgcttcaatacatttagcgttattatcagagctcttcttatagtttatagttactgttgttatcaatactatttgccctgtgcccactactgaccccacaatccttgactgggaggatccttcatagcagggattgggtcttattcatctttgcacttttcttctaatctcacgtcaccatggcacacagtaggtactcagcacttttgctgatatcagtaggtctaatgaaggattctctgcagttttaatgtgccctccaaggcagtttattttaataggaggcttcaaatagtgcttgagctgcaaggaataccttttgcacttcaccccaggaagtcaaattagctaatattgaggaggatgaggtagacacctcggaaccctcaggcctttcagtagctctgaatctcatttagtgtttggctgcatctcctctgcagaggccagggcctgggcccctcccacctaaatgatttctactcaaagccattttattaagtcagggatggggagacccagaccctgctctggtgaggccgacatctctacagcggacctcacggagtcacagccaggcatattatgtcacgagacagagtatggccacagctctctgggcattagaaaggacacaggagagggagctcctgcttggaacccccaggagctttcgggaaagaggtggcctgtgagttgggatttgaagatagtcagggtttctactggcaggattaagggaaggacagcctggaaagatggggagggattatcagcagtgaataaagagaggggaggaaaagggcagagccaccagacgtgtttgctaaaacaaaccctcaaattccctatctaggaattaaatgtaggctcaggttttgaacttgcttagagctcacagtggcaagaggaaggaagatttacaatttgagaatcaaggcgtctgaagaatttgtaatctgagagaccaaaacagacgccccctgatgaactaagacagacacaaaggttaaggggaaaagattatctattggcgagggctctggactcagtgagcatggcaacctctgaaattcttacagttaagagaaaaatcacacccttcctaaactttctaacagtaggagccatcaggcaaaatatcagactcctcctaactctgtcttacaacccagaccactacaactctgaatagacagaggactggccttataaacactctttcctgataagcatctgtagcccttaagccagttccagcagctcatagaaactgtaggcaaactgtgccctgtcattcaccttttgccctaaagagccaaattctacctcattttaatgctaaagccctgccccaaagtgaacatgggatgtttgttacctatgtgttggtccattgtgcatgtgcttgacccacctcataaatttgtatggccttcctccacacctggtgaatatgtacagtgatattcacctggtgaatatctactatgtgacacagaccttctgaggcataaaacacagcccacccttcccctctttgaaaagaaagcaccttaggtccatgctggaaactgtctcttcttggtttgcaaactgatatcatcaataaagctctcctttctactatttagccatcctgatggtcttttagatgtcaaagctatgaggaaattacaccacacagccccccacttcttgtctgtgttgaccattctggacacagaagcctctgctcttttacaaacatctctgaaggaaggagagctcctcacaaagcatcaggaatcatttagtggtgggaaagctttgtgcatgacgatcagaggaccctgaaatcaaatccacatctcccatctgatcatctgtaggccctcgacaaggggcaaaccttagtttcctcttctatcacattgaaataagccttcctacttcaggggatggtgtgataactgcatttcagagcatatagtccagtgactagcacctagtgagcacccagtgctgacaaagactgtctcaggctcctctgagccttcctcctgactttggcccctgtcctgtcagctcagttttagtaacaatcctgctaagccagtttagcaagaaaccccccttcccttgacccactcatctgcttcatagctatgaaaccccacttgtccttgctgtatcgggagcactatcttccctactatctcccctactgcagtggccccattgtaacagtcttgaatgaagtcttcctcgccattctaacaagtgtcagaataacttctctaacagtatgtgcatgtgactattgccatcatctttcctctctcccagggatcaacagacagtgaaattttctacctagttcctggttgggaaggcagcacacccatagtcctgtgatgactcttctagcaccaccgttgggctgggagacctgcccttgcacgatgactccaggcaggtactttgggttctgcctagcacagggtctgcctggcacatccctccgtagctttccttaggatcaatgtgttgagctgccaaggaggggtcaagccagacctttagaagctgctcttaggtgctgaccaacattcactccagttccaagcaatcaaaccagccttttgtcagggagaggcctcatcttaggaaaccaatgtttctgatcaaaggtcaacctccaaatccaatccagatgcaattatagttgtgatttaagtaccagagttgaggttcaaagtccaactttttttcctgaaacaactgacctctgctttgtggcaaaaatggttgagtgtcagatgactataatacaattttaatttaagatctaaaactcggtgctaccttcaagttgtcatcagtttgtcatttttttttttttgttgacaaattaaggtgagtgggcaggagtgctgtcatcttctttcacctccatttcaatgtcactctgtccctgaacctacttgcccttatactggtggggagagggtcccctccctgtgctcccaacatgtccacacccccatttttaggattctaagccactgtccctgactctgattctctcctccctaacccctggtgcaaagctgcccacgctacagactaggtggctactacccgtgatatgcaaaaccaataaaaaataaaaacacttggccaggtgcggtggctcatgcctgtaatcctagcactttgggaggccaaggcaggtggattaccaggtcaggagttcaagaccagcctggccaatatgctgaaaccccatctctactaaaaatacaaaaattagctgggggtggtggcgcacgcctgtaatcccagctacttgggaggctgaggcaaaagaatcccttgaacctgggaggcggaggttgcagtgagctgagattgcgccactgcactacagcctgggcgacaaagcgagactgcgtctcaaaaaataaataaaaaataaataaaaaaaaaaaacacttgaaaaatagttgtgtatttatttaattaaataagtattaagaaaatgattatataacacaagaaacccataattttgtggatgttattgctttagatgaggttaaatatttaagtttagctagctgacttgcaatagtaccaagtaactgatcacaagggtgatctgtgacattggaaacaatgggtggaagttgggatgatctttgcacagtggagagccctggactggcaagcaagagtctttgctctatttctcacttccagtatggccttgagatgtgccttaacctctctaggcctccttgggtatcattggtgctttcacggagctggctcctttcctgatttccaaatgtactcaagtttctccagtgtggaaaataaaccaccaatacctgttctttgagcgtgtgagccctcagatcgagctctcctctcccttctccccttttctgtgggtgccagagctgagggtgttgccttccttctctctgctctccctgacaacaccattgaaagggcctcttcagtgtcactgacgacttcccaaatagcaagcagcactgccggccctcagcttctggaacaccctgacttacacgggctttgtggacaggactgagaacttagccccgatggatcgtatgctgtgtcccaggaaaatggattctgtgtatccaatgcctccttgacaaagagaccctcagaagctatctccacccatttatatttaaaacccctcctgggttgtcaaacaatacatgacaagggtccctggtctgctgcccgcactcagccctgctgctgccttctgacaatgggaaggatggagcggtgccaggaggcagcccctggggcactgggatgtcattatgggctgcatcaggtgcccatacccacagtgaggggcatcgagctagggctgcccaactctagcagccccgagggatgcctagggagagtgaagaaaagcagctcaggtttctgggttcattacttggctctccagtagacgttccagccttggaccaatgacccctttcgtaatgcctcaatctcttaatctgctaagtggcaataattagtattaaaagtaggaaaaactttgtatgagtttgttagggctactgtaaggaaatcccattcactgggtgggcttaaacaacacaacggtgttgcctggcagttctggatgctggaagtccaaaatcaaggtggtggttccttcagagggctgtgagggaaggatccattccaggcccttctccctggtttacagatggcttccctcacgttcacacggtgttctttctgtgtgtgcctgtgtccaaatttccacctcttataaggatctaccttcctccagtaggaccacatcttaactaatttcattggcaacaaccctattttcaaataagagcatattatgaggtactgggggtgaggacctcaacatatacttttctctttttttttgcggggtgggggggtggtgggtgggcacaatttaacctataacggagctgaagatgcgaacacggagtcggggccctggattctagacccggctctgccattcagcagctgcatggcactacgtaaatcagccctgtactccaggcggcagacttctcttcacctcctcagtttgagggtaggaccccttccagctctaatagccaatggcttcacatctaacttaaaccgttctaaatgttagcagagtatttaaaacttcttacatgggcgatacagtataaacactaagaaataataaccccgcgcctcgggagaaagaacgcatacaaattcaaagtggttttcaaacataatttcattaatctttacaaatcccctgtgaagtagtattattaaagagcaaactgacaattgtgctatcatctggtcaagtaaaagaacaacatctcagacaagataatagcagacttatctgcctccagggagagttgaatatgcaaagggtgagtgagttggaaacaaataggaaatttcatctcaggtggctttgaaataggggttggaaatgaggctttggctgccatcctgggactttccaaaggagggggagagattcacaggcagactttccagaatacatgcatcattcatggcctctaatttttcatgcataaatgtttgagctgatatttaagatctaggaaatctgctgagaaggaattacaatgtttttctgaggtgagaaaaaaaaaacaacactgtcttagatgaattgttcatcgctttttttgttgttgtggttttgctattgcaaaggtagaaaagatatctgttttcttcctttctaaatcagggctagaaaagtaggcaaccttgaaatgatggaattgtggccacttcactgaagccctcatcctcccagcctctggccattgtcctgagtctgaccagcttttaggaaaagctgatggtcaggcacagtttatcccaggacactgatttcacactccatgtagaaggcaagatgaaggaggcaatcctagggctgaagctgaccctggacagtgggacaaaaggtgacattcagatctgggattgcacaaagacgtctcatcatgtgggaccctggaaggggccaagaaggcactgttgcccaacttgatcttaaatagcttctttacttgctggccttctgatctgaaattccactactggagactctttgggttgaaagaatatctatcctccaggtgaccccctcaagaattcaattgcttctggagaggtgagggctggacctcttaaccaatcgccagcatcattgtgcgaatgagtttgtctcaaccatccttttccagggtgttgagaggttatttagagagggactgggaagggcagggcaggtctccaagcctctggtgggaataagaagaagcagaaaaacaaaaaagggatgaggtggggtgggtgggagactttgaagaccatctttgcccacctcactatgctgccagatgagccacagtacaggctaacctcatttagtgaagcaccaatgctgctagtttacaggttagcttggtttagtgaacacccataccgctaaattaatttaacagttaatactgtgagccagttggtaaatctgatcgtatatcatcagaaattctcttgcagggttcttctgaggctgcttttattattaaaacttaccaatcaaccaaccaacaaataaaaagcagtgtattagcctgttttcacgctgctaataaagacatatccgagactgggaagaaaaagaggtttaattggacttacagttccacatggctcgtgaggcctcagaatcataatgggaggcaaaaggcacttcttacatggcagcggcaagagaaaataagaaagaagcaaaagtggaaagccctaaatccatcagatctcctgagacttattcactatcacgagaatagcacgggaaagaccagtccccatgattcacttacctccctctgggtccctcccacaacatatgggaattctgggagatacaatttaagttgagatttgggtggggacacagcaaaaccatattaagcagctttgaaaaatcataactttacacagaacccagcttctctgtatgacctggtgccagctgcatctctcaatcctccttccaacacaccaatacccagttccttgaagttccacagttgggccagccccctcacccctcctctgcacatgctcttccctttgtatggaacaaccctccatcccttttctacctggttaactaccattcttcattcaatactaaactcaagtctgccccttccaggaagccttcctgacttcccaaagtaggtgagggtcccctgcacctcactgctctaatcacactgattagaattgttcatttggtttccagtttcttcctctagaacgtggcagaaccaatgacctccatcttggcaaccccaatgtgagacgcggtccctggcacctaggaggttcctaacaatgtttattgtgaatgaacaattttttaaccattaaatttgctgattaaaaagcaacagaactcagttgaagcacacatctactttgtggtggaaatataaattgattcaaggttcttggaaagccattggcaaggtgtatcatgggcaatgttatcaactttgaccctggcactccacttctgggaatctagcctaaggaaataatgtaaactatgaaaaaatgatcttcatgatggtatttatagcagtgttacttaaaatagaaatgcctagaaataacataaatgtccaataatagagaaacagttaaattataatctgataaaatgttttgcaaccgtgaaaaatcaccactagaagaaactgtgtcaaatgtggaaaagaattatgataaaacattaaatgaaaatgacataaaacacatggacaggatgataatgattatgtgaaataaaatgatagctcactttaatactttacatgaactcttaattcttacaacaatcctatgtggtaggtactattcacatctccattttctagatgatgggggtagaagcacagagagagtaagtgactttccctaaactgcacagctggtaagtaatagagtctgaatttaaacccaagacagcctgtgtctagacactgtgttcttaactgtaatgatataaaattcatctagagtttagaagaaaaacaaccaaatgctatcgcttttttaaggttgtgaaaagaaaaggaatttcttagtctatatttcaacatttctataatgggcttatactacctttataacagaacaatatttgaaataaaaattttagaaattttataatatagaagtctttcttcaaacgtctatttgtaaagcatgtttacaacagttggtggcttaaatattccagaattgtcttgaatgaaaatgtttaaatactaagttacctgatgcatacacagacacatgaagctgaaactgtatttctgctcatgtatttatttcctttgtaatgtgtaacatatgggatttgatatttataccctagcaagactcttcgtagaaaggtatcaattcactagttgaggaaaaaaatcattgtcagactatgtgttgatgcctttcctttgctcaaacaccagtcctgctctcgctggtggtagaaaccccaaaccaagtcctgggagaccttttgggtggagatgtgtgagggaggccagtgttgcacctatttctggggcacaaggaaagggacctttaagtttttaccaagttaatctgatttaggtcttttataaaagcaaaactgaccgtccaggattccctgagctctcacacagagtatttctgttacaaagggaggtttcatgtctgtatatgagtgagaaaccctctatgggaaatgagaggacacagctggggaaggctcctcctacacctccgtgttcaggtttgcagaggagcgggtggagcttggtttggaggagctgttccaatggagcaaggtaaggaagaactgcagggaagccaccactgttgcctaaaacttaagactcaccgaggcctgctggagcaggggatggggggagggagagcatcaggaagaatagctaatggatgctgggcttaatactgggtgatgggatgatccgtgcagcaaaccaccatggcacacatttacctatgtaataaacctgcacgtactgcgcatgctcccctgaacttaaaataaaagttaaagtgaaaacaaaaacaaacacataaaagtaggactcattccctctgcaattcccaaatcccacgccaaggcactacaaataagagtgttcctctaactaatacttacaggagggtgttcactgtgggcagagcctggtgctgggtgagaatggggtttgcctcagctctggaaacctacacactaggtggggagataagactgacagctagggaaaaggtaattgataatctcaaactatgcatgtggttcacatttgcccacatgagtggtatggacgtgagtgtgtcaggttagtgtggggaggcagtcagaggggcactgtgtccacactggtggccgtggaatgtgtgtgggattcaaggaagagcatctgtagctatccattatgttctaggtgctgtgctaagcaatttcactatgttgttatttcatcctcaccaacaatcctatatttattttattgatcttacaaatgagaaaattaataagtaaagattacatagctaaggaagagactgcagttcaacttccaaattaattctgtttgacttcaagacccataagtagaagaaaggaggagtgcacacatgcatagtatttatgtatatgtgcgcattttcccaaaagctttccgatagatttaaatcaaatgttaccatttgcaaagttcttcttccccagaagtttaactggattctttcaatagccctgcaaagtaacaattacaactacctaaatttcacaaatcagaaaactgataactagaatatgacagagaaccaagcagtaagtagtgtagacatgtgtcccttaatgaaggggttgcgtcgggagaaatctgttgttaggcattttcatcactgtgtcagcatcatacaatgttcttatacaagcctaggcgatatggccttctatacgccaggtgtttggctgcaaatacgtgaatccactttttccagctgttaatcccatgcttgctgccctcacttacttatccagctaacctctgcctgctgctggagggccaggctctggagatactgagaggaagttgacatcacttgcctgatggagcagaggcacctgagctttgcatgtcatcaccaagagggtggtgggtgccaaggcagacatccactgaggtctttatgcttcacctggggagccaagattggaaagggctttgaagattcctaaagctgaatcttaaaacataggtttaccaagagagcaagatagatgatggtattttcagctcaggaaacaacccatgcaaaggcaaagaactgagaagccacacagggctctaagaactactgatggtgtgtgtgtgctatggactgaagggctgtgtccctcaaattcaaagactgaagccctataccctatgtgatggtatttggaggtgggacccttgggaggtaattagattgagatgtggtcatgagagtagggactttgatatgacttggctgtgtccccacccaaatgtcatcttgcattgtaataatccccacatgtcaagggtggggccaggtggagataattgaatcataagggtggtttcccccatattgttctcgtggtagtgaataagtctcaagagatctgatggttttataaacaggagctcccctgcacaagctctcttgcctgctgccatgtaagacatccctttgctcccctttgctcttccatcatcttctgccatgattgtgaggcttccccagccatgtggaactgtgagtccattaaacctctttcctttataaattacccagtcttgggtatgtttttattagcagcatgagaatagactaaaacagtctccatgatgggatttgcgtcctgtaataagaggaagtgatcagaactggcactctcccctccccatgtgaggacacagtgacaaggtggccatatgcaagccaggaagagagccctcaccaggaaccaaatctgccagcaccttgatcttggagttcccagcttctagaactgtgagaaataaatgtctgttgttaggctaccaacctatggtattttgtcatagcagcctgagcagactgagacagtatgctttctccactctagctagatgcaggcctctacctctgcagagatagtgcctggggctccagaggcctgcagtgaaaagagagcccctcttgttccttccccagctgccaaacatccctaaagccggggctcctccaaaccacctgaaatctgcccactagttattagacttgcttctaggagcctggttgcagtttccaaaagagaaagatgccagtgttaggtaatcatgcccatcatcccctaatgccaggcactgccctggctctgaagccagggctgacggatgcaaagaggctctgctgggcaagacactctccggaaggcagacagccgcattttctagaccaccacggttctgttttgtaaaagatttctctcttgtccaattaaaacagaaaattctcttctgttctccagccccagctgccctctacacagtacccagagaggacaacacaatcattccatgcattcaaaaagcagggctttttgcaaggaagagtatttgcctgctcaccactccctctccccaacataaggctcactgttgatgccgcaaatttctgcattagatggctggtagcccatttccactccctaatttcgcatatgaagatgattactgtgtttatgttgtgtgaacagcagtgggccagggaattgagaagcatttgatccatccaacttaagtcttatttctcacacacgtgtctctggctgcctggctgcctaactgctgagaccccggcaggagacaggaatgaggaggcgtgagtcatgtcttgtttgttacaacaggaagatgtcccaggaccttcttgaaggggagatgggggtgggaggatgaatacttcaagttctatgaatcaaatatgaattgaactgtaatctgggctttaagtagatgcctgcataataagtgttaaacaattcatctttctgtcaggctgcagaaagtaatttattcattaccatttaagcaagaagagatcttgtgtgtttaaagagagaaaagtttagcgtgctccattctcaatggcactgcaaagggcccaaactgaaagaaaatgctgaaaggggaaaggaatgaaggaagcttcggagcatcaaaccttgatttggcttgggaaataacattaattctctttcagcatccagttgagaaatcaaacaggcttaatttaaggagtcttcagatgaagaattggtaaattcagtaaagactgatcttactttatgcatcacaagccatccccagctatgtgtaaagttaaaaagtatgcattaagctataatcttttccctttgactttcattatgatttcagatatgtttgcttaaaaccctgaaatacaataaaagcaccatttaggccttttatgattcactgcaagcattttacatttgtcaacatgcaatctatgagccttacatcctcccacaaaaccacaagtaaaatttacaaattttctatataatcttaacacattcaggatgaatcacatgtgctctctattaaaacacgctatatagctaattttcactctactgcatttttttcttaactccatgggacttaagtgtataagcagccatagtaaccaggagaatgcttcagggttgcagccaaacttacgagctggagggaccatatggaggagttttcttggacagaattcagttgtaccacttcacaagtattatactctactcatttgttattgcatagcaaacactctgttgtgttataaagagatggtgtacagttctattttaaaacttagcagaattctctttaaaatgcttgagtcagaaaatatgtctggctaccttaacaattaaaaccaaatctctggcagagatgagattgcaaaaactgtttgctaaactagttcatgtgtgatctcaagcaattcaatgcaaatgacttttaaactaagcagtaaatgagaaactattcaaagatagacaactctgtaagaaaaaaaggagagagcataataaaacattcacatacagatttagcatgttcaagactcagtgctctcgccacagaaaatggagcacactcaaaactgagaatgaccccatatataggagccagtcattctttctaaagtagagaagatgcagggaaccaaattaaaaatgaaacctaagactgccatgggagtgttggcaggcaaagctatctgctttctatgataagttgcaagtgcttatttgaagaggaaacatggcgctctgcctagttctgcatacacaaaggcaatggggtcatatctagacctgaacaccgttggagactcgctttcctcacacatgtaagcacatctgagttttaagaatcccacactcaaacccaactgacaggaccattgcctattaaccaggatgaaaacaatttgtcataataaatatttaaacctttattgtatttttacaaactaactctgtatataaatgctagaaaacttgagaccctcaggaaagaatggcataaatggaaaactgttttctaactacaggtttcttcaagcagaggaatatgacaatgaacagacatacaatggcccacaacaggagttttacttgtttgaatctttcttgagatggaatatagaactttcctacatactggtcagagttttcctctaggatttttgaagctaaagtttagaggaaaatcttgaataatcttaaattgctctcataattctttctgttacacctagcacagattctaagaaatcataatccaaggcattttctgtccacttattaagcactgtctttcaaccacaacaatgttaataccatctaacattactgagtaatgttactcagtaatgagttgccaggcacactgcaataagccctttatatacatgatcttggctaatcctgacagcaaccctctgaggtacagacagttattagtctcattttacaggtcaaagcagtaagtcacactgaggcaggtgatagatctttgaggatttgaatgcaggttggcctgacttcacattcacagttttaaccatgaagccaattggaagtaatacattcctagatctataaaatgatgaacatattcttgaggcagtagtctacccgacaaacagattccattttcctccccacccctgcccataaaagcagtttaataataaataggaagatattatgctttaaaggtatttcatgtcagttgcctttcttcgacacacaatgcaattagagtctgggcggaaatttgattgactggccacatgtgccttaaagcattggaataagcacggaggaggtgaggtagaaggacacttgattggagaacaacagtcgtggatgaataggaaggtgcccaaagtagatcgtggatatttctcctagcttctgccaagcccatcgtggagaaaataaaagttcctcctccttgcaaagaaagaggagagtaaagaaatagctaaaaggtgactttagtgattctctggtattaacagagacatcatagataagaaattttatttattattttttttcttacaggtgatattaagcctaattacagggtctctaattctaagcaccagggagttttatggtagcctagggacttttgacatccaaactaccataaatgagaagaaaatgttaagcttttatggaaagcagagaaggaaaagagaaatgaaattaaggttggcaattattaagtacctgagtgtattaggtatttataattttaatataatttttaaaatattgttcttaagggtatcactaaaatgttatataaaccaccaggtatcaggaatctttctagattaatgctttgctttcttaatgaagagttatattttcacaggaaatatatactagattaacccaggctatattttgaaattttgttgtctacgtctttgaggaactttggtatttacactgcaagacttttagcctagttacttactgacatcttttttattcttgtggacaaggcttataaactccagcatcacataagccattgttcatgaagatccattactcatccctctctatatagatgtatttagctgcgatttgtatagcacatggtgcttagggttcttcaagaaaggtagcaatttaaaaacatatatgtgcaacgtattcaaataaaaaagcaaattcacagatctgtagataaaatgaccacggtgagactgtactaactgaatctacacaaactaaataaaaatgtaagtgaataacacatgttcatagttatatatgcagctttaagatttgggaaaaacttgggcattcattatgtcatagatatcgctcattttcatttgagaaaattccccattaatatgcattattgaacaagcgatgatttgggcccctaggctatatctcatgatgagggtgatgcagatgaagtaaaactttgacaaatgaaaggaaatccagattttatcatcacatcagattagagctgtaagctgtttctaaactcaaaacagttcagatcaatcaggggaatcttgctgacatggaggagcctctgcttctggctctactaatatttgtggaacagtgagcatggaaatgggctttaattctagatcccatcctgggacgggttgtgcattcctgcagcagctggcagggctgctgacacaggactggaacaggagttggaaatcccagctctgctacctactagctgtaggatcttagtgaattagttaacctctttgatttcattgcttgaaatctctaaaactgaaaaaacagtacctgccctgtgcaattcaaaaggctgttcatacatcaaatgaaaatgaatgtgaaggttttctgaaagctgtaaatcagatttgcactgaacttcacagttaacctggcttgagaataaagattaggtatcacaacgtggccctcaaggccccacaccatttaatcccattccatgtgtcctacctcagtctccttgctatctagccacatatcctctgctctagtgacctgaatcaggttaccattttctaccatatgacagctatgtattgtgtgttactgtatttcacgtgcacatctcacacatgtatcattcgatcattgtaactcttggaggcagaatagggattgcttctaagcagcactgaagggtagaaataagaaaattgcacaaatcccatgcacatagtaactggtggagacaggatgtgggtccggattcatctcttagggttgggtcatgtagaaagtttcttcttctctctcccccaggataggtggtaactcccagagggcatgcctacgtgctgtctggtgcagagctttgcacaaagtatgagtcaataaaaatgagtgatacagaaataaactgtgagatgtgagtaacagccaggttttccttgtagagtacagggttagtgggaatgcaagtattatggagtgaattgtgtccctctcctgccaaattcataagttgaagtcctaggccccagtatgattgtatttggagatagggatcttaagaggtaattaaggttacatttagtaatctagaagataaatatggttaaatttaagagataagattaaattaaagttatagtaaataatattaaatttaaataaataaggttgtaaaaggtaattatggctgaagccctaatctgatagaattggtggccttacctgaagaggaagagaaaaatctttctctctccccattccccaccatgtgaagatgcagtgagaaggcagccatctgcaagccaggaagagagccctcagcggaaacccactgtattagtccattttcacgctgccaataaagacatacctgagactgggcaatttacaaaggaaagaggtttaatggagaactcactgttccacatggctggggacgcctcaaaatcatggtggaaggcaaggaggagcaagtcacatcttatgtggatggtggcaggcgaagagaggatgagaaagatgcaaaagcagaaccccctgataaaaccatcagatctcatgagacttatttactaccatgagaacagtatgggggaaactgctcccatgattcaattagctcccactgcgcccctcccacaacacctgggaattatgggagtacaattcaagatgagatttgggtggggacacaggaacaaaccatatcatccaccacgctgacactctgatcttgaacttctaacctctagaacagaaatctctcttagttacacaacctcatctatggttgttatggaagcctgagcagacatcttacactttgggctggtggtggactaagtccatgatgatcctcataggctgaatgacctgatttctcattcctggaaatattttcttcatcatagtcataacagtgatcatgtcaaaataatctttagaacatgctgaaaaggctgcactcttgttctgagctcaggaggtgtgggagagatttacccatgtcagctattacacatagatcccaaaggaagtctcaagtaaatttaaaaaacacattgaactagattaaaatcgaaatttgtgggacacagttaaggcagtgatgaaaagaaaattaataacaccaaatgcttacattagaaaagaatacaattctcaaatcaacaatctatgctcccaattcaaaaaactagaaaaagaagagcacaataaactaatagcaagcagaagatataataaatatagagaaaaaaatcaatgaaattgaaaacataaagacaatagactaatttaattaaaacaaagagctagctctttgaaaagatcaatacaattaacatacctctagctagaatgacaaaggaaaaaaagagaaaatgcaaattaccaatatgaggaaggaaacaagggttgctatggagcattcaaccatcaaaagcgtaataagggaatactacaaacaattctacacgtatacatttaacaacatagataaaatgggccaattccttgaaaaacacaaaccaccacaagtcaaccaatatgaaataggtaatttgaacagccctgtaactattcagataataaatttgccattaaaaactcccccaaaagaaatctccaggaccagatggctttattgaaaaattccaccaaacatataaagaattaataccaattatatacaaatagaagaggtacaatttccatttcatttatatatattttagagaaagagtctcactatgttgtccaggtgtcctggctattcatgaaaggatgactggtgcacatttttttttttcgctctgtcacccaggctggagtgcagtggtgcaatctcagctcactgcaccctctgcctcccggttcaagtgattctcctgcctcaccctctcgaatagctaggattagtgacacactgcggtgctggtttccaattcattttatgaagctagtattactccaaaaccaaaatcaaacagagacagtacaaaacaaaagcaaaactccaaatcaatatccctactgaatatagatgcaaacatctttaacaaaatattgcccaacagagttgagcaatataaaaagaattatataccatgattaactgggagctatttcagggatgcaaggctggttcaatattaaaaaaatcaatcaatataatgtaccatattgacaagctaaagaagataaatcacatgataatatcaattcatgaagaaaaagcaatagataaattcaacactcattcatgattaaaacccagaaaagtagatagggagagaggaacttcttcaacttgataaatctacaaattaaactctatagctaacactgtatataatagtaaaagactgactactttccttctgagatttaaagcaagatgtccacactaacgactgctattcaatatagtactggaagttatagtcagggcaatagggcaaaaatacataaataacaaacaaagaaacagaaataaaagacatatatatcagaaaggaataaataaaactgtccctattttcagagggcatagttgtctgtatagaaaatatatgattaatcaaaatactcctacaactaataagtgaattcagcaaggctgcaggattcaaggtcaatatacaaaaatcaattgtatttctctatactagcaatgaacacccaggcatcaaaattaggaatacaataacatttgtaattactcaaaaaataacacttaggcttaaatctaacaaaaccggtacagaatttgtgtgctgaaaactactaaatgctgatgatgcaaatcaaagaagagctacataaatggaaagaatactaagttcatggattggaagtcttaatatagtaaagttgtcaatttccccaaaatagatatataggtttgtaacaggatgaataataaccacccaaagataacaggttctaaactaaatattgccttataaggaaatgtggtcttcacagatatggttaaattaaagatcttgacaagggggtattaacctagatgatccaggtgagccctacattcaatcacaagtgtccttacaagagagaggcagttgacaattgtacagatattatgcagagattatgatgtaaagacaggcagagattggagtgatgtggccaagggatgtcagcagctaccagaagctggaagaggcaaggaaagaattctccccgagagcctcttgagggagaatggctctgctgacactttgatttttaatttctggcctttagaactctggataatacatttctattgttttattttattttattttttgagacagagtctcactctgtcccccaggtgtgatctcggctcactgcaacctccgcctcccaggttcaagtgattctcatgcctcagactcccgagtagctgggattacaaatatgcaccaccatgcctggataatttttgtattttttttttttaattatactttaagttctagggtacatgtgagggttctatcatgttggccagactggtcacgaactcctgacctcaagtaatccacccacctcgacctccgaaagtgctgggattacaggcatgagtcactgtgtccagccacatttctattgttttaaatgaccaagcttgtggtcatttgttacagcggccacacgaaactaatacaaggtttagcacaattcctatcagaatcccaggaagattcttgtgaaaaaggaactagaatagctaaaatacttctgaaaaagaagaataaagtgggaagaattgctttacctgaattcaagatactatatagctacagtaatcaagacatgtggtgttgggggaggaatatacacatagatcaatggaatgaaatgagaacacagaaacagacacatacaaatatgcccatattcttgataaaggtacaaaaacagctcaatagaggaaggataggcttgcaacaaataataaatggtcttggagcaattggacatccagaggccaaaaataaagaaagaaagaaaagaaaagaaaagaaaagaaaagaaaagaaaagaaaagaaagataaagaaaaatggagaagaaacaaatgaccttaggtcagaatttttagttaataaaagctaactcaaaatgaatcatggacttaaatgtaagatgtaaaattataacactttaaaaaaataggataaaattttgaggaagtagggcaacagaaagagttcttagacttggcaccaaaaaacactatctataaaagaaaaatttggtaaattagatttcatcaaaattaaaaacttttgctctgcaaaaagatcctgtttataggatgaaaagataagctgcagactgggagaaaatatttacaaaccacacttctgagaaaagactagtatctagaatatttaaaaacctcaaaattcaacaattaaaaatattcaaattagaaaacaggcaaaagatttaaaggcacattgtatcaaaaaggataaacagctggaaaataagcacacgaaagatgttaaatatcattaactattaggaaaacgcaaattacaaccacactgagctatcacctcacatctgtcagaatggctacaataaaaaatgacaacaccaaatactgataaggattcagagaaactacatcactcctacattgctgatgagagtaacatggtacagccactctggaagacagtttggcagtttcttataaaagtaaacatgccattaccacaggactcagtggttgctctcctgaaaatgtattccagagaaatgaagacatgttcacacaaaaatctgtacacaaatatttagagcaattttattcataatggtcccaaactagaaaccaacatgttcctccatggatgtatgattaaacaaactgtggtacctccataccatggaatatcactcagcaataaaagaaaaaaattattcatacgtgtgaaaacttagatacatctccagaaaatgtatggtgagtaagaaaagccaagttcaacaggttttatgccttacgactccatttgtatagcatgtttaaacttacaaaagtgtagaaatggagaagagattagtagtttccaggggttaaggaagtgatgagagaggagggaagtggatgagaatataaaaaagcaacaggcgggtggatcatttgaggttgggagttcgaggccagcctggccaacatggtgaaatcccttctctactaaaaaatacaaaattagccgggcgtggtggtataggcctgtaataccaactacttgggaggctgaggtaggataactgcttgaacccacgaggtggaggttgcagtgagccgacattgcaccgccgcactccagcctgggtgacagagcaagactccgtctccaaaaaaaaaaaaagaggactctttgtggtgctgggaatgttctgtaccttaactctgtcaatgtcaatatcatggttgtgatatcacacttatgttttcaagatattactgttagtggaaattgtgtaaaaagggaaatgaaatctatattattttataactgtatatgaatccataattctttcaacataataagtttaattaaaacatatatagttgctattaaaactcaagctggtaattaaacccgatacagaattttgaaataaacttgaaaaaaaaatcaatgtatatgtcaatgaaataagcagagctctagtgttcagatcagagctttttagagggctgtggaatatgttcttctctattgactccgttttccctaaagcacaccttaaacttgagatacttggagggctctgatagccatttttggcatctcaacaatggcggaaagcggaggcaggaagctgggacaccagcacctgctaactgcatgaccatggggacctgcaatatagaaaggtaatggtgtctaccacaccaagttattgtgaagtctgtgcctaggggcacagaacatgactgtacatcaacacatagtaactttttgccaatataaaccttcattgactagtatacaccttccaagagctcctcctaccctaacaaggctgtggatgaaagctctccactcaagcaatcttcattttgtttggggagacaagaatgatgacagccaggacagcttcgagtgtcagggaacttgtttgtggcaatgaccacagggcaaggatgatggagtagggtgggggtggggggagatggatgcggataatgctggggcaggggcatgtacaccaaggatgtggctgaatccttgcaagggtctcgtcctttctcttctgcctgcctgttagtcctttcccagcttcacatggaacagctccttatctcacccatggagtggcctgtttcttgccctacagtttctctgttctaacaccatctgaaatgggctgtagaggatctgcctatttgggatcagaagactgggactgaaccacagcaccccctctcattagctagtgacctctgacaaatctctctccctgagccatatacatgtttatacatgttttacccatatacaaaatgcagagaatgaggctccttcacaaatcagcctgtgtgagggacatgcatggcatcccgtgttcagtacatgtggaccacatggttgctcctgctctcttagacaagaaataaatgccagctttattgaaaacaaatagggcttctacagcaatactgggcacgtaaggagaattagaaagtagctgaaattatagtcttagctaagaaaacactctaattctgaccttatagtagaagacctcatgccagcagaaatctagctttcacacagaatttcaggacaggttacagggctcatatttagccactccccagaaaaggattcggatcttgcatggaggtcggcatcactcacacttctgggtcacctgagggtagcttcggcaggagatcaggaacaaaaccacctccgtaagctgttccagagggttcctcttctagaaaccctgctgtgtccttgcgtggtgcacagacacccatgtcagcagggctccttctgtgcactgcccctgccaggaccacccacagataggaaccctctgcaagttaaacggaatgtatctcagaacctcatgcatttctttctttcatatatctccttgccacattccactaaggatttgagcaaacttacaagactttgcactctaaaataaaaagctacaaataatttaataaactgagaccggggagaatatatttatagaataggaaatcaagactagggcaaagttacattgccaggtgtgcgagctataggcttctacagttacaaaaattgagcagagaatgtgactctgagctttctggcagtcaaagctaagagagaaaaacatggttcacgaattcagtgaacataaggcaaacactcagcagtttttcaaggaagcaaaggtcttcctgacatttaaatctacaagagacatttcttaggtgtgtctttacatagggaacagggagtgctgtcgtgaacagcatcttcgacaacatcctatgaaagttcaggtccagggtttgcatgatttcatccacatatcctcccagagtaacaatgccaccacagttctaggaaacctagatcaaatgtgctgggtcttgacgttcaacttagggataaaacatattttaatcacttaaacttttttaaacatatggtggaggggtaggggagatgcaactacagaagaagaagctcagcacctaatgctgcgaattagacagagggaggtccagtgcctccagttcccccttctgtctccatgattctctattgcaatttcagtacctggtggattctcaaacattcatctcctcagtaagtaactattaagcatttactatgtgccgggtgatacagtttgtatatttgtccccagttaaatctcacattgaacagtaatcgccaatgttggaggtggggcttggtggggaagggactggatcatgggggtggaattctcatgagtggtttggcaccggtcccatggcactgtccgcatgagggtgagtgagttctcatgagctctggttgtttaaaagtgtgtgacacctacttcctacgatctgtctcttgcttctgctctggccaagtgatgtgcctgcttcccctctgccttctgccatgattgtaagtttcctgaggaaagaagctgagcaggcgccacattctgtacatgcctatacatgagaagctggacaggccacattcctgtacagcctgcagaaccgtgagccattaaacctcttttcttataaattatccagtcttaggtatttctttagaacaatgtgaagatggcctaatataccaggtatgtgttgaacaatatggagttagtctcgaaaggacagttatgtccttttggggcttactattagtgggggaagaaatacattaagcaagtaattactggtgtagacaccgctaccaatggtgaagtgccaggattatggaaggggtccatatggggtgttgaattagtcaggtagtgaaggagaaatagacatttaagctgaaatcttaaggataagaactaaacagctagggaaagagtattatgaatagaaagaagagcatgtacaaatcccctaagtcagagaggtgttagaatattccagaaactggagatgtcgggacattccagaagctgaaaacagtatagtgcttggcgggggcagtgatggtgaggggaagaagaggaacagctcccagtggggctgctgaaggaagtggcacacttcattaagggcctggaaagctttgccaaggatttgtgttttatcctaaaataaataggcagatattggcaggtttcaagcaagggaattttaatgccagttcacagttctgatgatcactagctgctgtgtgaaaaaaaaggataggaaggtgacaagagtggagtcagggaggccacagtctttcaaggattaggttttctgagcaggaggtgggggcggcaagagtcttgaatgaacagtaggtcagtaccagaaaagaaaagatgaccacagcgcgtgattctgaaaaaacaatccaattgcctgcaagtgaaccaccgcaagtccagtacattgtgagttggatctgctgaacagcccctgggaaaaacaggggccctgagacagacactaataacaatgcaaagtcattcatgcttttattgttcaattataatgagtccactcatcttggtaataataataatgatgtgtttgaataacataattgcttaatagccattccttaccaccaccaccaccaccccctactattagcacaaaactaaaataacttagagtatttgtcattctaaaagaggcagaaaaaattgcttttctctgctagtagcttttaagaaataaattatatagatgatctagttatttctgtggctttaaaggggaaccttcacttagggcagcaaaatgtataagggttatcctttcaggaaagcccctttcatataaacagaaacttttcttcatggaattcaattagtctctgggcctcagttttgctatccctaatgggggatcagactaatttgtggtttccaaacccaggtatacataagaatgagctaggaaacttatcaaaaattcacctctttgggctccatccatgattctttgtatgtggagcctgagaatttgtattttgaaccacttgcttggatgacctctcaagttccttctgtcttcaaaagtctaggacactgctttgcagtgtggtccacctgggagcttgtcagacatatagactctcagccccaccccagaactgctgaagtagaatttactctttcaacaagagtcctggaagatttggaggaacattaaaatttgagaagttctagtctaggactctacctttcaaatatgcaccttatttcctatagttcaggaaaacttggccattggagaagaaaccaactttctagcagaagcaaagcaactcagtggctgagctttgaatgcaattcggttgtcctttatcagcaaggacagaatgcctctctcacagccataaataagctcagagaaaagaagccgaatcagcaaaggtaaatcaagtcctgaattgtgctggctcatgcatatattgagagacaaacaaaaaaggaagcactaaaatctcctgcatatttctttaaaatatataaatagtagataatcagaggttgacttcaaatctgggtcggcataaatttcttctcaggggcattaaatatcctcctctctttcagcttcctttttcactgggtccttctcatcctgagctgtgttctgcagtttctctcctgtctcagactcaactctcacctattcagctcttctttaaaaaaagaaaaacaggcaaatcaaaataagcaacaacaacaaaaaacctgttataatttcttccattagtactacatggataaatcccaatctctttccatatttacttctctacttgaatttaaactcagtttgcctactgtcttcaggaattgtttcagtaactatcatttagtcatttattccaccaacttttatttagcacctacatagtttggtaccccaagtatcatactatgtgagattaaatccaacctgcctctttcctctgggagctcagagtttattagagatttaaaatttaggaataataataacacctaatagaaagtaagaagtgaagatttaaaagagacagagataaaatggtatgggggaaagccaaagagataaaatggtatgggggaaagccaaagaagataatctttttggctggggaaaaataataatggtttcttgggggtcatggtgggtttgaaatatgcattgaaaagttaaaatgatatgggcaggtattaaagtttccagggctggtactgggaagcaagatacatcaccaggaaagggaatggcatctgcaaaggcaaactggttaccacatatagtgtgtggacatctgaacataacaaagttgacttgagtggcccctgcatgaagacaagtaattcaaaaaatatgttggaaagattgtggagagtttttaattttagtctaagaaatttgatctttattctaaagcaataggagcaaccaataactttctaaatagaggagtgacaaagccaagcctgagtctttggaggaaaatgctggctaagagaattggacactgaaaacctagaggatgggcattgcaaaaggcttggtggagggcaatgaggacctgagccaggagcgggtgaacagtggggaggccatttataactgtggctctgtcttataacttagaccctctttcctgagctggctcagatcaatcaggttagggaggggaggaaatgggcatactataacaatcgaaatctagtagtttcccaacaggtgatggagaggatgtggagaaacaggaacacttttacactgttggtgggacggtaaactagttcaaccattgtggaagtcagtgtggcaattcctcagggatctagaactaggaataccatttgacccagccatcccattactgggtatatacctgagggattacaaaacatgctgctataaagacacatgcacacgtatgtttattgtggcactattcacaacagcaaagacttggaaccaacctaaatgtccaacaatgatagactggattaagaaaatgtggcacatatacaccatggaatactatgcagccataaaaaatgatgagttcacgtcctttgtagggacatggatgaagctggaaaccatcattctcagcaaactatcgcaaggacaaaaaaccaaacaccgcatattctcactcataggtgggaattgaacaatgagaacacatggacacaggaaggggaacatcacacactggggcctgttgcggggtggggggaggggggagggatagctttaggagatatacctaaagttaaatgatgagttaatgggtacagcacaccaacatggcacatgtttacatatgtaacaaacctgcacgttgtgcacatgtaccctaaaacttaaagtatatttaaaaaaaaaaaggaaagaaatctagtagtttcctgctatccttcagtatttttcacctagagctgcttctagctttccctgtggtttcagaaacacagagagattacagtcatgtctgtgtgtctttgcaagagcagaataaagcctatatatcttttcaaattaaggtttttttttccccccactctccagggaaagcagcaacttctccattcatgtaggaatcaaattgctagccattatgcttgctgatcatttatagaagtttatacccctagcaaccagatatgctcagtttgtctccgacacagatggaagaccttaaaaaaaaacaaaaagctcaacctttactagaaacaaatttctaaaagtacgtattaaaaaggtaagttttaaaaacaattcatgcatggatcattccttaaatagaaatttcaagtagtttcagaaaatcagaattaattataatgatcctgacttgcttggttcattcccctaggaatatctcataaatattcagtgtgtttagatttcactggctctgggtgcaaggactccaggccaagcacccaatgtcaattctccatagggtcctccaggtcccacagtcttggaggccttggagatgtcccaaagccaagactgcccagaaagatccaggtccaatccttgagcctagtaaactaaaaataagagcctttactttctcctcttttcttctcttttgtaatatttttgctaccaccaggtggtagtgggtaagtgcatctatgagaaaggtggagttatcaaagtgtaaaggctcagttttgggaaattatcaaaataaactctgtttaatgagagtctggaaatcttaattaaataggatcaatattacacacggaacaaaaccaaaaatacaaatataaatgaggtgtctttccttgtgggaaaagtcagaaagtgtgtattcagttgttttcaacaggaaacaaacttggcttctttcatataagacccaatggtcagcttgaggaatgtcccgcattttcacccacatttttctcagattccaaatactctcatggtatcattttcatgaaaagaataaagcgtactccattagaatcatcataaaatcttagaattttagagctagtaggagctttttcgctttacaaatgagaagactggccctagagaagttgcatggtgacttggtggaatggaccagggcccagcaattccttctccagccaggctttttccgccatcctgtgccaccactgctcctatcaaggagtgtgttgttccatccagtggtcaaccctcagccctcagatgctcttccttggccatagacagcattcacccacagctggtcactcccacacccacacttccttcacctgacttctgggacacagggctctcttggttttcctcctacctcatcatcctttctttaatcacatttactagttccttctcatctccccaagatgctaatattggagttccatggggaccagcctttggtcttctactctttcttagctacagtcattcattcccttgggaaatctccttcagtctcatctccctagtgaacaactccccagtgaagaccctggatttgtatcttcagccgagaccactgccctgagatccagggccctttatctctcttccttcttaagatctccacttggccattgttatggattgaatgattccagtttcccacattagaacctaaattcatgagtcactgacacaaacttgatctacctgtagtcatttctaaccccaattaattgcaactttatcccccccaggccaaaaccattgaagtcactcttgtttcctctctttctctcacattctatgtccaagtcattggctccgcctcaaaaacaccactccttaccatctgcccttccagcatctgatacaagttgtctttttcttgcttagtttcttgaaaatatttctacacatctacatgcttcagcccttgtttcactatagtctcaacttgacagctgaaggggtccttttaaaacttgcattagaacatgttttccctttgctccaaaccctccaaaaccttccatttctctaagagtataagccaaagtccttatgatgtttccaagacgcttacagcctgccctgaagcctctttgacctcatctcctgccactctcctcctgccttactctgctctagccacatggtcgtcttgccatccctgaatattccaggcattctcctgcttcagggcccttgtggtcattactccctctgcctggtcggccctcgcaagatggctgtgtggctcattatctgacctccttcaattctttgttcaaatttctctgtcacacaaagctttcctgaccaccctttcaaaaattgcaccacaccactcctgccttccttgctttattgtcctttatagcacttatttactttcaacatattgtacattttgcttatttttcctatttcttcctatgagtgtaaaaggatcaagaaagcagggattgatgttgattgggttcactgatgggtctgtgtgtataaaccagttccttgcactgttgtattgaatcaatgtgtgttgaacaaataattgtggggtgaatgaatggatgaatgaatggatgaatccaagtctagtttccttgtaatataatatatggctcttcttccagtttcacattcttctgggcttggcaaaatcagttttgaatacaactgctcctagtaatggaagttacgttagaaaattcaatacggcaatgaacttctgccatcacttctgtattgtggcatgtaaggcttgttctctaagagttgtgtatctctccttaagtgctatacttatagttcagatgagctgccactaggtagaactctgggcattcagttaggagctctgcatctctaatatgtctcttcttctccctgcatactgtcctgggccaggcccacatagtctcctgttaggtcacttgcatcagcttctcagttgacttccccattcttagtctttctcccctaattcccacctaaccagaatgatctatctcagtggcctgcaatctttcatgtttagtggccactcctttgtaattataggtagactcatatatagaacagagcatctctatttgaagctctctctttcatcccacctcaaggcagcctgtgaagaagcgtccggaattgagggagctgtagaatgaagttcatattcccctgattaagcccgtccatacacttagcttgaatgccccttttcacacaaaccgtcaagggcttcctattgctcagagaagtgtttcatctaccatagtaatccatgcaccacgttcatgattttttctttttttttttttttttttgccacagtcacatgcctctctattattcacctaatgtttttcttaaaaccaactcatatttataaacttagattcagtttagggaatctaaatcattattgtcatcaccataaactaaaacccaatgtgtcattcattatgaatagaagataatattaaaattaaatatgtagggatttggatgacaaagttatcatgttcatctgtaagtgtgctccacactgtagggaaacactgcctagagaataaagctgcagctcctttacccaatgtgttcaaccctctccatgaagaagaaaattcttaaagttctctgcacgctgttttgcacctcattgactttgctcatgcagttcccttggcctggaatgcctaccccaatttagttttaggtttaaacattttttaatttttattgaagtattacgcataaataatttgaaaaatcagttagtactctaggcttacaacaaaacacagctgcccctccctcctaattctcccttcctagagcatacactttctttttttaaaaaattgtggtgaaatatacataacataaaatttaccattttactcatttttaagtatatagtttggtggtattaagtacattcacagtcctgtgcaaccattaccaccacccatcttcagaactcttttcaccttgtaaacctgaaactctgtgctcattaaacaccaattcactccccactccctcattcccctagtctctggcaatcatcattctactgtctgtctctgtgaatttgactactctaggtacctcatataagtggaatcatacagtatttgtccttttgtgactggctgatttcatttagcatcattatttcaagcctcactcatgtggtagcatgtaacactttcaattcactccactactttcttttgacattatgctaggaattctcttttcctctcttctgaaatggatcctctgtcttctggatcccatgttttcctattctttgttttattctcttattttgatgtggcatatccttcagtaactttttaagtaaggatgcacaacaagcacatattttgagactttgcatgtgtaaaaaaaatctttattttaacttcacatttaatgatagtttggctgggtatggaattctaaattggaaattattttccattcacattttgaacacatttatcaactgacttctaggtccccaaattgcagatgttaatgcagatgctactctgattccccatcatttgtatacgatctatattttttcctttgcaagacatacaatctttattttctattactctgaagttttataattatatgatattgtgtatgccttttatagtgtgggattcaattatgctggacactttctgaggttacaatgtgtgtgtgtgagagagagtgtgtgtatgtgagagagagagagagagagagagagaaagtgcgtgcgtgtgtgtgtgtgtgacagagtgtgtgtttcatatttattcctgctccccgtattgactctgagaccctcaccccacctcaccaccgacctttgttttaatttgcgttttggtttcagtcactgtgctttctgttagaactgctatcatcaaatatctgttgatccttggttgttctttatgaaaaattcaaagccaattggaatttctatgcacatgaatgagggctgttgccttgtaaacttcataggagggtgattgggccaggaatgaaccattgaatgattccccatggcaataacagatttttctctggggcatgccagtctccttgaggaataaccccctttttttccttagtaggggggcattcaactaactacactgttctgaagtctgaaagaggagcaggctaggacatctcactgttcaggatacagactcttcctcaacctcctggtggttggtatggtgcacccatgctctcacctctgcctggcttgtggactctgtccttatattccatttagggtccctctattctctccttcagttgactcacctctgccctccagcccttactttggccccccatggcctgctttcctccctggctagccctcagctcagatatgataaccctaatatcttttcatgaactcatgatttttatctttcacataagaaagcatatgtatagaccacaaaatctatgcagaggacagagaccctttgggaatcaaactccacatccttaaaaccacaaggaagggaaggaaggaaaagtgtccaacccatgccttccagagtttcagacccctgactctaagaccctaagtaacaagagattgcagatgaatattagggagtattttacactgaagcaagccttcaaatggttatatacaaaatagattctctaatgaaacatatcaagatgaactgaacatatggataggttagcagctataaaagtcctaatcttctaattctgtattggtctttccagtgaccagaccccatcctgaagccaggtaggggctgccagtcagtagtcaatcattagcatgcaaaaatgcatcactttggaatttctaaggattttaggatttgaaagccaagaaatgggattaaaaaactaaacatatttcacaatatcacatcaagaaactttcattatggaaaagggtaactctctttaaggtggcttattactagaagtaagatttggggtcttaagacgtcccggggcttccttaacaatcgacttcctagtactttttgatgaagcactgtctctcctttaacactgcctttagtttctaacctaatcttatttggcatgattctctaagacatgccaaacagagctttcaggtttctctgttttctggtatctggatatgtctgactcacttaagaagtttcatccagtgacagtaaccatacccgatgaggtctccgtgttaacagagcttaaatgtttgctaccccctcaggctctttgggtgatgattcaaccaaagggaaaatggcaagtgaaagtgtgtgccccctcccctctgacttcagagcattgcaatagggctacttttaatgtgcttggtaacaattagctcttgaagctgcaacagctgcacaatgctgatgctctccagatgcaccaaacgaattaaatcatgcgataattcaattggaaaattgggtgtaattatggagaatgcagagtctgctagtcgccgcacggtgacttggagttcttgaaacaacagtggtgtgggatgttcagggagtgtgtggcagacacagaagccgatatgggtgtttgcagaaatctcagccccctctatgacaatgatggaattacccaaccctgttctcagttaagagctatctgagtgccactaaagagatctcctctgtaacttcaaagcttctcacatccagaccactcttcctgacatgatagtgggggctgcgcttcaagctggttgggaacgtgtaaaacaagcaaaggctggaatccctaaggagtagtgatacaaatgttaatttaaagagctagttaagtaagagaaccataaattatgataccttaaacattctgttttaactaacacacacacacatattcatacaccaatctcttgatagagggtcatgtccaaggtcaatgtcttctgcgtagcatctttctcacatttatcagacccttaatgcattggttataattttcagtttgggtttatgtgatggggaataagaacctaaaaagatctgaggatcattttcaatagcatcttctcagagatatttatgtttttctttccaaactctgagagtcacccaattcaaaggcttctgtgtgctgttttgcagttatgccctgcacaactcgaggaggcgtcagccacagggtatcccttggagtcgtgtagtgacaacttgagagtcgttctcaggggtcctgcctcatccagcagcaacttcttttgtactggcttgcctttattgaatctttctgcagcattcaactgagttttcatagaaacaatagctctctccttgcattgcaattgaatcttataattaccataaatatcttttagaacaaatacaatagcctcttgggaagtgagcatcttaactggtgagcagaagtgtgcatgtatgcaagggaacagcctataggcctcgagtgtacaggatgctatgggcatcaatcaagataatttacagagtgttctgctcagttctgggaatttttaaaaaaatgatactttacagagggaaagctaatacagagagctggtaaagggaaggttaattaagagagcttctactgtcctgtgaatttagtgatgctcttaaacaaatttctattttattattcactatttcatctatatttttttaaaatagcacctagagatgtcagccattttatctttttagtccacagataaatttctggattccttatcataactccccaggcattatagtcttcagattgggaacccctggcttagggtctgctgcccatagtgaaataaaaaatgattgagcttggttaatgaaggagtaacgagttctctttgcatgatgtgatttaaactcaaagggaagaatgctgaagcatccattaagagccatgcttttccataatgaaagtttcttggtgtgatattgtgaaatatgtttcattttcgatcccatttcttggcattcaattcctaaaatccttaaaaattccaaagtgatgcatttttgtatgctaatgattgactgatgactggcagcccctaggtagcttcaggatgggatttggtcactggaaagaccaaggcaggattagaagatagggactttcagtcccatccctcagcctcagggaaggacaaagtggctgaaggttaagttgatcaccaatggtcaataatgtaatcaatcacgcttaggtaatgatgtttccataaaaactccaaagaacagggttcagagagcttgtgggtagctgaacatctggaacttcctggaggtgtcacacccagagagggcatgggagcaccacaccccttccccataccttgccctacacatcttgtcatctatattctttgtaatatcctttataataaatcggtagacataagtaagtttctctgagttctgtgagctgctctagcaaattaatcaaacccaaagtggcaatggtgagaaccccaacttgaagctggtcaggcagaggttcctaaggcttggacttaagactggtaggaagcaggggcattttggggactgatccctcaaccagtggagtctgacgctgtctccaggtagatagtgtcagaatagaactgaactggaggatacccagctggtgtttgctgcagaacttcctgcttgcttggtgtgcggggaaaatctccatacatgtggtcacagatgtcttctatctgtgttgacttttggcgtgagagctgagaaacccaatctgtgtttttttccaccctcacctggatagtttaaaaaccacaagaaatattgatgctaaagagggaaaaagccaccagtttatccacctgggactttccccaactccttctcccttcgccctgtctttaggtacatcacatcttgtcttttaatttgaccagaccaagaattagactcgagaagctcctcactgagaaactgtgacctagggttggatcgtcttccgttgaaatcatgactttgcctcttgcttacctaacttaacttaatttgaacgttagtttctttgtctgtaaaagggtcatggcaataagtactctaccaagttactgtaaagattaaatgtcccaacatatcccaaaggaccagatatggattggatgctcaataaatgtcaggcaggagcaaagggtggctaaagttttatcagaaggtaaaggaatgggagaagatacacggtatgaggaagaggtgattcaaaatagggagatagagaagatgagaaaaagtagtaaaaatcatatacaggactgggcacagtggctcatacctgcaattccagcactttgggaggccaaggcaggaggatcacttgagatcaggagttcaagaccagcctgtccaacatggcaaaaccctatccctactaaaaatacaaaaatcagctgggcagggcacatgcctgtaatcccagctactcaggaggctgaggcatgagaatcatttgaacccaggaagggaggttgcggtgagctgagatggcaccactgcactccagcctgggtgacagagcaagactctgttgcagtaacaacaataataataatatacagaattgtgtggttaaaaagtgaatttatacacattatgtcactggcatagtccaacagccctgtgagataggatgggatttagtattcatttttcagacgagaaaacaggtctaaaagattaaaagagttggccaaaaggatgaaacagagttggcacttggacccaagttctccttattcccagcccagtggtttgctcataagagtatatgatcttcagctttctgtctttaccacaccatcttggagactccgtgatggctgtcatgctccagatgacctccttttgttctagggagagttatacaaacagtcagtgctccaggaagctgctttgggtcttccaggtctagcatgccttccagtaattattttgagagaaacaatgatggaaagaatccatgaaaaaggaagcttgggtcatacagtttgtgggtaggggaacactgaatatgaaaattgcaactggagatcaccctttgaggttaggacccagagaaaagtgatgttatgagtcctgagttattttattagtggatagaaaattataggaagtgatatgttttgaagatggaaattttagaggtctaatgtaactctccaggcatattgaaagatgttatttccatattcttcttgggtaatcaatcatgccatagcaaattaagagttcttatttttaggcttattagctacacaatgataatgaaaattgattacagccacattcccctccttaagacactgtcagtaaatgaactgagatgccccagaatcaatccatttaaaaaatatactaaaggttgaaaaaaaagccctcatcaattactttgacatctgttaataaagaaaagatgacgaactggctgcttctgtcattgttcgcttactgtaggctaagaaaacaagttcttttgttctaccaactgaagacatcttcaaaagctgaaagtatctgagctgctgaagaccagatattggtttccaggaatataaatcagagaaatgtccaaaaatactaataggaaagtgcaaaaacaagaataagccatgtctgtctctgatttatcaaccttcaaagtctaagaaggttctttggattagactcaggaagttcctgtaggtggaaacttggcaatactggggtattataaaaatgctggtaggggctgaatatggtgacattaacaaactaaggatctagagaaacagggaagtgcaccttttgtgaacctaattaatggttttgtgctttataattttgggaagatgtcaagatgtccaaataaatagcaaataataatacaccagttctgtatgttaccttttccaagccattttttgggggtaaaagaaaaaaatgctgaagatagtatcttacggggtcccacactaacactgaggtttcactaacaacagagtgcatgaggaacgcattcagtcctccctcagattattctgagctgagtccagggaggcctggaaaagctcactcataacaacacagggcaagatgacagtcctctggggcttaggcccatgatctctggactctaacactcatcaccttggagttgtaaggtctcagctcatttcagagatcaggctcatttaaaaaatcagctcacaaacatggattgcctttgaacaattatagaagttctagatactcttcatagaaagaaaatggaaaataaagtataaagatgtgtttctcttttctgaaggattgtgtttaagcaacttggaacgaatccaggtcaaatatcaagtgacttcatacttcatgcatttctctgctgattgacatatggtcatgctagctggagactgggtcataggagaagagctgctgtgctactaaatgcctgtgtccatatttatatccacaaacatctttctctaagaaggtatcattctgtctgagggtcacaagcatatgtatatatacaagtttaaataaacagaggagacactagaacatttttttggtgatggaaattttttttccttgattgcagggctgtgtgtgtttatcaaaattcatgggactgtacactacaaagggtgaattttaaaaatgtaaatttttacattaaatacttcattaaccccacccccaacacacatactaagttcttaaagacaaaagtctatgataaagcccagctttcatggccttattggaatggtagagggactgactgaatgatatgtaagatccgtcctaactctaatattctatgaataattttaaagtatctcaactgaagcactttacatttctatcccacaggacactaatgactgagactgtaagcatgtatttaaacctggccaactaatgtatacatatttcttcccacaggcaggggaacatattgaaagcaaatgctaatatctcaattcctagctaaggtaatagtgctagctaatattcattgaatagttacaatgcacaggcatttctatgtgacatacatgtattagtttatttgatataacaaccctatgaaactgaaactattattgtctccattttacacacaaggaacctgaaacacaaagaagttagatgtcctgttcacagtcaaacagcaagtgagtggtaaagccaggacttaaagccaggtagtgcactctttgtggagagactcagaatccaatgagcaaggagggatcaaaccttatgtactccacagagaggtagacatggcgtttgaagctcccatcacagacttctttatccttgctcctcattctccatcctactactccatccctttttgcagggaaaaaaaactgttcaaagaacaaaactcagaaccttttttcctgcttatataaagggcatggtgtctccctcttctgcttcctcactttttcctcctagaaagcacccatgcaaaatatttaacatagaaaacggcatcagttcaggtaagctgccagcttgaagtaagattggtgaagttgcaaggaggatgaaccaataggtggatcttttgtgatccagtgcccttgccctgccacccacttcttggtggctttaagctaattagttggacacaaaagtcttaaaggagtaacaaggctaaggtggacaagagtgagaagggaagcaaaacctggactgtaaagataacattggaaaagaagggactgagaggcagctgttgtggattagaaagaccacttgactcagagtcagaagtcctgatcttaataccatttgtgtctttcagtagaagcatgactccgaatatgctacttctctgaacctccacgagctcatctgtaaaatggggacagcatagaagggtccttgttaagactaaagatgtctctgaaactgaggtacacattgtaaagcaccgtgcaatatgaattaaaatggcagagcaccaaccaaaggtgcctgggtaaagaagctagggaattgggggatatggacatagagtgatcatgtttattctctttccaacaaaggcctgaattaacaaacacaaaatggctctgctgtcaagaaaaacacagtgggtagatacacttgaaagtcacttctgaaagagaccttgaagaagggatggagaatgtttggggtggacagaaactcctccaagaaagacaatgaaagacaacaagttaggtcacggtggctaaagaggagacaatgatttgttgtctgactctccagctacgatggggctgtaactaatgaggttattctggttacaaaggaagcattcagccccttaatgaaaaactctttggcaactggtgttagggaaagaaaaaacaaaccagcagcttattattagttccacagcaagttaattaatttttgccagtcactttgggtcacttgctggactgagcatctgtctcactcaactgaacagctggagggatggtgggtgtctctgcgggccatgcatgtgtcctgttccgggaggagaagggagagctaactacaaggctgaaaaaacgtgagcttccagtgttcatctgctcctctcctgtccactgtccactcaagccaggccaaaggattgtaattccatgggaaacaaaggaaatgaaaatgcttaaaatgagtttttttctgcctttgtgtagcactcaaatgagagcagtgtaatatggtacaatgagcactatgtcagcctgcagaagtcctagcccaggctctagggcctcctctctcactgatcagcttggagctatggtaaggtgccttaacctctctgggcttctcttacctcacctgaactaactacctgcatggaaagctgggcttctcttacctcacctgaactaactacctgcatggaaagatgttcatttggtatcctttctagcattatgaaatttgagttaataaatatatcttttcttggagacatgtcaactacttgccaaataccaccaaacaacacttccaggaagacagcagtggctaggtgtaacccttattcagggatgggagagcaagggctgcaaaagtgctcaaataaaacacccacacagagttgacctggcttcagaaaatactagcatgatttctaaagatgtgtaatatgcaagtgtgacgagtgccattttatttagcatacatattaatgctagtatatttactttctagagtggattaagtgatacaaattttctgaattatgtgtgctgcataatatgtaatacacatatataatatttattacatactcacccctagaatagaccaagatgctcataaactacactgaagcagggaccataagtttaattccctctttgagccagtttaagctactgtttgggtgctgtgatttttaaatcacttgcatttaattcaaaattatgaagttttcagcaaaacgaaaaaatcaaattgggagagagctcattatctcaagcaaacccatgtatctcactgggctttcagaattgtcctccctcccctccccttaaagagatgatgatgttaaagtcctagatttaatgcttagccagtgctctagaattgtgggtttcctctcctcctgcctctcccagaactaatattcactgtcaagcctgctgcaggtagttaaaaggagtgatagggatcctctaaacccactcaaacaaaagcattagtgactgatagggagatttgcagttccactgggaacaatgctacttaatgaaattagcattgcatttatagacagtatttaggatcccatggtaaatcagtaggtgaggcttccaggaaggcaagtgcataccactgacatcactacacccaggagtgggctgttctgcctggggaaggtgggctggggagatggcatagggtctccatggtgagctatttattgtgacagcactgtccaggttctcaactggtcacaaaacctggtcacacactttctgtgagcagccccttaagaagcgtagggcattctaagcactacgttatacaacagggactgacatttggggaggcaaagtgaatcatccattctctcagggctggggctggaccaaagttattaaacaaataaagagttctaccagcctaccacataaaccaacccatctttacatttgcaacatctgtccccagagaccaggcatttctgagggtctacttcaacacaacagattgtcttattctgtcttgtattgttataacataatactacagaccggataatgtttaaagaaaagagatttattaccatcaatctcttagaggagccctctctccctgcctccttctcttcttgtctgctgtactttaccttctttccaactttctcctttgctctcatctctcccctcccagctctgctgtttctccctttaccttaccctaatatgccccttcttatatatccagtttttaattattattagctagactccatcttttaaaaagtgataccccactttcgggacatgaaataaaatagccctctaatgtgtacaattttggaaggaagccttgtcctttccaaataagccatggatgtgctatggacaatgggggcaccaagagtctgtccagcacggtccttctgtccaccacagtccctctgtccagcatggttcctcttgggcccagggcccagtcagactctgcacccacagacacgcttcttgactggtcatgttaaatcctagcccaggaaatgcagtaacagctctactgtggactgactgtgaacacaaaccagataacgttttaaagcctgagtgatctgtgcccaatttgttcagaggaactggaaacaagaagagttgccaagacaggtgggcaaatatgctgaggttcagctgctccctctcaaggcccctcttgaggaaatcactggtggggacaaggccagcccctggatgccagtcactcaactccaccaatccccaggccaatgcctcacacaattccctcttttttaaaggaggggagtggtggagatggggtgtgatgagaaagaaaagaaggaaagatacatatgaggaagtcagggtgaaaaggggatgagggaaaccaggagaaggtggggagaggaaaagaggagagaaacggcccagggagaggggagaaagggggaaaaaggggtggtcagaagagtgagtagaggcaagcagacaggcagggggccatggaaagctggaatgtgcacagctgttccaaagctcacagctttctttcctttggggtcttcttagtttccttgcattttcataacttatgtctcttcctgaatgtgattaaacgaccctccccaattctaccttgaagtactgcattagccataaaggcatagaagaaggagaccacacaatgccctcatggaaaccgtagtgctccctcaacttctcatttggttgacttctcccatgaagtactcacaccggacatcttcctgggcagttaaaagcacttactctgctcctctctggctccttgtaacatagttacggaaagagactgaagacaccaatacttactgagtgttgtgcattcttctagggattttatatatgttgactcatttaaatctcatcacaaccctaaaacaagatattattattcttattttaaaggtaataaagccaagattcagagaaattaagcatctcaatggaagtcatgcagctacaggaagcagagtcagacgggtctgacttcactgtctccagtgcatcatgctaaccctcctgcttctcctctctacctagttaggggctttctaacaggccagaagattagatgagagaggcattgccattttgcactgatgctatgattgtcaactccaggactcaccacactatctggctcattgcattttcattgaatgatatttccacttctatgattcggataagaatagtttatgtcaatgttgagaggacacgtaagtgtgcaatcactttgaactctaacaagaaaaataacatgattgtttaggtcttaacaggtgatgttctaagacctgtcatatattaatcacatcattctcataaaaatcctataaggtatgactgtctatttgcatggcacacttgagagataaagtcactttctgaagattatacagtaaataaatatggagccaagatttgtactcgagcagtctgactctggtccttgtgttcactctatcctccacttacacacttactaaaatggccaatctgtgtcatttagagctggcatagcagaaaactgaggcccaacagaggccaatgtaagaaatgccctatctgttgaactcttatatgtttatggagtatcatactgtgtcttttatgaatatctgttttgttttattgttgttgttttttttgagatggaatctcactctgtcgctggaatgcagggcagcggtgtcatctcagctcactgaaacccctacctcccaggttcaagcaattctcctgcctcagcctcccgagtagctggtactacaggcgtacactgccatgcctggctaatttgtttgtatttttagcagggacggggtttcacaatgttgcccagactggttttgaactcctgagctcaggcaatctgcccacctcggcctcccaaagtgctaagattacaggcatgagccaccacgcccggcctatcaatatcttttaatacatatgtaactaaaagttgaccggggccagcctccctgccctttgaggtctaaggaagatgagtttgaacctccaattctgcaccttgtgaaagtctaaaattctcatgaagatttcccaaactcccaggtgctcatggccacctctaacttcagattcatgaattgtctcatttgacccaatttcctgtatgttttataataagttgccccaaaagtgaaatttggccccttccttaagtttcatccaaaaggttacttattgcaaggccatttgtgtgttcactataagatttgggtaggagaggtgcaataaatacagagaaagaatttacatcgaggaatataaacaacctcaaggtgatcattaggggtgctggctccttatggttatgccagctcctgcagttacaacaaccctctggtaagaaactgtcaaagttgacttcaccggtcctatcttttccttctcttctttccagaaatatcctctcattgttttttttgcgtaaatatggacatctgtgacctacacgtgaaggcatttttccaaataaagacagcttcctcccaagagaaatttgtgtgcctgcttttataatatcatgtttaacccttgctacatgtttgtgccttatctttttgataaaaatatgagctccttagaataagtaccatatcttttactgctatgtattgctctccaggcctagaagaatgtccagtagatagtagggactcaagagctgtttgatgattgacaataaatcagactgagtcacaaattgactcatagctcagtttgactattaggctaatactccttccactgaacacacttcctaaacaacacggtcttcccataagcctatattcaactaccactgtatttccttaaagggcaattcataaatcagagcagactaaaccacgggcctaatttccccattggaactcctcatattcatcttcctgagcaaccataaaacatgatttcaaaatgacctagtaattatgtcttagggacactgaaaaaagtttaagtaaaaatgtcttcattacacagacccaaaattcttttatggagacacactcttattaatcacttcaggtgagtcaaagtaaacgtaatcagtcaaagctttacaggaaaagattgaaagaaaattcttggtccagaatgatttctctccctcccttcctccttcccatcgtcctccttctctctctcccggattctttcaccaacttttacccaagaaagagtacaaccagtgatggcatcagtgagatccttaagcaatttccctctatagagtttaatctcatggggataatttcaagagaaccagactgtattttggatgactcacagttgtattgtgtgtctaagacatatttgaatatcttctcataacagacaatgaatcaggcaatattttcaactagttttcattctcctttgttcaatgtttaaaaaaaaagataggacaaaatctaactgtgggtatcagtagttgtgaaagtttaaattttgttccatgtaacaatgcaggaaaattataactaataggtctagtctgtaacctattatgtttaaggtcagtatatgtataatgcttctctctagtgtttgtctatatgtcaagtaacaaaacaaagaaacattttgctccatgatgaaaccaccctgaaggggacttagaaaaacctttccttgttatgttgaaacaacacaaggagagggcaaaaagagaggaaagtactacctctaggaacccccttggtttctgggttcctcatttacctctttctgattagtacagctttcccagttcttcccaggtaaaaccttctgaaacatttctcctacaaacagctctgctccaattgccaatgtctctgagagccaggagagatgatcttagcccactaaaatctcacatctacaacaaaagtggcaatgatgaaaatggcattccaaccatggttcagagggttgatttgcataagtctgcttaagaaatttttcatgggattatgaaaaaccaaacttgaaatttgttgtttctgagctctgttttaaaaataatgacgttactaaatacccagttgtccaaactatacaattaaattaatactggttctcttttctttagttaccaaaacagacctcagactcacagcctttttgtactcccacttccatttgggagtaggtttgggtctttatctgtcacttgagtagccccttacctggtcttcttgtggctaccctttcctcatactcttcttccatcactatcagagcaatcttggcaaaagaagggctggtcaagttacccccatatttatgtccttctattgtctgcccaataaagtctgggtttcttaatatgacttttacagtcctcttcacaagctggttctaaacctatctttccatcctcatgctgcaacccagctccaccccaccttgtcccaggtcctactatcaggagtgacagcataatggcttccaactactgaacctttactctgtgctcagcatggtgctatgttctatatagacaacctttcacttcgtcctcacaacttagggctgacatgattactataatagtcttccatatcacttacggaggttcagaacttgtccaaggctgcccaccagtctatcctctggctacattgccctttcatttcccatcctatataaaaatctagccttccattgagaacctggtaaaatacatccttttttttctttttttctttttttttttttttgagacctgctctcactgtgccacccagactggagtgcagtggcaccattatagctcactgcagccttgacctcctgggctcaagtgatcctcctgcctccaccccccaagtagctgtgacattatgcttggataattcttgtattttttgtaaagacagggtttttccgtgttgaccaggttgatctcaaactcctggactcaagcaatccacccacctcagcctcccaaagtgttgggaatacaggcgtgaaccaccatgcctggcctctgctcctctttgaggctggcttccacaacccctgaccctcctaacctcccgcttttccctatctgatgttactctgagcctactgtatttttttcataaaatattgtttaaacttgattacagcaataatcacagcaagtttaatgtgtctgtcacctactccaaaccatgaactatccttacgtcttatgtatttatggcatcctttatcctttatgcctaccatggcctggaacatagcaggtactaaataacttattatagcattaagtaccaggctgtgagttcttggtgggctcccaggtgttgaggttgaaagggggcctatgcaggataggacacagtgacaagggcatggtcacaagaataggcagagctcttggctaagaacattacacccacttcatcattcagaattagagttgaaattaagtattggcctacttgatattgtttgcttcaacagggcttcccctgggacccagaatgagtttaagcctgggattggaacctacgtagacttgctagctttcaaatgattttttttttcattaaagcacacagataagatataccatgaatttcacttacgtaagatcaacctcctcttgttcctgagaagtaatgaaataattaaatagaactaacccttgacctgaaattccctgccccatgtctccctactctcatgcatgggtgtttctcattcccttctgctgtcctgccaccatgccgaagttcacgcaacagtgctcatctctaggccattttcaattaatttcctgagtaaaatttcatgagacactataaaatcttttgctgaaatcaagatgtattacatctactctattccgttagtctactcatcaaaaaagcaatcaactttgtctggcatgatttgttcttttaaaacctataatgcttattgctcataattccattatcctagatagtattttattcctcttaatatttgttccactatattaacagggattgaattactagatggtcgtttctagggtcccttttttttctccccactgctttgaaaatgagctacctaatttgaaactatcaaaaaaatggtattttcttactctgttgagtcatagaataagaaaggagctcccagaagtcacttgatcaatgcccttgtatctcctcaaggctctcatctcctttctaaaccattctagaccagtactcattactcagtgtctcccaaacaggagattctgagacctcttttgataactgaatcaattattcatgtatgaccttatgatccagaagaacttcctaatttctcatccaggactattctgaaagaggatgatgggctgaagacacagatctgagctccaatcttgagcatgccattaactagccatgtgactttaagcaagtaacttattcttttaaaaaaaattaaggtaaaacatacacataaaatttactgtctttactattttaagtatacagttaagtggtaataactatatatataatatagtttctatatatgtatatattcttccccttcaccccccttctcctacctttcccagcctctggtaaccaccaatctactctctatcttcatgagatccactttttaagctcccacatagaaatgagaacatgcaatatttgtctttctgtgcctggcttatttcactcaacataactgtcttcagttccatccatgttgctgcaaatggcaggattttattctttcttatggctaaatagtattccattgtgtataagtaacacattttcgttatccattgatgggcacttaggttgagtccatattttgactattgtgaatagtgttgcaataaacaggagagtgcagatgtcttttagatatatgcatttcctttcttttggatatacacccagtagttgaattgctggaacatatagtagttttattttcagttttttgaggaaacttcttactgttctccatagtggctatactaatttgaattttggtgccctttatttatttctctgaataaattactctggccaggacctccagtgttatgttaaataaaactggtgaaactgggcatccttaccttgttccattccttagaggaaaggcttttaattttttcctattcggtacaatgttagctgtgggtttctcacatatggcatttgttattttgcagtatgttccttctatctccactttgatgaggatttttgtcataaagagacattaaattttatcaaatgctttcttggtggagtcctcaggtttttctaggtgtaagatatgttattgatttgtgtatgttgaaccatccttgcatccctgggataaatcccacttggtcatggtgaataatatttttaatgtattgttgaattagatttgcctatattttgttgaggatttttacatctatgttcatcagggatatttgcctgtagttctcttttcttgtgtccttgtctggttttgctatcagggtaatgctgacctcatagaataaatgtggaagtattccctcctcttcaatttttttgaagagtttgagcaaaattggtattaattcttctctaaatgtttgttacacaacagcagggaaaccatctggtcctgggcttttctttgaaaggagagtttttgttgttgcttcaatctcattactcattattagtttattgaagttttttatttctgcatgtttccatcttggtagattgtatgtgtccaagaatgtttccatttctttcagatttgccaatttgctggcatatagttgttcataatagtctctaataattctttgtatttctgaggtatcagttgttatgtccccctcttcatttctaatttcattatttgagtattctttctttttttcttagtctagataaatgtcaattttgtttatctttaaaaataactttttgttttgctgatcttctgtatttttttagtctcagtttcatttatttctgctctggtatttattatttttttcagtttgggggtttgatttattcttgcttttccttggggttcattagtctacttgaggtctttttacttttttaaaacataggtatttattgctataaactccctgttagcactgttttgtcatatcccatagattttggtatgttgtatttccattttaatgtgtttcaaaaaatttaaaatttccttcttattttcttcattgacccattggttgttcaggagcatgttgtttaatttctgtgtctgtgtattttccaaggttactcttcttattagagttttatcccattgtgggcagcaaagatacttgatatgattttgaattctttgaacttgttcagccttgttttgtggcctaacatatgatctattctggagaatattccacgtgttgattagtttattctgcacatgtattagtctgttctcatggtgctaataaagacatacccaaaactgggtaatttataaagaaaaagaggtttaatggactcacagtttcacatggctgcggagacctcacaatcatggtggaaggcaaaggaagagcaaaggcacatcttacttggtggcaggcaagagagagtgtgtacaggggaactcccctttacgctatgtaagacttattcactatcacaagaacagcaggaaagacctgcccccatgattcaattacctcccactgggtccttcccatgacacatgggaattatgggagctacaattcaagatgagattttggtggggacacagccaaaccatatcagcaaagatgggtgaaatgttctgcaaatatcagttaggcacattagatctagtgtgtaagttaacactgttatttctctgttgattttctgtctggatgatctgtccattactaaaagtggggtgttaaagtctcttactattattggactgtagtctatctctccctttagatctattagtgtttgctttatatacttgggagctctgatattaggtacatagatatttataattgttatatcctcttcttgaatttgacccctttactttatatagtaagttatttgtctctttttacagtcttagatttttagtctattttacctgatataaatatagctgctcctgtccttttttggattccagttgcatggaatatcttttttcaccccttcactttcagtctatgtgtgtcttttgtatgtgaagtggggttcttgaaggcagcatatagctgaattttatttctttatccattcagccactctatgccttttaattagagaattgagacaatttacatttagtgttattattgataataagaactcagtactgccattttattctctgctttctggctgttttaagatcctccctttcttaccatttccctttgtggttaagtgattttctctggtagtgtgttttaatttgttgctttttatttttagtgattctactataggtttttacattgtgattaccataggcttacaaaaacatcttatagataataataagttgttttaaagagataacttatcttagatcacaaatagaagaataaaaacaaaggcaaaaaaaaactaaaaaaaaaattctatactttaactccatatcccccacatgttgaattttagttgtctcaatttacaaatttttatattacctatctctcaacaggttgctgtagctattattgtttttgacagatttgtcttttgggcctcatattagagttataagtgaattgcacgccataattacaatacagtattatgggtttatttgtgtacttaattttaccagtgggtttttcactttgaaatgtttttcttttgcatgttagtgtttatttttgtttcagattgaagaactacctttagcatttcttttaagaagagtatggtggtcatgaagtttctcagcttttatttgtctgggaaggactagctttccttcatagttgaagaataattttgctgagcacagtattcttggaaggcagaatttttttcctttgggcactttgaaaatgtcattccattccttcctggcctacttagaagtctgttgagaagtctgttaccagatgaattggagttcctttatatgttatttcagttttttttcttgatgactgcagcatcctctctttgtttctgaactttgagagtttggttattatataccttggtgtggtcttatttgggttgattctggtgttcatagaccttggatttgtatatttcccaagtttgaggaagttttctgctattatttcttcgaataaactttatgccccttgctcttccttggctccttcttgaacaccaataattcttagatttggtctttggagataattttctatatcttacaggcaatcttcattcctttttgttcttttttctttgactgtgtattttcatatagccagtgtttgagctcactgatttttcctctgcttggccgatttttctgttgagagtctctaatgagttcttcacttcagcaaatgtatttctcagttctaaggtttccgttttatttttaaaaactatttcaatctttttgttaaatttctctgataaacttttgatttgcttttctgtgttatcttggagatcactaagtttcctttaaaatgctatttttaattattggtcagggagctcacaaatggccactttgttagggtcagtcactgtattgttgctttgtccttttggtaggtcatggttccctgttagctgttgttttgtgttggtatgtgtttatatctttgcattgaaagatcagttttttattctagttttctctctctggcctgttttgttttttattggatatatttgcttagcaaatttttacctataggttgctgcctcctttttggttctaagtagcacgtgaagcccaggttcacctctgcgctaataaatagtcaaagtgctgcctgttccaaatgggggaggtctcaaagagattacccagtagtgtgggaaggctggctagcagtttgtgcccagggaacctgtgaaatgtgcctcctaagcatgatgctgctgaacagccacattgatttggcatctcctttggctgagttacagagtagagtttccatggctggagacggcagtcctacctttgcctatgcccatccttagggatatttttccctttagacaatcacaatgcttcctgtgcattaagggaaggacagatctcctgccaaagagaccctaagaaggtggagaagctggttgaccacctcaatttcagtttttccagtgtagaaattgtgaatgaggaaagattttctatgaacttgttgccaggaaaattgtggggtaggggtgtcacagatgtgaaagtctgattctcctactacttgcttagaatattttcacttctctgtggtcctgggacctgtctgatcctcatgtttgaatttcaagtgttgctagtgaaaatctcagtgctttggttttgattttctacagggtgtggggagtaaaaccagcttgcttctacaccaccattttaaaactggaagtctccttttcttaatagaaagcaaatagcatttttagatataaatatttaaagaaatttttagtttttaattacaaaataaatatgtaaaaattctaatgatacaaaaatgtattctcctcctagttccccaaccaaaattctactctccaaaagtaattggcaataatagtttggtatacatgcttccaggacattttctttttttttttttcatttgaattagagtctcagatgtcttttatttagggaggttttttcatacattttctgtttccctgcataccttctgcaggaaatatacagtggcttctgctttttttttttcttttattattatactttaagttttagggtacatgtgcacattgtgcaggttagttacatatgtatacatgtgccacgctggtgcactgcacccactaactcgtcatctagcattaggtatatctcccaatgctatccctcccccttccccccaccccacaacagtccccagagtgtgatgctccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttggcttggttccaagtctttgctattgtgaatagtgccacaataaacatacgtgtgcatgtgtcttcatagcagcatgatttatagtcctttgggtatatacccagtaatgggatggctcggtcaaatggtatttctacttctagatccctgaggaatcgccacactgacttccacaagggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcaaaaattttctcccattttgtaggttgcctgttcactctgatggtagtttctttcgctgtacagaagctctttagtttaattagatcccatttgtcaattttgtcttttgttgccattgcttttggtgttttagacatgaagtccttgcccatgcctatgtcctgaatggtattgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaattgggaatcctttccccattgcttgtttttctcaggtttgtcaaagatcagatagttgtagatatgcggcgttatttctgagggctctgttctgttccattgatctatatttctgttttggtaccagtaccatgctgttttggttactgtagccttgtagtatagtttgaagtcaggtagtgtgatgcctccagctttgttcttttggcttaggattgacttggaaatgcgggctcttttttggttccatatgaactttaaagtagttttttccaattctgtgaagaaaggcattggtagcttgatggggatggcattgaatctgtaaattaccttgggcagtatggccattttcatgatattgattcttcctacccaagagcatggaatgttcttccatttgtttgtatcctcttttatttccttgagcagtggtttgtagttctccttgaagagttccttcacatcccttgtaagttggattcctaggtattttattctctttgaagcaattgtgaatgggagttcactcatgatttggctctctgtctgttgctggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttcacctgcctaattgccctggccagaacttccaacactatgttgaataggagaggtgagagagggcatccctgtcttgtgccagttttcaaagggaatgcttccagtttttgcccattcagtgtgatattggctgtgggtttgtcatagatagctcttattattttgaaatacgtcccatcaatacctaatttattgggagtttttagcatgaagggttgttgaattttgtcaaaggccttttctgcatctattgagataatcatgtggtttttgtctttggctctgtttatatgctggattacatttattgatttgcgtatattgaaccagccttgcatcccagggatgaagaccatttgatcatggtggataagctttttgatgtgctgctggattcgttttgccagtattttattgaggatttttgcatcaatgttcatcaaggatattggtctaaaattctctttcttggttgtgtctctgccaggctttggtatcagaatgatgctggcctcataaaatgagttagggaggattccctctttttctattgattggaatagtttcataaggaatggtaccagttcctccttgtacctctggtagaattcggctgtgaatccatctggtcctggactctttttagttggtaagctattgattattgccacaatttcagatcctgttatttgtctattcaggattcaacttcttcctggtttagtcttgggagagtgtatgtgtcgaggaatttatccatttcttctagattttctagtttatttgcatagaggtgtttgtagtattctctgatggtagtttgtatttctgtgggatcggtggtgatatcccctttatcattttttattgcgtctatttgattcttctctctttttttctttattagtcttgctagtgcttccaggacattttctatgcctaaattacatatacaaaccaaaatgaggctataatatgcatactgtttaacaacctacattttcattaaactatatcaatatttttccatgttagtgtatataatatttatttaacatttttaaaaatatacattgcttttgtaattaaattttttatggatccatcctaattaatttggccagttcactgttgatgcacatttaaagcagattctatttttttctctattccacataattctgacaatgaactataataatatttaaacagttattgaaaatcaagtgaaggaaagagtgacaactgtgagatcctgagagtttccccttaaaggcagcctgcgtcttccttttcctttgcccccaaccttccctaccagcaaaacctgatgggacagagaccagggggaggtccgaaccctcagtaccttgaaggataggatggcccaggggaacatctttccctcatccagtgtgaaaatcacctgtgaatttttttttcttagatactgaaagttacagctggatccatgcctgctgcttacatgctgtatgtcttcggacaattctttaccttctttgcagctcagtttgtttatttacaaaataatgagtatacctttctgagtatacctcttgctgctgttcattgattatttcctgtgtagcaaacattgtgccaatgtttgctttagtgtatgtgcaatgtgagctttagtgtattattttgtttaattcttattaaatccccttgaggtaagttttataaatcttattttttaaaaattttgttgtagagatggcacccctctatattgaccagactggtcttgaacttctggcatgaagcaatcctcctgcattggcctcccaaagtgttgggattacaggtgtgggtgatggcacctggcctgaatcttattttttaattcagcttttagtcttattattgatttgtaagagttgtttatatattatggatacacttttttatgcaatgtatgattcacaaatttttctcccagtcttgtggcttgatttttcattttcctaatggtgtcttttagaacacaaaagttttaaattttgatgaagcacaatttatcaatgtcttgcattgattgtgattttagcatcatacctaaaaacgtttttccccacccaaggtcacaaagatgttctgtcattttcattttcttgggtagaaactgtatacttttggctcttaaattctgagttaatttttgtgtatggtatgaggtcatattctaagttcatttttttgtaaatgaatatccaattattccagcaccatttcttttacctcaggcacctttgtcaaaagtcagttgattataaattaaacatgtatttatggactctcatttctgttccattggtatataagcctctcctttctttaatatcacactgtcttcattactttggctttatagtaagttttgaaatcaggtagtagaagttctccaaatttgttccttgaaaaaatattgtgtctattccaggtcttttccatataaattttaagttacgaaataaaaaagcctactggaattttgatagcaattacattaagcttattgatcaatgtggggagaaataccatcttgaagctattgatattttcaattccaaaatgtaatgtctctttttttaatttatattatctttaatttcagcaatatgcaatttttaatgtatgcagcttgcacttgttttgttaaatttttttctaattattttctctttttgatgatcttgtcagtggaattactttcttaattcccttttggaaattgttgttagaacatagaaatacagttagttttttaatattgattttgtatctgtggccttggtaaattcatttgtttgttaaattagctttcattttttgtgaattcttttgggattttctacctaaaattcatcttatctgctaataaaggcaattttattttatcctttccaatctgtatatctgtatgtttttagttccctccctccctattttatcctttccaatctgtatatctgcatgtttttggttctctccctccttccctccttccttcctccttccctcccttcttccttccttctcccctcccctcccctcccctcccctcccctcccctcccatcccctccccttcccttcccttcctttgtattggctaggctcaatcactacaagtgatgaaagcaagtatttttcccttattcttaatcttggagacaagcttttagtctttcattattatgttgtttgttaggtatgggtatttcacaggtgctctttattaggttaaggaaattaccttctattcctagtacatagagaaatttgatcatgagtggatgttggattctatcaactgccttttctgtgtttattgagatagccaaacggcttatgtactttatcctattaacatggtatattacatcaactgattttgggatattaaaccaaccttgcaatcctaaataaattccacttggttatagtgtatcatccttttcatccgttgctaaatatggtttgtaatattttgttaagaatttttgcacccatcttttatgagggatatcgatcaggggttttctttccttgtcacatctattttcctagatttaggatcaggggaatagtgagtggcctcatagaatgagttgggaagtattcattcctttatttctaaaagaatatgtcaataattggcataatttattctgcaagtatttggtagaattccccaatgaaggcacctgggtctggacttttcttttggggtagattttcaattactaattcaagtctttacttgttataagtctattcagattttaatatttcttcctgaattggttttggtaatttgtgtgtctctagaaatctgtcccttttatctaagttgtcatatattgtcatatctaaggtgtcatatattggcaaaaggatgtttagtttcccttacaatcttttaaattctttagggtcaagagtgatggtccctcatttattcctgaattagtaatttgtgtcttctctctcttttacttgattaatctgaataaaaggtttatcaattttgttattcttttcaaataacaaatttttgggttcaatgattcttactactgcttttttatttcatggatttctactcaatctttatttcctttcttctgcatgcttttacatcgcatgttttcattgatttttctaatttcttaaaataaaaacttaggttatagatttgagactttactctttttctaatataggcattcaaagctatacttttttttctctgagcacttttaaatttcatctcataagttttaatatgttttattttaattttcattcaggtgaaatattttctatttcccatgcaattgattttttctttgatgtttatttagaagttcattatttaatttcctaatagtcagggatttctgagatttctttcagtggtcaacttttagtttgttttattgtgattgaaggatatactttttaaattttacttgcataattttaattttaattaaatttaaatttaattttaattttacttatataatactgattttttacttgtataattttatacttgtataattttatataaattaatgactttctttatggcctggcatatggtctatattgaagaatgttctctgtttacttgaaaggtttgtattatgtagtcgttaggtggaaaggtgtttatttgtcagttaggttgagttagttgatgttattgctcaaggcttctatatccttctttatccagttgttctacttttgggagttattgaaatctcccactataattgttgaattgtcttgtttcccctttcagttctaacagttttgcttcatgtgttttgtggccctgttgtttgatgcacatacatttataattgttatctcttcctggtgaattgacatttttatcattataaaatatactgtttagtatatttttgtcttaattttatctgatattaatacaaccactccagctttcttttggttaattgtttgtgtgatatctcttttccaatccttttactttcaatctatttgagtatttgagtctaaagtgtccctcttctagaaaacatacatttcatcttcctttttatgtagtctgacaatctctgatcttgtgtgttttttagttcctctgtatctttcttccttttttttcagcactgaatacttttcagcgtaccattttaatcgtttatttattttctttcattttttcctttgtttcttccttgctttttctttctttcttttctctctgtttctttctcttacattttggagttattttcctagtgattgctctaaaaattacaacatgcatcttagtttatcacagtctatttaagattaatattacctaattttactaaaatatagaaattttgctccaatctaattctactctccatttttgtgctgttattgtcctatatacatctatatatgttatcaacccaacaatatagttttataattgtggatttacataattttgtcttttaagatgttaagagaagaataagaaaaaggttgtttaagccttttatattaacccatatgtttactatttctagtactcttcatttctccccgtggattcaagttagctcctggtatgattcatttcagcctgaaacacttccttagtatttattgtaaaacaggtctgctggcaacaaattctctgtctttgtttttctgggaattatttgttttgtctttatttttaaaggttagttttgcttgatatcaaaaacttgttgacattttttcttatctttcaacatgttggaatatgtgttccactgtcttttagtctttcatgtttcaaataagaagtcagccattaatcatttcaatattccctgtacatgataagctattgttctcttgttgtttaagatctttggtggcatttaacaatatgatgatgatatgtctagatgtagatctcattgtatttattctaggtgggattttctgaggcacttggatgtgcaaattgatttttttcaccaaatttggcaagttttaggccattatttcttcaaaaaaattttgccccccttttcttttctctcttataggacttctattaaacacatattataacacttcatgttgtcccagaagtttcttaggatctgaacatttttcttaaaacatttttctctctgttctttagggtgaaaaatttatactggcttgtcttcacattttaaaatttcttctgccttcttaaatctgctgttgagctggtctagtgaattcttcattttagttactgcactttccaacccaagattttccattttggtttctttttaaaagatttttctgtccagtcaaattctcagtttttcagttattattgctcattgttgtcatgctgttctttatttctttaaacttttttgttgtttttaattgaatatattcataatagctacttttaaggttttattttctaaatccaatagttgaggacattcagaaagttttattagctttttgttttcttatgagtcacattgtattatttctttgtatatattctcatttttgttaaaactgaacattttagaaaatgtattacagcaattctggattctgatatttccctctgaagactgccataggttcttttcttgttcttatagttgttttattttgctatctttgttagttttgtttcttcatttagtaacttggctgggttctatctgtgaagtctgtcttccctgcagtgtgtgtaggctgatgtctctattgattgtttttcaggtgcttatttttatttttacgttttaataaaaaagagatggggtcttgctatgttgcccaggctggagtgctgtggctattcataggcatgatcccactactgatcagcaaagtagttttgacctgctttgtttacgacatgtccagttcatccttttttaggcaacctggtagtcccctgctcctgtgaggtcaccatattgatgccaaacttagtgcagacacttatcagcatagcacactacagctcagaactccggggtttaagcattctttctgcctcagccactggagtagctgggactacaggcatatgccaccatacccagctgttttgatttttaagcctggatttctatgggtacttcctatgttccttagtgattggcaaatgtttttacagatgatgggcttatattccttaagtcagtaagacttctgtcatctgtcaatagatctgtgtataggtaagataatgtgtttcttttcttgctttgcgtatgtcaggtcttaaaaatctggaggaggaatgcactttaatgttcaggccatttagttcttgagtgtctgctctgcatatacacaaccgtaggattggctaaaaggctgtggctacctcagactctgtcctatctccattgggaatatatgcagccataaatggagcctcaggctagcagagtagttctttccctatcccagccccatcccacttccctctgagattatcactttcacctacaacccccctgggcatgtacattacccccttccccccctcaacctcatctttatttcactccatctagacatgtgatttccttctgaaggacactgagttttcatcctgtctttgatctcaggagcacagaacccagttgatccagcttactttaaaaatattactctatttaattatttcctcattcccacaggcttctggaattcacctctcttatcaatttaggcaactaagcttgtttctctagcaagcaatgtttcctaaatttgtccttatatatgtgtcacacaaaagaccaacaggtgtctgaatttgtttttattagtagggccagcccatttagtctgtatgtcagccaatcttgctggttctgcctattctgtttccagagttgttgatgggaagaatactttaggcttttgatggcaaagagattgaggagggaagaggaagagagaacactgggatagaagagagatggaaaagtaacagacagcaaaaatgagagaaatgaatgaagcactcatttgagggctgggcaattatggatgctctctagagaactgcctagccaaaagcactgagactcctgtcttctctcaaatcctcattttgaaagcattaattattttgatgactcttttttttatattcccagtgctctgacctattttacagttaaaggctccaaataggatataatctgtgtttagagcttggacatgggagagatagcagtgactgcactgagttctcccacactgcactgcctgggtacataccactatagaatgaattccttttgggtatcaatgtgttgtcttaataaatgaagaaaaataattcttaggagaggaagattatttaatctacataatgatactttaataatactttatgtttgcttagctgaagcaatattggatataaggggattaaacaggggcatcccaagctgttgttgcagaagtaaatttaatgtctatctactttagtgtcatggcaatatataaccgaaagactattctcattgtaggcaccttgcctaagaataattcaccattcttagcaaaatatttcaaatacctccttcattgcctctagatgcaacaaatgctgatcacaacagaaagaaggaggttgccaaatataacacaaatacaagtcatggtgctccagaaaagagacacagggagctgccacactatgcatgctatcagattcattaacaagtaaacacagcatctcgcatatttccaaatactaacagcttccataagaatcaactaggaaaggagtaatactcaacatatgtacttacgagtaatactcaacacaggtactttgatcaagcatgaaggctgggcatggtggctcacacctgtaatctcagcactttgggtgaccgaggcaggaggatcacttgaggtcaggagttcgagaccaacctggtcaacatcatgaaaccccgtctctaataaaaatacaaaaattagctgggtgtggtggcgcacacctgtagtcccagctacttgggaagctgaggcaggagaatcgcttgaacccaggaggcagaggttacagtgagctgagatggtgtcactgcactccagcctgggcaacagagtaagactctgtctcaagaaagaaagaaaaacaaaaaacaaaaacaaaaacaaaaaaaatgactacgaatcaccagtaaggatcccaaagcaagatgtagaaaattcaaagtggaccataatgcattagataagaataacctgaccacaacctttgctatgcaggttaaaggtcctcaccaatcacttagtagaaagagctggacagtgagatctgaagccctgtgtattctttcaagcttgctgcacttccatttgtaaatgtgcatgattactgcctcaggtgagggctcctcattctcagcaaatcctttgtcatgtccaaaatttttgagtttaacccaccccccattcccagatatgatgttatatgtgaatgcctgggcccagtaagcctgctttgtaggatcaagatccttaaatcaagacagagcagcaccacttgcttcaggctgctgtggctggttgactgctgtcaggcagggctgtgtgttactccactatgccattttcctgtttacagaatggtctcttgtgcattattttgattgatttttataacaagtcaggaaagggagccacagaggtaaaatgacccccagatccctcttcaacttacgttgaaccagtctttctctatcttgaatgagtaaagattatctttccactctaagtagaataattctgtagttatccccattcaaaagaattttattttattctttcttgcaaggtcccggctttctttcaaatcccttcaagcataaattcagagtggttcatgacttttcttaagcagagcccatttttctttaggatgtgtcttatctgtattatttgatatatagaaatcagtgaggctaaaaaactcagataacattaataaaagcttcttaatacgaggaagtaaggaaagcaaaaagacagctccacatacttttatagatgatctagtcccacccactcaattcaccaatttagagactgaggtctgatgtcacgtgtcagccaacgccaacccagcactcaactctcagcacagggctccttccatttctaaaagggcagggaaactataaacagcttagctggtggcagtaatcgattccacttcctcacatggattgcatctctgtgtggccgggatggctggtaagttttaggctgtggctgccttggacagcactcctcaacctggccatctgcaaagaagacacaggtgacagtgggcttcccaagacccctctgaagacacggcacttccagacaccccaattgatgtaatttggttgtgtcataggacaaagcggacaccccagtatcactggtatctgggagatgccccaaacttctgaatgtactgccagatatctaatgagggtgagtcttctgtaggcacaggcctgggaagcactgtgctttaagaagagcttgtcataatggtaagaacataagactgggtgttcaaaaactggaattgaatatctgactgcaatatactggctttggagatttgaacctcttacttcatttctccgagcttctaactataggtcaagaaatatttaatgaatgcctattttatatggaggcttaggctaggctcttggaacactgcaatgaatgagaaagactcagcttcctctctttgaaacttactagttcatcttcgattatcatctacaacttagaaatacctatcttgctatattataggaatcaattgtgactgtggctggagaagcactttacagtctgcaactcttgccagtttcatttgggacaggaaacggggctcatttatgagccagttggcagctcaccccagcccctgtgtgtgtagtttcactgcctcctccaaccaccctagacaggagcttcatagaaaccgagcccttggcagctgttacagcaccttcaggctctctctacaggtaaagtagtagccttatcccaggtgccccatttctagcaatgtgccttctccaggaccctccctggaggtgctttcggtacttcttgccttacaagagccaaactcccagatgcatctccttatttctggcctcagctccttgtccccttgggtatttctttcccatttcttgtccatagagaagtttattctgtttatagtggaggagacagtttaaggactgcatttccagccagaattcattggataccttcaatatatgtaagtcagtttgtcttgaagtccccatcagtcctctgagccttgttccttctagaatcgtgccccaggtaagccctggccctggccctggccccaagagcatgtcaattttcctgccgacttggtcaaggccagctgtgttagtatcctattgctgcagtaacaaattaccagaaagtggggggctgaaaatgacacaactatattatcttttggttctgcaggtaagaagtctaaaatgggttggtggaactgcgttccttctgaatgagcttctgggtagaatccttgtcctcttctttcccagcccttagaggctacctccattcttcctctcacggcttcttcctccatcttcaaatccagcaatgtgacctccttaaatctccatctctctctgacctgtgcttccttcttcacattccttctctgacactgactctcctgcctccctccttcccttttaaggtcccctgtgattccactgggtcaacccagatcatccaagacaatctcatctgcaaagtcccttttgccctataaagtaatatcttcacaggttctagggatcggggcatcttgttgggggctggaggaagcattaatttgccaatactagtttttatctctatgctgtgatccctcctcaggctcctgaacctctagaatctaatctgacaagttcagctgctgtgatgggccaggagttcctctttccttcctccagagaaaacactagggtttctggaggcaatgatcctatcttggctctgtggtacaaagtgtgacctgaatcactgggctgtttagattccagaaaccatggccaaaccttaggaggtgggtctctctccctgggctggtagagatttctgtgcctcacaggttttatgccaggtatttggccatcatttgtattggatatgcctaagccttgccttagagcaggaaatggccttattgaccatctagtctaagatcttacctaacagatgaggaactcaagacccagagaggtaaagtgatgctcctaatggcagagctgggaccagagccaggcctctgctcccccagccagtccttctttccttgctccacatgcctatctccctatctccctgtgggcagacccatgaggttcagttaggaggggttccttgttcactggacatctataatccatcccaacaccccaggaaaggcctgtcctgatggggaggtgaacaatacttccctggaaggtccacccctgaggcaagcatgccactcattaaggcaacccttctcaggagtccaagctccagctgctagttgtatcagaatcacattagatggaaagaatcacacatcacaacttgttgatgtgattgctcaagggtccagatctaagggccagggactgtattgcttgagagacgagtgacgtgtttctacaaacagaaccagagaactaatgtgggctttcctggtgaattccaaaagacgggcagagatagaaggccacacatccacccagtgaccttagtatgatgagaaatcatgctcaaatgaaaagcataagcacccagagccctcttggtaagtctgcaggggcaaaaattgaactgaagtgggtgtgtttctgtactcttacttagatgctgggattggcccctgggtatattcctgagcctgctgcacacttattttccacatttccctcttcctacccttcaaggataagccaagcagaaagaggtagggggtggggtgctctggacttgggagcccatgccagctgccaatgtgctgtccctaggcaggcaggcaggaaaataacctgcttgtctgtctgcttgcctactgcatcctagccaggatttttggctaggcttttttgactgtggttgtggcacaaaatagttaacgtttttcccccaaagtctaagataactcaatagaatagtctcgaatgataattttttattcctttgtattaaaaaaaaaggatagcatgttttatcttattataaaaaataatatatgacaatgaactcaaatttggaaaatagcaaaagcaacagaaggaaatgaaaatcactaataattaatttacctagaaataacttctgctactgtgttggtatatttccttacagactttatccttatgtacatagttctttttttcttttacaaacaatttctactacacacattctttaacttgctttttgaaacctaataataagttccaaatatttccccatattattcaatatttttacaatgtatatgtgtaattgtggtataatattttaggtatactatattttatttaactaattccttattttaggcatttaagttatttctagtttttcaccatcataaacagcaccaagatagttttttagataagccagtaggaaatattggttgcagcctgcatcttaggtatgtcagttgaaatggaaacaagaatttctataaagatatatctcgactttggagagttagtgttgtcagtagcattcaaccaagaagttctttctttcctctccaagtgatgtagattctaagaaaagaggataaaggtctttgaaacttaagagggaacacaggggctagagctgtccgtgaggccttactggtgaaggagtccctggccagcacagcccatgcaatgggaagagagtggaccaggagaacactgccccaaaaatgctccttaaaggactggaaaagggacagagacatcaggaacgttggggccagggtaagatgacttagcaaacaaggaagtctgattccatttatagaggacagatgtgtggctatatttattttatctaaaagagaaaagaaaacctttgctaataaatagtattatacagttaggcacacaaaagtgcatataattgatgaatataacatggtaggagtacatgctcaaaaatattttaccaatggggcatacaacagaataaagtttagaaaccattaacttaaagtagaaacttggccatgaacagagcagcacaggaagggagctctggggagctgcagcctgtgaatacctggcaagggtagtcccagtttagatcatccggtttgaaacaagtgaaaagaaaggaatattgttctgcccatgagtgtgtgtctgtgtctgtgtgtgtgatcagcggtcactccaattacatttttcttctattccagttttcttacctctcctgactgtttccccaacttcaacatttttctaaaataagaggtttgctaaaggttgttcctacagacaaactgaagtgtgtaattattgactcccattaacgagatgaacttcagggtggccactgaaccctgtgggccataaatgccggacttgaagcctgcactagcacatttcactctgcagtggtgcagagcagggacaatggcagcacttttgggagaaagatcagtgattctccagctctgaaggtcgtccgtctccatcttactgacagcctgtcctcatctatgaggacacctcctacccttcctcacctagggaacttgctctccagaaacagtggcaaacccatacacatgtaggtgtcagaggtccccatcaatcagcaaatgaagcctgaactcagaaatgggtggctaatgatgagtttcactgatgaaggaggaaatgctgggcagccctttatcattccatagcctatcaatacctcaaaagatcaagagtcagaggtgagactcagagtcagctcagccacttatttgcagcctgcagtgactgtgggtgcaaaggaggctatatcctgagagaattttcccgcaaagtctgcacttgcagttcaaaaggtgactcaggtccctgctactcctgggatacagttcacttgagaggtgttcagggacccttttaagaacatggcaaacttttggggtaggggaagaaattgaagaaaggatgagaaatgctggtatgaatctggtctcctctgaacctgtctaatcagacttcctgaagggtctaagaattcacagtccacagatgcatgggatccacatgccaacccagacgcagggggagaaaaaccaaggcatagtgggctaaagagtggcccccagggcatatgtccaaatcctaacccctgtgtacctgtgaagatgaacttaattgaaaatagagtatttgcagatgttatcaagcattccagaatgagatcatgctggacttaaggtgggccttcaatccgataacacatgtcccgttaagatacagatttcagacaaggacacaggaggtatgccatgtgatgacagaggaagagtttggagtgagacatctacaagctaaggaatgccaaggattcccggcaatgccagaagctggagtggggcatggaaaggatttctcttcagagcctccgggaggtactaaccctgcagacatcttgatttcatactcttggcttctagaatgaggagagaatgaatttctgttgtttaagccatccggtttgtaagaatttgttaaaacagccacaggaaactaatacacaagggtacaacaggagtgcatcaaaaatttgaatgaccccattctgctgttgcaataccctagtcatgtgtgaaagcatccttagccactccagggctccaggatggtgtttcaccatcttttgaaaatgaagccatcttgatgaacagaagaacctcagtagcagtgctgcatccagaccctccaccaaaagcacaacaaaacaaagcaaaaacctgagagtcagaggacggggagagagttgagctgttccaggaagaataggagcctcctcactgtggagtctgcttccatcttttctgcgtgtgcccatgagtgaggccctggggagagggctctgcagatgggctgagagtgtgttttccatttttaagccaggattcatgctacagagtaaaatcttgccttactggagaagaaaaatacctttgactatattccaaaacaccggaagcagttagacatcaacatggcccctggcacttcttaaaaagtcacagaatgcctccatctgatggttcttcaagattttagtaatttataatattatgttccatcaaaatgatcactttttattatcttgctgctctgaattgtatcttccttattattctcagctacagaggccataaattaaaaccattcaggatttatacacttatagttcattatctttgattggtatcatcttgctgcctttttctggtccttctataactgacaagaaatattgcaatagcatctaaatactatctgacccatgaatattgagttagaaaacaaactagtgactacataatactaaaggcaacccatccccacttctcatcttcaccaccagcaccctttctgccaaaatgaccaagaaactgagactctaaagctctgggattaggattggaatataggacactgcttggccattgtgcagaatggacaggttgttttctcttcctgaaccttcacttctttccctgaaggtcaagggagtttattacaataggctgcttcatgaggaacaacgctacttcagggaaaggtagtgttataaataactgactacaaaagtgatgagagacgcactcctgaaagctccaaacacctctcagtgccattactgaagcagtggattttctgggagggctgggaggctgacctcctcatttccgtgactgatccatgctgtgtgagtacagaccactccattagaccccagacaaattagcagaagtttctgacagtggtgagcctctcttaagttatgtttggatgtgtccattcatgaaagagcttggtaaaggagactggtgtatccacagcagcttttgctatggttgttcacaccaccatccttagtattgctaactactacctgatgctaacagtgatgacttttcagagcaatggaagttgacaacatttactttaaaaaaaacagatattccaatcctgattcatctaatgggaaagtttcacattcagtgtgtgcactgacccttgggatccagcttcataaaaactaaaggcattgatatgtttccatgctaaagaatgctgagaagtaaaaatttatttattttcttccttccctcctctcccccccttcttttttgttttgtcatagcactcagtgtattgtgcgcatgtcagcgatcacaggtggaggaggagaaacaggtcaccaagtgaaatgtacaatttattggcactgtttaaaaacatttctttaaagcacaaactttcaaagttatcatgtgtgactcagtaacatctgtggaatttacaaagaacacaatttccacttgtccctgtctcttgatctcactgaactgtaatcacagttccactcctggaatataaatttttaaaaaacctgtaacgaccaaaaaaaatgtttctagaggtcaagtgttggaatctggagatagtcctaggggtggctgaatgggagtaagtctgaatgggagtaagtcaacagtattacaagcccagctatgcctcagaatcatccaagaaacttatgaaaaatgaaataaaacagatttctatgaaaattgaagctgcaatgggatgctgtatttaattcaccagacagacaaaaaaatacagcctgacaatagcaatactgatgaggatgtaaagccatggggaggaataccaatatattactagagggagtacaaattggtgtaaccactttggaaaatagattggcattacccaatgaaatggaagatgttctgaccctctcacccagcaattccactcttagttacatgctctagagcaatggtccccaacctttttggcatcaaggactagtttcttggaagacaatttttccacggatggttttgggatgaaactgttccacctcagatcatcaggcattagattctcataagaagtactcaacctagaacccttgcatgcacagtctgtgtgtgtgcacagtgcacaatacgattcacgtttttataatcacaataggattcatgttcctataagaatctaatgcggcagctgatctgacaggaggcggagctcaggcagtaatgctggcttgcttgctactcacctccagctatgcatcccatcctaacaggccatggacaggtaccagtcttcagcctgggtgttagggatccctgttctagagaaattcttgaacatgtgcaccaagagagatgtacaaaaatgtttacaattgtgttgatggcaatagcaagaacctggaaataattcaaatgttcaatgacggtagaagagatcaattgtgatatttttatgcaaaggattaatatagtaccaaaagcaaatgaatcacagccacatgtatcaaagtgaacagatcaaaaacaatttaatcccatttatatacaagggtgaaaacatgcaaacctagtcaatatgttgtttggagctgtatacataggtggtatagccatgaagaagagcaaataagtgattcacacaaaatataggagagtggttaccttggagggtggggaaaagtttgtgatctaggtgggatacaggaaactccaaaaagactgataatgttcagattcttcggctttttggtggtgagaatgcaagtgttgttggttttgctgtaatctctaatctatgcatgtatattatatccactttttgctaaatttcctagtagaaatgtaaaatacacagacacgtagtctccatctcagatctattgaatcagaatctcaggttataggatctaggcagtcttttctataagatatccagaagaattctgatgcactgtcaggttaagagcactcacctacacacacacacacacacacacacacacacagacacacacacacacaccctacaatacctatcaccatccagataaaagcagcttaaaatataagtcaaggtcaacccatcccaaaacagttataaaaacaaaaagtcagcccaggaaagtgtatagaaaggaaagtctcttttggttctttgatgacaaggtagaggctgaggtataagcctgagagcattaattgtttttgtgccacctccaatctccctcatcagcttacccaagacctgacctgttaggctccctagtagcataagcctgagatgagattctctcgagaatctggccacagagcaggctctggtcctggtctttctacaaagacagaagcatgatgtggtggaaagtgcccttgtctgggactcatcacagcaagtatttagacccagacccacatgtacattctgtgtgatcttggggcagtcactcccccgctctgagcactagttttcttatctgccctgcctctctcattgaaatccaatgagacagcgtaggtgggagtgctttgcaaactgaaaaaactaccctgaatgtctaataagcccattgccacttcagttattccttcttccaaaaagccaggaacataggctttcaattctgagttagtagagttttctaggtccaagacattgggagtcccaagatttggcttggtgagacataaaactagactagagcttagtgccttcatgtctctgtctaagaaactcagcacaatttaacaatttaacagttgcccactactttcctctgagcctacctttcctaggccctgataataaagaaggggacattcacaaacagctcaagaccacaggaagcatcacaccaagcaaatgtgtcgcctgagtatttatgaacggcttagaaacatttaagccagttctacaataccttccaaattaggattgccagatctggcagtaaaaataaacatgcaggacactcaattacatttgaattgttttgtaaaattggagtagttcttagtttaagtgtgttccaactattgcatgagacacacttgtactaaaaaatcatttgctgttcatctgaaattcaaatttaatgaggtatcttgtattttatctggcaatcccatttcaaataccgatcagcactttctcctgcagggaaatctgcatggaagagagttatgaaaccctacttttattacttgttaaagaataaaggtttgggctgatcttgagatgggacttgtcttcctcccctccttgcatggcccaagaagccatggaaagtcacagatattaaaagcaggtttcaaagtaaacagagcagaacaggagtgaagtctcatcatttcaaacagaaataggtattccagcctggccctgacccacccaggacatcaccagcagcctctcccttacctctgggcatctccttagaacgctctgccccaggcccatccagcaagtccatctgggaggcctcctcggaggggatgcggcgccaggaccagctctggttcctgaggtcatgcagtggaggggaatactccagctcacaggggaagtcaaagctgcactccagacctgcaataatagccaagggtcaatggaaaaaaccatttcccaaacgtgacttttcagccccctccactccacactaggaggttggccttcatctccccacatcctttgccctgtccaagggagatcagttgtcaataccacagggctctgtattggtgaaaagggacctaagagaataaaatgtgctctttctgtaactcatattacgggagatgttctcagagaaggcaggtaaaaaacaaagctaactaacaggttgaatggtgagaagctctgcatcttgtgaagttacctgaagacatagagagggcctgagggtgagtgggcagagccttcccaagaaacccatgagggctgagtccaagtctggctctgcttttaccagcccggtgactccaagcaagaaaactcacctctctgacccttaattccctcacctgtacattaggctgataattaccactcaagtttgccgtaagaactggtggtaaaacatactgcctaagaacatgtaatgtatgtgcggcttacaacctagatgatgggtcagagtgaacaggcaacctacagaatgggagaaaaattttgcaatctatccacctgacaaagggctaataactagaatctacaaagagcttaaacaaatttaccagaaaaaaaacaaacaaccccatcaaaaagtgggcaaaggatatgaacagacatttctcaaaagaagacagttatgtggccaacaaacatatgaaaaaaagctcatcattactggtcattagagaaatgcaaatcaaaaccacaatgagataccatctcacaccagttagaatggcgatcattaaaaaggaaacagatgctggagaggatgtggagaaatagaaatagaaatgcttttacactgttggtgggagtgtaaattagttcaaccattgtggaagacagggtggcgattcctcaaggatctagaaccagaaataccatttgacccagcaatccccagcaatcaccagcaatcccattactgggtacatacccaaaggtttataaattattctactataaacagacatgcctacatatgtttactgaggcactgttcacgatagcaaagacttggaaccaacccaaatgcccatcaatgatagactggataaagaaaatgtggcacatgtacaccatggaatattatgcagccttaaaaacggatgagttcatgtcttttgcacggacatagatgaagctggaaaccatcattctcagcaaactaacacaggaacagaaaaccaaatacggcatgttctcactcataagtgggagttgaacaatgagaacacatggacacagggagagaaacattacacaccagggcctgtcgaggggtgggggactagggaaagaatagcattaggagaaatacataatgtagatgaaggcttgatgggtgcagcaaaccaccatggcacgtgtatacctatgtaacaaacctgcatgttcgcacatgtatccaagaacttaaaggattaaaaaaaaaaaaaaaaaaaaaaagaattccagatggcctaggaacttcagcatgctttgcagaggaggataaggcctgcacaaaaccagagcaaaccagaaccagtggcccctgtcacctttagatcattagcgtatcattataatgcaaaagtccccacccatagaagagaatcactgccactttctgcacacgtgtcgtatgaagagcatgttcctgatctgcacctgcgtgtctgaagttcttcccaacacaagcttacatagcccctgacccacgtctaaccctgtaacattccccagcttcccactgctctgggagaagctgtctttagagcaagtgctctctccttctccatgcctggccagaaataaaacctgcttgcccttttccctaaaaaaaaaaataaaataaaataaataaaaacaataaaaaaccctaggtgatgggttgataggtgcagcaaaccaccatggcacacatatatctatgtaacaaatccatatgttctgcgcttgtatcccagaacttaaagtaaaataaaaaataaaataataaataataaaaaagtactgcctatgaaaaatggacctggtccatatttgatgctctgaaaaatgctagccaggccctgtcctttctgattgataagggaaaggccataggtaactggaatttcctcacagcctgctttgccagccctataatctacccttcgatctcctctccagagaagagggccaaggctatgacaatgagtcagggtttattttctcttggggagtgtttggggagggtcattgggtaaggagagagagaaaagagaggcaggaagggcccatgccctgggatgttttgtactttgttgagcttccctgggcagactctttctgtccaatgattccacgtttgccccacttttagggtacatgggccactcagcttttcttccccttccttgctcattgtccactccccaaagtggctgaagaactttgccatggcgggctctcaaagctggcttatggattaacagaagatgccaagatgcaaaatgttcaaccacctcttacttcatcctctccccgaagccgtgggaataagaaaaaatgggataatgtgatagatattggacagacaatatgaggaattcagtttgagtccaggcatgactagttacctctcatgtgtgaactttggttttctcaccaaaagaaaccaaaagctgttaaagcagtgcattttaacagctgcttctgaggctactactaccccaatctccaagacaattctggtgttggaaatttcagaatacagtgggggcagattctaaggcaggcagccggccactggattgtctcccaatgggtgtccacacccatagacagctggccctgctgcagagtgggagcaaaatattcctgttaacactaaccaaactattcaattgtaggagaaaagaaaaaaatccttcaattacacttctattgagtgtctttctgctcctcagctgctttccaggagctgccatccttctggccctaaggttaatactccttgccctttcacgattcagacaacttgccttcatagtggcaagctgaaatgggtagctctcactttgtttgagttgataagccacttgctctacagttggtgtccaggaaccacaggctgccttaatcttcaagatgtgcttgaagacacctggttttcagagcagactgcaaagagaaaactggtccaacattttgtactttgcaacaccaaagtgacataggaaggattagccatgaaacatgactaataaggagaggcgtagccatgaaatgtaactcctctagggagggtcaaaaagacacatccacattggtggatgttcatgtcagtaaaaaggtgagaaagccaccagccactcccatcccacattgacaattatcagtgcctttcccaaagcttcgacttctgcggccatcccctaccttgatttttctcttccaatgaaagatgacctgtttctattcaagacagaggtgaggcatgccaactgtctgagttgtgtcctgcctggcaaatgtgccctacatgtgtatacaacagacagacagtgcaatatacaatcccagcaccgagcatattaattcttggatctttgaactctggagagtttaagtgtgataattggctgtgtttgggccagatcctgcctagtaaaacaggctatgcaaatgtaccgattaaaatgcgttccttctgtaattcttagtccgcagcaacctccttttagctgttaaagctgtactttctagctttaaataggaatggagttaatattactactcatttggttgaaactgaattaggcttttctacattctgatttaatttcttacaaaacatggagacacaggtttttctcactcaaactagcctcagtgcctcttgggcaataataccttgggacttgcctaaaacaccaggttaagtcttattttccttgggcctcttccgaggttctagacctagtgtgcttcttgaatctctctccttcaccctcttccaactcagtgcctatgaggtagagactgtagaatctattttacaggagggattcagaggggtctagggcttcagcacagtgctcagccttaagcaacccaaccgcagaggcaggtccacacccacccaggggcaggggtgggaaactaccttccctcagcccctcctggcggtcttccacgcactgtcctgggtgttttccttccatcactgtacctcatctgcagaacaacactgagaagtggacggtttcttcttctctctataggtgaggaagctgaggcttaaaaagttttcttgcccccaaatgaaaggactaccccaaggcagacccagagagtgacctagaactggataatgcagaatatccagtgttgttcatctctctcctgcagcttcagaatctcaatttagggctgaagattaatttacacaatagatgagaaaccaatgaagtgttttatcttggttactcttagacccaaagcctgtaaacttttcatatctgaaaagccttcttcatgataggggacagatctatattttctaaatgtcaggcccattttgcagaatgactatgaccttcaggaggatccagagatcttgacctttttttgttttaacccaagagaatctgaccattgaaaaagagcattgagaaaaagacacactttccaggacctgcctatcacatatgtgaaatcattgtcacttactttcttgttatttccatcatggaagaaaggtaaggtaatggaaccttctggaaaagatctgccagctgagaggagcgtcaagtgctatgaagggaaagggctctagcagagcagtgaggatggttctgggcttggtcctgcacagagcagctgagaccccagcaggtctatttctgtctctaggcctgtttctttgcatttggaagatgaaagaaatggagcatgtaccctccatggtgccattcatctctgaaggtcagtgattctataggcttaccctgggccgacacaatcaaacctacagaccactcagcctgcctctgctcaggagatgctgcccctaaacaaggacttgttgtcatcccaagaggcagatttcctatggaagaagggtgaatgtacatcacactcaatggggacttggtttgcctccagattctcaaagaattaaaaagcttggctgggtgcagtgactcacgcctgtaatcccagcactttgggaggcccggtgggtggatcacctgaggtcgggagttggagatcagcctgaccaaaatggagaaaccctgtctctactaaaaatacaaaattagccaggtgtggtggtgcatgcctgtaatcccagctacttgggaggctgaggcaggagaatggcttgaacccgggaggcggagggtgcggtgagccgagaccccaccattgcactccagcctgggcaacaagagagaaactccatctcaaaaacacaaaaaggaaagcttatgtgagttttgcacataatagttgcaggatgaacgagtgagtgtgtgtgcacacacctgcatgtgtgtgtgtgtgttcatgcatttttatcatctgatactcacttcctgaaatctcccagtatatgaatcacatttttaaagactgaattcattaacaattagcttctagacattgttttagtatgaagcacagccattcaggaaaatgttgtggtaagtatcagaaaaccacggtggtgaccctgcccaaagacatacccagtctcccttatcaaaaccccctggctgtagaagagttgtcaatgacaaaccaccttgaacactctgaacctgagggtggaaatatagcctctaggaatgtgtgagactcccaaagcagtcaggcccaaggcctgtgcctaggaagcccagcattggttactcaggcagagatggaggccttccaaccggggccatgtaccaggccgagacactcaaggagattgcatgtaggttccagctattctccataacaccacaaaaggggaatagggagcttggtgcattttggacacttgggtctcctcttgagtgggctcagaatatctaacaatgctcctttgtatccagactgacctcagatttccccagaatcccttggatcaaggccctttatgcctccttaaccttgagcctgttaacccagagactagtttcctaaatcctactagttttctaaatcaccttgggtcagtttcaaggtagaggaccagcagctccccttagttttaaagacatcccctccaacattgcccagtttccaggtgaatgtagggtggcagggccttaaagggcagccccctggggcaggtccacatcagccccttggatgaggccttgcagcctcaggccaccgtgagctttggaagcaaatactgcagaatgaaaggaagagtcataaaaaagagaagaatgccatgcccatcaattccataacacttcatccttcttgattttgtctcttattatgaagtaaagctggaggtcttactttcttgttcctggcaacgcatgctgtagtgtgtatagaagagccctgacccccatggagaggacttctgtgaaggcgtgtgggaagtgtattcataagtaataacactcgccaaggactcactggggctggtcaccatgccaggcaccttacatgatcatcttatttaatccctatgaattaggcaggattcttatctccattcaacagatgaaggcattggagctcagagaagtgaagtcacatctgatgttactcagataggaaggggctatgtggtcttttactgatgtgtttccttcctgtgagtcctgaggccctgatttcagtaggtcacaaatgggattgccaatagaaaaggcagcagacatagcttccctcatgtagagccacagacatggacatgtctgtggctgcagtgaggcaggaaacagtgtacgagctccacaagtgaggcagagctgacagccactgactctgaaagtatcacctaaaggcaatgccaaccttactgtggtgcaacaaaatactaaagaaatggtcatggtcatgtgccatcaactccttcaaaatgacaattgaaatactatttctcaggatggacaggaggctgtgctgaaaaaaaaaggcatggtatgcaaattctgaatcagccaatgtgctgatttagaatctcgatattctaaatggccacacttcatactacaacaatgtacaagctctacaagtgaggcaggaaaggacctgggcccagagagggaaaggcagggcaaagctgggggcaggacaggagccagagtgtcttcgctatcttgaaggttctgatatgacctataaagttgggcctgggatgccctaggtgaggactgagtcagaggacacatcaccaagatctaagtctgaatctcagtgggtgtacggctcaggaagccaaagccacaagtgcaataaagcccagggcttaaagttcccttctaggtttcttgattgtattagtctgttctcatgctgctaataaagacataccaagactgggtaatttataaagaaaaagaggcttaatggacttaaagttccacatggctggggaagcctcacaatcatggcagaaagcgaaagaggagaaatgcacatcttacatggcagcaggcaagagtgtgtgtgcaggggaactgtcctttataaaaccatcagatctcctgagatttactatcatgagaacagcacaggaaaaagctgcccccacgattcaattacgtcccactgggtctgtcccatgacatgtagggattatgggagctacaattcaagatgtgatttgtgtgggaacacagccaagccatatcactgatgtcttccagaatatgtgctgtgtttcttgggtctgattgggatcccagtttagaaaactgagggtgggtgggcaaagtttctgtggccatcaggatgtatctgttttcagaaggggcctataagaattcatttaactgaatacttggtcaatgggatctgcatctgaaaacagaattatcgggcttgccactcacttaaaatatgacaatatgattgtgattttgtattggggttattttcctgctaaaaatgcttttctgtctccagttatcttgacttgatgtctaactactgggatacagagcctgacgctgggcctgactgtcctcacttgttgaatggtgatgtctgtgataccaatcagtcgtacaatcttttcccatatgtctatggccatatgtcttattcatcaagtgaccttaatattgtcatgaatgattcacaggaatagagcacaagacttgagatttgactctaattctgccatttgtcagctctgtgatatgggacactgctttgtgctaagcctcagtcaggtcatctcagtgagaagcctcatttcccagaactgctgaaagggcttaagatgatgaggcatgtgcttagaatggagaaattcccaaagcacattggctgattccgaatttgcataaccatgccttttgtgaacacagcttcctgttcatcctgagaaatagtattccaattgtcaatctgaaggaggtgatggcacatgaccatgaccatttctttaggattttgttgtaccaaagtaaggttggcattgcctttaggtgacatttgcagtcagaggctgttagaactttaagaaacatttgaggtcaaccatttcttcactggagaagtgaaaaaaagcaagacccaggcaagggaaaatactgacttagggccacgccactgattaatgagtccttcacatacagtgtggagggcatttctcctggttgcagaagtctttctgaatgtcacctcttcagggaacaccagacgggagctggtcagacgtactgaaccaccagctgtcatgcatcctcaggcttcacttactggcccctccagctgagactggttttcttaatggcataggaaaatgccaatgtattcctgacaagcctggttaagtgtcttcaataaagaaccatatgaaacatcatgcatacacggcaattctcttacagctggcctttagagagatctacacgtaaagctacatttcattaaatggaaccccagaaattagcattcttaaaacactgtcagtccttaaagattgtacccagctcaagggaactctctcagtggccactaatcttgaggcacagggaggatcctctttgctcgagggattcatcagaatgtcccaaatgtaggccttcagagtcatgagggaccttggagacctctgagaggaagggaaaggctggagaatgatggggatcatcaaagaatgcacagtggctggttgcaaggctggtactaaaattctgtttctaatcctgtgattgttattattataattattcaaagctgtgtataacaaaaaacaatatcttaaacaagtagaaaaattctgaaaaatcctatttttttcttgaataaattggcaaaaacatatatggctacgtttcaaatatctcccaatgatcagatggctcaactcacctccaataaagctttttgggttgtctcctcctgcatgtattcttctgccaacaaactgctttttgatggttgctggaagctccctgctggtgagcaggtctgttctcaggccaggagccacagtgagaacagggtgggggaaagcatggggccagaagcaaaggggaaagttcactagagaattcttaggaagcctcccagctccaggcgcatcagccttgtgcttggggcaattcatttaaccacttgagtcttggttttctcatggataaaccagggagaattatcacactaatgattttgataaaaataatataaatacctgtaatcccagcactttgggaggccaaggcggatggatcacttgaggtcaggagttcgagaccagcctagccaacatagtgaaaccccgtctctactaaaaatacaaaaattagccaagcgtggtggctggtgcctgtaatcccagctgctcgggaggctgaggcaggagaatcgcttgaactcgggaggcagaggttgcagtgagccgagattgtgccactacactccagcctgggtgacagagtgagactccatctcaacaaaaaaagaaaagaaaagaaatatatatatatatatatatatatatatatatatatatataaatatatatctgctgtgatgattgcataaggtaatgaatgtcgccatgctttcaaaaccctgagataccatatattaatagatggatactcttaccaccttggccctgtgatgcagacacagcactgtgtcttcctctgcctcagatttaccaccaggaacctggggatgaactgacctgacttgaccttggaggacccagggagaagcaggctagaacagacatccttctttccttgccctattttatatcaacctctcagggggctgggagaggcaccagagtgtctggggaggcattgcagggagtaactgcaagcacagatcctgcatgaggtcaggctcccaagttggaaatttggctgtgccattactagctccacatgtcagagaaaattaatccctttgtgcctcaattttttcaactgaaaaataagaattaaagcagggaccacctcctggaattgtgaggagggtgaaatgcaatagtgtatgttgagtgccctgcatggtgacttgcacacaatttggccttatttaatgatgcgcgtcattgctgttactctttaagtgtctccaggagtcagcaatggcagagagcacataagagggagtatatccagcacagcaggaagaaaactttgtttcaagccctgtttcagctggaagcataaaaggaaaaggggtggagaaacgtgtgctcctctctcaatatttcctttgcgatggctgattgagcttgcctttggaagacctccagcgagatgatctgggttctagctctggctctgtgatataacttcacacaagtcacttaagctttccagacctcagtgtcctcatctgtaaaatggagtgggggaataaaatgattctcaggtctcttccatctctaccatgctaagaataattgcccctttgggcaggtggccaaaataaactctctaacttcactctagccagctggtcagcaggaacccagggggcctgacttccagcccaggctccgatgattagggactgtggctccccctttctggattatctccttggctcaccagtcacctttgttattaatccaccagctgccatcaacatctggtcacttgcttcataacactaagtatccaacctggcccctaccccctctgcccacaaccactgttcatttgtcatagagccccagaacttgaaaccattcacttccttcccaccagcctgctccctggaatgcatctgggaaccaatcacccaattcaagacatctgtttagctcacttataatcaagctgaagagaagaagggccaagtctccttccatcaatcaattacatgaacacagcctcagagggcagtgtgtgtgcgcacgtgcacatgtgcacactgcagtgggagatacacacggaaagctgaattcttatttctcttatctgtgaccattactatgttacagatagaaaaacaggactctgctcttaatcatagaacagaaaattgaaaataattaattctgaggttaactagctcagcttcttcattttatagatgggaaaattaaggctcagaagagtgaagggacttggccaaggtggcatggcctagggcttggagcagtaagagagttgagaccagaacccagattggacttccagtttaattctctgcttgcaatttccaggaaacactcatgcagaatgtgtgtgtgtgtgtgtgtgtgtgtgtgtgtgtgtgtgtgtgtgtgtgtgtgtgttgggtaaggaagtctctaacagaatgaagcaggctccagagggcatggtgaaatccttagcagttgtatcactgctcaatatgacatctgtctaaatgggtttattcctgaaaccagaaggctggagatgaactctgagcaatgtggcatccatgacaacaggagaagcctggtggttaagggagaccccagaatatgcagacggacctccccacttactcttctgtctctaaagagacaggacctactgggtgttaatgtgaacatggggttccattcctccctgttttcaaacacaggaaggtaccagactgcccgagcacagaccttctacccttcagggaagggtcccagtccagttgggggatgaacttgcccatacctaactctaagaggcctcagggaaaacagaacaagggaggctctttgcctgggaggaccaaaggtccacagaaaaagcaactgctgggctgcatcttgaaggatgaaacaatttgaacagatagtaagggtttggctaggaagtttgctaagaacagaggaggagataaggttattctaggcaggtgaagaactgatattgcttaattcagtatagttgtataaattttgaagctgaactgcatgaattaaatcccagctcaaatactagtgtgattaaaggcaaaatgctttcaagttccagagggcaaaactagggacttaaaagagttttaagcaagaggcttagagcaaatggagccatgccaccaaaacccaccttttgctgtgccctgggcacattcagatctgtcgtcatgtcctcataataatgctgtcagttggtaatcctgatcacctccactttaaagatgacatagacaaccaaaaggagtaggtagtggctgaaggtaatacaactcacaagaatcagagctgggaattcattccacatctcagattcccaagatgagttttccccactgtggttccatgtgttgctttcaggcagaggctggaagaccttttgttgggatgttacagaggagattgactgactgattgatttaatttttgagatagagtttcgctctgtcacccaggctggagtgcaatggtgcagtctcagctcacggcaacctccatctcctgggttcaagcaattatcctgcctcagcctcccaagtagctgggattacaggtgcctgccaccatgcccggctaattttttgtagttttaatagagatggggtttcaccatcttggccaggctggtctggaactcctgatctcaggtaatccacccaccctggcctcccaaagtgctgggattacaggcattaatcaccgtgcctggcccagagaagatttaaacaggcaatgcagaggtgagttaaagccctaggattaccagacctagttctctagtccagtgaataccctcaccagaatcctgtttttaaggtgctctccaagtgactatgaggcaactagactgagtgtggccatgtgttcatctacaccaggaaggccctgaccccacactgaggcaatctgtggggcagcaaaactctgctgggctggaaacccaaggtattcaagggatgagttgtgtaaagcaacagatgggactgaaatgtgagaaaatactttgtgagccatcttattgagaagaaaatgaacccttgcctctatggtagagaggttaggtgtgggctctgccaagcagatggcctgggtttgaatctctgctttgctgctagtcctggggagatcactaacctctctaggcctgtttcctcatcctacagatgtggctatttgatcagaccacagaaggccctgacagctcacaatttctatgaacttctcatagaccaaattattctagtcatctacccaaatgggctggttcaagtcctgtgaattggaggtctcttctgacacaaagttttgcacctgaggttgctctcgacaaaacattttaagaggattttctctcatttttctcactcttgatcagtccttttcctgaacatgttttggacacacgtctttctaggttggttagaagtgctctgtatacagtatctcagatgtcccaaagctgtcaaaagagaaattcctcagctcactcatgtctgctgaatatgcttttttatgttaagaaaagaaaaaaagcaagcctgctcaaagtagttaaaatcacatctttgaatcctcaaccaaattaagtccagctcaggaactggtctccccctcagacacatttctttcctgaaactgattaatatgactagaaatgagagggctggtgggaatgtccctgccctttaataaaacagagaactttgggggctgaaaggctgtaggttgggaattgggagacctcagtttgctcctcatttgtccctgaactgctgagcagacattgccattacttctattgagtacacaatgagtacacaacatgagagaagtactaggtgtgcaaaaggaaacaagatgtgaattccttgacgtttaaatgcttaacgtctaggaagagtgataacgcaggaccacaaataactaagacacaaggaaaagtgtgacatcagaggcaccaagtagcggggagacacataaaaattttctccatgagaatatggggataaagtgaggtccaccacctcccagactgttctaatttggggttatagtgcggtcaccagctgctggttgtgaatacttgctatatggtatccaaaaggaagctctattaaatccaagagccatgtcatgtctgctaaaaatgagcaaaccttcctattaggtactgatggttcattagacccagagagagattctgtctccacagaactgattggaatgttgggggtatcacacatgcatacaacattccttcatctaaaaattcctcacttccttggctttgctgttgatatgatttgtctgtgcccccacccaaatctcatcttgaactgtagctctcataattcccacgtaccatgggagggaccctgtgcaaggtaattgaatcatgggggcaggtcttccgcatgttgttctcatgatagtgaatagtctcatgagatctgatagttttataatgtggagttcccctgcacatgctctctttgcctgccaccatgtaagatgtggcaagaggtaagcacatcttacttaccacaaaatgctcctccttgccttctgccacgattgtgaggtctctcaagccatgtggaactgtgagtcaattgaacctctttcctttataaattacccagtctcaggtttgtctttattagcagcatgagcacagactaacacaggtgactataccatctcctggttctcctcctgtctcccatttcttcatctctctgtttcatgctcctcttcctctgcttacctctcaaatgaaacatcctggatctcctctgggtcttcaacctccaatcaccagcttcaacctcagtctgtgtgcgtgtgtgtgtgtgtgtgtgtgtgtgtgtgtgtgtatgatggagtctcgttctgtcacccaggctggaatacagagtcacactctcgcctcactgcaacctctgcctcccaggttcaaacgattctcctacctcagacttccaagtagctaaggctacaggcacatgtgcacccagctaatttttgtatttttagtagagacagggtttcaccatgttagccaggctggtcttgagctcctgacctcaggtgatccacctgcttggccttccaaattgctgggattacaggcgtgagcaactgtgcctggcctcaacctcagtcttgctgctaataactctccatccacttctctcctcaaagccaagacctgggtttacagctctctactggccatcttcacctggctgtcttgaaggcatttcaaatgtaacttgattacggtggatctcaccacatttcctcctccctctagatgtcttggtcaacatctttccttgccaaatgtttctcttctctgttccagtcaatgacatcttcatccactcaattactcaaggtggattctcctgaataggaaaccaagtggtgctcaccttatatccagaatctcttccagattctcctccttccctttcttttccatcctatgcctcatatgtaggaccatgcccaactcctgagcattctcagagtaactgtctctccagcctcaccccaggtcctctacaacctttgccacagagcttgacctgttcccaaacacctttgcacatgcatcccttttgtccagaacactcttctcctgactctctgtgttccctagagtccaaggtccagttcagctgccgcagtctccaaaacatctcccttcttgagtcctctacagacctggtcctccctcctctgtgttcctgggcctctgttactgcatttgtcaaagagcaggtatgcttacctcttcccccagagctccttgagggaagcaaatgtgtcctatttgtctttatcactgacatgtctagagcacaactaagcatacactcggcactccacgactgttgacatcccttctcccattctctgtgttggtggagacgtgctaagggggaaatgatgcaggcagggtgggggttgtgggagggcctctgaagggggaagtcaagactgaagcaagcactaaggagccacctgcccaggggtgagagctgaaccatgtcaacgggaaaaagaataaatgaaaaggcagtcagagagccaagggcgacccctacttttgtgtctttctctctctttccctgtgtgtctctctctgtctctgtccccttcccctcatcatctgtttccctttgtcagtgtctgtcccactttgtgaaaagtgttttgaatggatcttttctgacttgtttttctcacctttgtgtcacatggtcattcattctcttattatattttattctgacgttttttctttctgcatttccttactcaacttgccaccaacatagagataaattgttcatatttatgaatggctctatgtgtctttgttttaaagagatatgaccaagaggagcattttaaacatgtctctcctcgaaacacctaaggcaactcctttatattgaatttccatggattgagtatattggctcccagcaggtcagggccctccaggtgataggtggtccctgatccttggtcttgtgtgactgccagcattactgtcccctttgggactcagactttgtggtgaatgcatgcagagatcttttgcttatcaagcttgtagatgaaaatacagaggcatgagctaggaaagagcttgaccccctagctcagtggagcaaggctaggaagagaacacaaaaagacctggcctggaaggggcagaggagttggtaaggaagctttcagccctgacaacagtccacaagggagctgcttttcactgacaccagtgctcctgaggaccagaatggctgatcacagccagccacattaaatacgtaatttcagaaatgcgatcaaactgacttcctgccagagctatgaagcaaatcctatacagagccagaggtcctttgtgttttccatttttgattctgtgttaggctgattttttttttttgagagagagatatttaatttacctagtcttttcaatcaaagaaattgatacattaacaggatgggtggtgatggtggcagtggcagggaaagtaattaaaaagtctaatttttctttctaaaagcaccagcccctgaactggataggtctccttggactggaaagcagacaaagtttgaataaaacttttattcaaatctaacaattattttgttgtgcttagatgttgggatgttgggaagaatattttcttttccaggagccaatgttttggacattagggggctggatcagcttcttagggcagtcataacaaagtaccatcaactgggtggcttaaaataacggaaatttattttctcacagttttggaggccaaaaattcaaagttaatatgtaggcagggccatgctctctctgaagcactaaagaaggatttgttccaggccttcctcttagctcccaatgctgcccgcaatccttggtgttccttggcttgtagacacatcactctaatttctgattccatagttacatggtgtgcaccctatatgtgcctgtgttttctcttcttataaggacaccaatcatattggattaaggcccatcctaatccagtatggtctcatttttatttgattgcaaagactctatttccaaataaggtcacattcacaggtactagggcattagaactttaacaaaattttgtggggagacacaagtcaatccccagggaccatagtctgggatggggagggagggtagagaagacaagactacctacagtgccaaggggattccactcatggttagaaagggttgaattacttggcctgcctgggatagtctccatttggtgatatcaagtcttggtcccatagctacccaaggtcttagacatcagactgatcatttagctaaacaccaggtcatccaggaagtgggcatgctctccaggcagggaaagctcatctttgaaataactttgtgatatgatagaaagagcacacagagagtcagaaagtccaggttcattcttttctaatggctcacctactccgtaaaatgaaagcacattaataaactcctttgaccctcgatttgtatttccataaaaataaaatataaaataattttcatctactgcaattttataatacaacttaaatgagaaaagtgggtgaaaaagagttttgcaatgtatcatgttttttttttttaaataaatgaaaagtccctttctcctgctcatatgggcagaacctttcatcgtcctgtttaaaaagttgatgtgattcttcccatacccagagtgggcaaatatgatttaaaggtggaaaggataccatctgtctctgtggctctaaaactcaaggtgatcaaaactgcctttcaaaacccccggtggcctcaatcttttagcatctggtgctacctgatggaacagatttttatctgagtaggtagttagagcctaatcctttagccaagcctataaataagtctaagggcatgagagctgatgataaaaagaaaaataaagtctttctttagacgtcctccctctcaaagccttaggggaggaatgtgcagccctctgctcgctgatgatgaaattagtgggcgctcgtcattcaacacaaaggcgagaaacgactggaatctgatgtcaaaagccacggaagagaatatattttacacagcatattaggccccaatgcaaattagaagaaatatggggagccttcaaaaaggtaggtcaaactttttcctcaagcagataattacagactgggggtgaataaatcttattagcctctttccaccttgtctcttctcataaaacactggaaaaaagaaagccattccaattcagaactggacagctcacccaacagaggcctagcctagtggtcatcaggacacctgcggtcaggttgttgatgctcactctcactcccccaccctgacgacctcccaccaggatgcaggtgaagacagccaaccaagcgtggacttccatgatggacttgcagagacttggtgacttctcactgtctgaagaacgatcccttcaggcagcaattttccagtcaaatttatctgcccaagtttgaggccttaaaattaatgaagttgttaacatttcttaaaatgtctttcacggcagttgaaaggtatggatttatcacccaactcagctggcctctttgattcatagacatgtgggctgagctcccaccaacatccttaaggggaccagactcttggccttagctctgtctttagcttgttctgcagtgggtcttggggcaagtcctcaacatctgtactctgaggtcagcccaccggggacactatggcagtgggcttagctgcctatggaatgatttgtctgtcctatgagcagtgaaagggaagggccaacccttacctgtctttatgtttgcatcacttcccacatcaggcacagggccaagcacccagagatggtgatggtggtggtaatgtcttcataagtctcagctgaattaaatatggcagaaagatgtaaagcctctggaatgcccaccatagtcagttaaggaaccaccaatgaagaatcagctcctccttccccataaatcaatagcaacgatggtgatgacttgggtactcttacccagaacttgggcagtaactgccaatggtttgggtcctctactctgccaagaagggaaatcatgaggattccagaccaggaggagagtttgaaagagatcttgaaaaacctccagatcgattcctttgccctaaggtggcatgccatttcaccctcattttacagataaggaggatgaagctcagggagcaccacatggtttatcagggccaagccatgggtaggaggcagcttaataagctttcatgattttctccttttgacctgcaacctcttataagatgctccacagggaacaaatatgttgccctctgcagcatggagtgggtagatttaccccttggggcattctgcattttataaaaattgtccttctgtagagatactgaatgactttgggagcaaaatcaaaaatgttacctgaagaccagttgtatcgcaaatctggttacaaagcattaacaatgaaaagatccagatttcaattatttatagatacttgcccttatcataagatgacactcagtgtctggtttaaataaaatcaggaagtaattcttatctggaatctcctgacgaccactgatctttctctcctgcaagggctgcttaagaatcacaggaaacattccagcacagaagataattataaactgccccagggtttttgatggatttttttttaagtttaaaatatggtacagaaaggtacagttaatatgaaccaagagcgttatagatgagagacagcaggctttggactggaagcttttctatagtgagtggaacatctctgttaggtgcattttaaatagcttaggcccaagggtatagactgcatagaggaataggtaaatatgcccagaagggaatctagaactccgtgccacaccaggtttataaatacttaattgaatcaggcctgatgaatgagtttcattctggaggacttttgcattcattcatcataaatatgaggctggtgcaaaagtaactgtggttattgccattgaaagtagccattgaaagactaataaggctttatgcatatcttccatgcgatagaataaagtggaaagcaaagcttagtgtctgtccttatggtgttcaccctagaggagttcaagagaattaaaatgttcatttgaaatgcttcttctctcctctaaatcttctcattgcagagacccagctactatgagctgttagaatgagcacagagaaggaggaatcttataccatgtaaaggcagcctcctgagggctgctaggacaggacctacccgggtgggtaggtggtacctgggagaaaaaatgaaagtaggggaagaagtctggcttggtagctggagaagccactctgtgtgatcttattaaacctagtttccacatctgtaaaaatgtaattggacctggtctcttcatgtcggatgctgttgcagaatcaaatgaaccaaaataatatcaaagaacatgtttgggaaactttaaggagcttcttaactgtaaggggccctggaagacctgtgacgctcataataataatcccctcttaagagactgattgttggctgggcacggtggctcactcctgtaatcccagcactttagaaggctgaggcaggcggatcacgaggtcaggagatcaagaccatcctggctaacacagtaacacagtcaaaccccgtgtctaccaaaaatccaaaaaaaaaaaaaaaaaaaaaaaaaattagccaggcatggtagtgggagcctgtagtcccagctactcgggaggctgaggcaggagaatggtgtgaacccaggaggcggagcttgcagtgggccgagatcgtgccactgcactccagcctgggcgacagagcaagactctgtctcaaaaaaaaaaaaaaaaaaagagagagagagagattgtgattgctagaaacactgtgggttagaaccagaaagcaagctacagtcaagaagcaaataagcatctcctctaatgattgataaggggatggctggaacactatataccataaaggctaagcaggagggatatggcagacacaaagcccttggctcccaccaggatacagaatgcagctggaatggcctggctggaatggtccacggggttgagcgtcactgggagacagagggctcagaaagacttcttttgcatatagggagctgagggaatgccctggagcactatgaatcccaaactgaaactcacagagtccttattatgagatagtgacagtgtatctcaagtaaatattaaacatatacttaccatatcggctgcgatgagacaggaaagggaaggagtctttcattatccaggtgagattccatgtaaaataatcaggagaaggagaaggcatgtttgttggtgattccaaggagctatgacctggacataaaaataaagaaaacactgatccatgtgcttggggtgtgtcttttagctgtcactcaatatcagtcaaaaatgaagtttataaggggctttcatgacatccatcgggaagatgagggggaaaaaattgagccaccagtagactgagttgacctcaggaccctgatgtacattttctatcaagggcagacagatctaagaggtctgaatgttctgaccaaggccatgctgaggatctctgggagatgaactagaagccagggcacttaatggcttggtctaagagttctatccaaagtctattctgcctataataatttgtgcagctttatagagaactccaattcatctcgtccagataatgcctccatccctactttatgttcagacttgtaacttcctctaatgttgtttgcttgggttattgccttatcaatgagagggctgaaactgcactctgaagttatgagttcttaacaattatgttattgtcagggttgtgggggaagctaggtgaccggagttttcccaaagccaagaggccagaaagccaaaaggattaatgtttctgatttgcatgagagaaagaaggcttgaaagaaaagcagcagagaagcattattcctgtccttagcagcacctcatgtggattttgtgtggtgaaaagtcattacaatatatctacaaatcaaatgatcatgcactgcctgatctaacacagtgcttcccagaaaatcccaagctcaatcactatttgctaatgttttacggcagacaaagccttttttgttaaagaaggaaggatttgagaattagttctctttcatagatagatgtgtcacaagactgagtgcagggaggagggaaggaaggaaattagcatttcttctgtagcttccccggaacagacgccatgctggactctttacctacataatgtcacatgatattcaccgtggctctttgagatagaaatgatcatctctgttttacagatgcatcaactgagacctagagaggcaagtgatggaagcagaaactgagcccaggtttgcctcatatcagcaggccatgttctatggtgaatgggctgacctgctattctggtggtaactgttaacccacttggagggactttgtgaagaggaaaagggggagaagaggagaagaagagaaagaagaaaaggcaggcagcaggagtagcagaggcattttcccagtctgcctgctctgcagtttcttccacattaccccctgtaccagctcttgcaggttctggtctcctacctctaacccccttttaggataaaccccacttcacacacttgaaggaaatctctggcctgggtacccatggcagtctcttgtttccagacccctccactattttacctgcaggtgctgcccttaggcaatgcttattaaaggcccttgtgccctgcaactgggacaggatgggcattccacggtctccttcctaaaaaaacattttaatctctgctttccatagctctgagttggaagtgctggctcttgggtatctaggaaagaattttgacttttctcttatatttggtctacagagattagaactgaattgatttgtgccaggtacatctttctgcagcatttctgcaaaacagctcagaggaaatgcactgaaaggggtgagagtctgtgtttgtgagttgcagagagaagccatctcatttcacctgcacatcaactctgtttcgtagataggcaatggggctcagagaagtgaatgcaaagccacgtagggttactttgggtggggttaagtttattagccttttaaaaaattagtatgtatcgagcacatatggaccggtatgatgctaagtgctttaaatgtgtgattttgtttacttcttacagtaaccttgtgaataagtttatttgtcctcattttgcagctgaggaaattgaggcataaagacgttagttaccttgactacagccacacagccagcaggagacaggaaatcagggtcaaaagactagatcaactgacactgaagtccaagctcctttcaccactctgcacaggccacagactggtgcagggtggtcctcagctctccacagggcctggcagggcccccacgacacaatggctgaggtcagaggccaccactgagcatgcttcagaatagggcaagtgggaagggtctgggaagactcggacaatcaatctccatgtgaataaaaattcacttagactctaggtctgagtcattggctaatctcaaattttaagtagctttgaagtgacaggaagactaagcctaggttatactttcctgtttctaagtgatgtcatttttctgaaccattcagtttgggaatgatattaacttcttcctggatgtgaggaaccaagcagatggggctagacttcagggagcacttatgaatctgtgaatgggtacagaatggcagataactttaatatgaatgggggccagataatatattcaggggtttaaaaaaaaagaaagctttcaaaaggaagggctctgagggctgggtcatgacccagcaaggtaatatggacatcactgtgggccatctcttcagaagcatgagcttaaagccttttatatcacaaaacaccaataacttgccaggcatccacagggttgaatattgcagggttgaaaaaaagcagaaagtcttaacttgcccttacaggaactcctagaatttcttccagccagtgggctcacagggtctccaatcttacccctgagagtagggagtgcaagtgataagccggatgaggctagggagctaatgtgggggtcagccaaaaggctgagcctccccacctgaaaagtcaaggatcaaggaaagcaaagcccacatgaatgcagttgttttccaaaatcggaagcattggaacagaaatgagtgctagtcaaagttcacagaatacacatcaatgtagaatataaagaacaaaatacttctgcatttaacaagtacagggtcaagacactgtctgttcccatcaagctctttacccttgccctacccaaccactgcagggaaggattttctagcagaaagagaagccatgccatcagaagcaatccatttaagctagagaaagccttgtcttttcagggttccactctgaaaatatgaggatccagagtgaaatgggcctcatcaatgcagatatatgggtgaaggtatgaatgcagaccaactggctcaagtagagtgactcttggaccttgggagatgaaacgtagatgagaaaggagtggggaaataggagcaggagcttctaggtgcccaagtgaggcagacaagtgaaggcctgaagagaaaggaggaagaaatatacctggactgaaggcattattgatttgctagcaatacaattgttgctgtttttctgatgatttcttaagccctttctaggcactgcagggtatcaaggcagagtgaaaacctcaagctcttgacactctgaatttttcactgtgtatcatccccctaatgtcctcagcttcagctccagggctcatctctatcataatttcatttcacacaatctcaactcctttgcctctttctttacaattatcctggagcaggtagatgtggtagtgggagaagaggggtggaggaacacacaacagtgctgacaggcctcattttaaattcatcaccagaaacctcaagaccctcaggatggcccgggaatcccattgccttccctgactaactcagttcactctctctctttccaatacaactagttcaaacttcctctcaagttctcaaaactccaattccccatatgcttccacattctcagtgaatgaatttgtttcttagcttattgagaaaagagaagtgatctacccacttacatgtatcagtgccttctcttctgttgtaaaggataacagtttactctcttaaacagtgccagcctcttcacttaggtgctagtctcgtctcttctcaagggatctgctgttacaatggtcctgcatcaacaattttccctctctaccaagtcagtcacacaaacatgcaccatcttataaagaaagaaaaagcttctttgactgccacactcttctccagccattgtccctttactctgctcttctttacagctaaatctattaaaagatttgtctttgctcctgtctccaccttcttcttcccgtgttctcttaaatccaacaaaatctagattgtcttcactactccacctcaaggtcgccgacgaccctaggctgcagatacattgaacaactctaggtctttgtttcactggaccactcagcagcatttgcccctgcaatcactccctgcttcttggatttttcacatcctggtcaccacatagtctttggttgcctcctgcttcagtgggaagatcctctttattcttctttgccaggtcttccttattttccaaactgtagaggaggaaacgtctccttttccggcagcacttgcttaggaactgtcatggctgagtattatattttatcccactggttctaaccagctgatgatcaataaatttcaagtgagtgcgggacaccagacccttcctgtacctaactgaagactctttgctgaccaatgaagataacttgtttacccatgctcacacaaacctatgcattcattcattctctttagttcaaagaaccgattttcaactccaaataaccagaaccacattgtagccctcttcgtaagactttaaaaactctgacttttcttacttggaaaaccatacagtgaatttctccttgcccgacatgtaagtaagcttgtcataaaaaacaactctgtgggatctttattttattatttgacagttgttaaaagttgaagaacttgggaattttctgcatctaaactctctctcaaagtgatcttacccagtttcatggctctaaatatcatccacatactactgttaccaaatttgtgtcttcagcccaatctctcccctgaacaacagaatacacagaatatacatccaactgcctgctcaaaatctccactttattgcccaataagcatctgaaacttaccatgagcaagccaaaaacctaacctcccttcccctaaaccccaggtattccccatttcagaaagtgttaccaatactcgcctggttgcttgggccaaaaaccaatgaggaatccttaacttcttccttttattcacaccccacatcaattcatcagcaaatcttgatggctctacctgaattttaccccttctcatcttttcccatctcgcatctctccattattgctatgagctcaaagagggccccccttcagtctgttctctatgtggcagttagattgacactgcagcccctgaaatagctttcaaatttcttgccatagcctagcccctaaaggccccacaggatctggctcctgattctgtctctaacctcatttgcaaccattttccctcattgctggagctcagtcccacaggtctccttgctcttccccgaactcaccaagcacattcccaccccagggcctttgcactggcagttctctcagccgaggaagctcctcctactcagaggtacatggccactccctctctctgtccaggtccctgtccataggtcaacttcccagaaagaatttccctggtcatcctgctgagagacaactcattgtaagccactcccatccctttgccctatttcttacacatatatgtgttctgtatattggtttattcattgtgtacctcctgcactagtcactgctatgtctccatgcctggcacacagcaggcactcaataaatatttgtcaaataaatgaaatcagcgccctggaggaaggtgttatctctggcacttattagctgttaacttcaggctaagcacacactctgccaaacctcaattttctgaaaacgatgacgagaataagaatagggcatattctaaaaattctcagggttttgtaagggccacatgagataatgtgtgcatgacacagtctttcagtatcagtcatatcattcttaaaattgtatgctcctatctctgttttagaatccaaaatgagtgggagtcttggtctcttttctatatttagatcatcttgtgtcaataattacaacgtccagaaatcaaaagtgctcccagagagctgcttcgctattattcactagttaatcattaactttgccaaatgtacatgatcacaactacccaaattgcagccgattggcactgtgtatttccaatctttatttttacatgtctcactgcatgtctatttattcctaagccaatgaacataatataataaatatatcatacttgtgtcagtataagtaatgaagagctatgcatgtgtgatggttatttacatgaatgccccaggctcactggcaagcatgttttacaaacctacatcaataaaatgtaacaaatgctcctattctaaatgctctttggaacagttcctaccttgcctgtacacgttttacttatttcttttccttccaacaataaaacaatcagtgacagtctgcttgttttttccctgttatttgaaaacacacttaataatgcattcgtttacaatgattttgtgtcacacaaagcaaagcttaatgtggccaaataaatagtggtctggatgtcaaatcaggcacagctctcagagagtacagggcaggcctgtttttgggactggcagcccaggggaaatggtttgggtattcactaggctgagcctgcacctgttcagcaaaagaaacctcagtaaatttacatgactcctagagttagcggtgatgggcgatgttgttaatttagtctgaaaaacagagatgtgatttcagagaaaggagagagtttgcagatgcaccatttgtcctaaacatatagccctccccataccttctctaggcctggaaaatgagcggtttgaactcactgctcgctaaggtcctctctggttcatacatatttgtttctctatggtttgctttcacattttcttccagctggctcattcagaagggagctattagtgtcaagggcggaatttggatggaattaaacagctcccactccacctcacctttctctaagccccatcccatcctgccagagaagtttgtgctctttcttagtagctcaaatattgaagcaaaaattactctcccataatattcttttgtactgtcaaaagttatagcttcagcatgcatttcctgcctccccaagaggacccatgtataacttttgtgttcactcaatggtgaaggacctctgccagccaatgaaagcatgtaccccttcccaaggcacaacagtgaggaatattaataaaggaaattgttagcatggtgcctacccttagggatttggttaccttcaggctatcctataccaaaaaaaaaaaaaaaaaaaggaatcacaaagaggttgctccagaatggctaaagcgtgtaaatctggagcccaaacactctggccactgtttgccttttcagccttatttcccattcagaatccttcctttcacattctatcccattactccttagtctccaaacttatgcccaagctaatctctgcctagaacatccttctccaccccctgctttcctaaatcctaccccttcttaaaggcccagctcaaatccctcctcctcaaggtccctgtcttccctgagctggacaccaaagcagttgagctgggattcgggttgtgccagaacaaaacctgaacttgggccctgacctccttaaccacttaggatagtggtgttgaggccattcaacaaacatgttaatgacgatggattgtaattgcatattaatttcactcacacaacttaagtttcaggtctgttgtttatgttgatttcttttctttttttttttgctcattgatttagaaaaaattaggaaaagcatttcacagtggctgtttttggtttggtgtcatgtaggacatgctttgcaggggcaggggcagatcaagacatggacctatttcatcagttgagctaccacatctatgcaggtactagtgactcataattcatggccaaagtcctataacgaaggccatgtgacagctgatgcctcctcttcagaacctgtatctctcagaatttgatagttccaggtcactcactgcattttcacctttccagacatgatttcagcatcccaagcaagcacctcctgactcatccatgagcgtcacaatgtctcctttggccctgaacccctgctgcaggtgtgcttggtcactggccctacctaactggccaaggtggactcacactggcttttggtagctgtggaagactaatgggcatttttattttactaatccaagacagcaaatatcactctccaggtggcctgattcttaacacacccgcactccctacccccgtaagacctgagtgcttccattagcagggcaacatgactctctgtttgggtccatttctgtggtttgcttgtactctgctctttatgaaatttactccactgtgatcttaagcctattttctccccccaaaatatgttgactagaataataatcaaaaggaaggctttgaactgccatcaggcctttcatcttgtgatctcagagagctttaccaagcactaaataattaatatactgaaagcgatacaaagacacaaagacacaaagacagggcagcctggaaaaccaagtccatcaacaaaagacctttttcttttggagtgagagagtcctggtaaggataatcacccaccagcaggcccaggagtctccagacatgttagacaagaggctacaaactatccaagaacaactggctcttctcttgacctgatgtttcaagttgggaagtaacggttaccaggatgactcctgaaatcatgcagtgagtgccctggggagagtgtgacccactttcacaggaagaagggagctccagcgtggaagagtggattgcaactgtgtgcacattcaccatgacttagggctccctgatgcctttcagaggcatctgcttttgtgatccttacaacaactttggtagttaacctcttttacagatgaaaagattgaggctcggaaagcacaaatgcccaaggtcacattgccagtgagtactaggataggatgtatgactgcagacctctgatgtgtggaccagctaggaatgccactctacagtacaaatcccttgcaggtgatgattctcctggggaacaggggttgggaattaaatacagaagaaagaaactgaccaggtcagagatgcttgctgcattctcctaactgaggacaatagatccctttgggtcaaccaggaagtcgacctagaaacacacaccttccatcagggcagctggctctgtggggtctcaggctcagccacgactgtttccatggcaaccaccacaaagcctgatgcctggatccttgaaattggtccttggcttgtccaagggaagatgcttagggtgaggggaagaagagggacaaaacactttctcctaacttccagacctttcaatccctctttatctacttgtcacccctgtcatttcaggataaagagtctatcctctaagaagccccagctccagatgccacattactcagcacaaaggcccctcaccatgactgaactcatttccagagataggctgatgtgctagagaactgtgttctcagatacagcagtgttactgcgtgaccttgggtaagctgcttaacctttttcaagctttgtttctctgcatgtaaaacagaactcatcatgctttcccagccaacttttgggatgctcaaagaattaatgagacagtatctacaaagccctcaggctcttttgaagaaaggtacactagaaatccttgtgcttttactaaggggtattggcatgatgctatattttaaatcactcttcacctgtattactaaaataaactcagcttgtattaaaatagataggccaacagcctgattggcttcatcctactctggtgctatgtcacctttgttgcttccattcatcttgcattgttaacaatggtgatcaatgttacccttggcctcatgcagagactcagagtgggggagctgggaggggccatgaagactatttatctgtgtcttcctatcacacatgtgagcaagctgaaacacaggaaggaaagatgcttcactcgaagtcatctcgttagtgaaaaaaatcacaaaatatgatcttctgtgcccccattctatgcctcacccaccacaggagaaggtagcaaagaaaggaggagggagaagaaatagggagacatgtttttgttctttaaacctttaagctgcaatactctgggatgtttttaaaaaaaaaatcactgagaaagaaaccaatacttcatgtgtgcctattacacacggtgcccagcaccatactgggggctttatagtcattgccccacaaatcccacaattttctgagtggggattattattaccattttcaaacgcaggaactgaggctcagagaggttgagtaacttgtccaaggttctggagccaaaaggggtggagctaagattaattcattaattccattcatacttcctgagtatctcctatgtgccgagctctgcccttggcagttgggctgcattcgtgagcagaaccccacactaccctcttagagcttccaggctgaggagcttagagtgtggaaggcagcagacagccatccaacaacctctcaagtccttttgacatcttgatgttgttatccattgtgaaggagacagacacaaccctatgagaacgtatgatgagggatctgacttcattacgagaggcaggggaagattacctgagaagctgatgcttgcactgaggcccttaaccagatgagtagagttaactagttaaagggagtggggtagggtgggaggctggagaaggcagggtctattccaactcaagtctctcagaacggagcgccagctccttatttgccaccaagaaaagtgaggcattatagaggaaccttgatggatggcccaatcacactgctactgtccagcaaagaaccccttggagatgacattgattgcaatcgagaacaaggacagggaatgaaacacagcagaaggagtgaccagttcataaatgcctgctgccttctcctgattaaggatgacagatgcctccagatcaacctagaaggccatctaaaactgctacctaaaatggctctgccccgtaacaggactgacctgacttgccagggaccctcctgccttttctcggatgctcagtctgttggccaactttcctgcagggaagaggcctggaacccagccactaaacctcagcctcccctcgctctgaaacctgaattaccttctggaaaagtgaagggttgaatctgccccaggaactcttcttgcagccatctgggtcacggataagccctggcttgctctccttgccctctcccatggccagggccagcaaggtcagagcctctctctttattttgctttaaaaatgaggtgaagagaggcaaagagggaggggagagcagggagagagagaaaagaagagagaggaaggagaagggagagatggcaaggagacgcctattaagcaatagagctgcaacaaagaagggaagaaacgtggtgggggaaagagaaatcatctgacattttttcactatctggaagttactgggagaaagttattcaagtaccacggtaaaaaggccataaaacaccttggggaaaacatgaaagtcacgctgccaccatacagacgagcaccctggaattagctgccagagcgatgtctaaaaagaggaaattcaatggcccacattgcagcctcctccccagtccctcccagctcccaccccctccaaatcgcctggctctaaaggcagaggcagtaatttggagctggcaagtgtgaaggaatgtggaagctgttatttgccttcatgcagcacatcttgagtgcatctttcagaatataatttaaaatacactttcggttttactatagaaaatctgaaaaaaaatcaagaagatctaaaggagaaaataaatatcacccatacctccagcatccagagaagccagtgttaacattttattgcatattggtttgtgacttggttttcactcacttaacaagacagcacttggctgaaaagtatatcgaggagaagggaaggagagagttcctctgcacccatgagatttgtctgcagggcaaagaaggtaagtcgtcctattaaaccacccaagcagcttgcaccctggcacacagatgctgaaattatggcaactcgggatcccctcgccccttggcaaggacctgccattaaatgcggcacaagctccgagaaagcaaaggctgtccttaggaagggcaggcctacggggatttgggagatgctgggatgtgagtgcaggatagaccaggaggaggcagatacactagtgtgtaccctcagcacaagtagacagagggataagcagattctgctctggtaggcaccttgtagaagtcataagaagcaaagactatacagaattatagtgttatgtaagtgcttgaacctaaataggaggtacagtacattgattttatgacttggaaaggctaaaaaaaagtggaattccacctcattttcaaaggaacagccaatgaaagtaaactagagatagagggatagagttctatctctgtggccaatgacacaccccacaaatacatggactcccaaagccctttcatttaagcctttgatcctcataaaggtttaataagataagaaaaacaaatcccaacttacacaagaggaaaacaaagaatcagagaggctaagccagtgcttcctcaccttttttcatatcatgacacacagagaaaataatatttatatgatccactggagtaaagagttaaggttgcttgcagtgaaaggcaactggcccaagggcttctgccactcctggtctggcctagcctcccagtgtgctgacaggctccataggtcagtgtctctgcacacctgttggccagcacacatgggaccacagctcactactggagaaggaagctctgggtcaggagatgtggccacaatcacacaatgagaagagcaagatgcactgtcaccctgcatcttgccccagggacatgtctacatgacaatagagacgttggcctcagaaagttcccagtgcttgtcgccaacactgtgtcatcactcaaacaaagcaggtggcatgggtgagtaagggctttgaaggttgatctgagagcgcctcagaaagtttccttaaagcatttgtaactgtcaagaggcttccctaaagaaaaggggtaaaacttggctcctatctctactctgggaaattcagaaaataatttcacaggatggttattgaatggccaaaaagtaatgattacaaatgactgagttaaactgctgtgtgtagcctcatctgtcatcatacaagcgtcttatcagaagtcccatcaggattaggggctcatcatgactggtgacatttgctggccaagatggcttggcttcttccatgtccccttcaatcatggtggcagaagccttccaaggtttgagcataaactcggagaaactgcttttggcaatgactccaggagcggctttcaagataatggactctttttctgcaagtggcactctgtcttcccaagacttcctgggtcttgctgtcactggagattctgggcagcatcgggacaggatgagctgctggcaacaggtataacagaaactaaaccttccggcctgctgaattaatgattttattagatacaggtaggtcacactcaggcagcacttacacaacattaaacctctggatggaaaatgaaaatatttcctcaaatcctgtaatatctccaaatgtaaaccaaagatatatattttcattaggacaatagcaatttggcccaagagaagcagtcaggactaagcattaaagatatttggaacaggtgaatgaaccatgggctaattggataatactacatctatctcttataattgtggaccaagagcacccctgactccttgggaggttctgtcagtgacctgtaaaggtgttgtaggaaggtgaggtcaattccctattaatttctcatactcagcagtgggaggggaagagaggagagtcctccctttgccctgggcctcgcacactgggtaaaccctggtcatttgtacagcatgcatccagagacttctggaatcctcatcttcaagaatattgctgtaacatatcactacctccataaaatgcattgctacaatagggagaaaacaataaatcattcactaagtgactcataaccaaacccagcctcatagcatgagatttttcaaattcttatctcagcaaaatgacaatttattacatatcatgtaatttggggtcgcttgcaaatagtagaaagtgtgactattaaatctgccactaccaagcaactgctgtagtcagaatatgagagagaaataaaacaagatgcaaaagtgacttttccacctactctggggtcccagactctgaaatgggcagggggagccaagaactattgtcacaaactccagaagttccagccatggcttcctcactgcccacacttgtagaactgtgaggttttcctgcctgaggtaaatagcaattatatctatactaggtttaactcacccttggggtgaaaaagacttgaggaagatgtgtttatgggttgttgactgttagggagaactgtggactaaatgtttatggttcccccaaaattcacatgtcgaaacccactccccagtgtgatggtattaggaggtgaggcctttgagaggtagggcttttggcagagctctcataaatgggattagtgcccacagaaaagaggcccaaaagagaaccctcaccccttccaccatgtgaggacacagcaagaaggcactgctcgtgaatcaggaaacaggccctcaccagacactcaatctgctggcaccttgatcttgcacttcccaatctctaggactgtgaacaataaacttctgttgtttttaagctacctagtctataggttttttttttttttaagcagcctgaatagactaagggagaccccaaagataaagacttttgagtttctgaccttcatgaattgatataagtggagtgaatataagaccaacagagagaagcactagaacatgaagcagccttccagggggttggaaggaggctaggaaataagtagaaggaaatccactctgagcaaatagaaaacatgacacccaagaggaagatacacaattggctagtggggcactctccctgaaagcggggcactaggaacaagagtaacctagccattctccctggaagtcatacatgaagtaaagcaggatcaggatctgctggtatcacccagaagaatgaaatggcagccaggtcttcttatagctttgaaatgtccttgtttaatagagatctgtggcaagagatatggaatttataaaaggggctgcaaactagattaagggaaaaggaggccagatggggaatcccagatggtaccatgctgtcttggagttgagatcatgggtttagatgtcaggctggcctgaactcaactcacagttccaacacttactagcacctacgtgacctcaggcaaactatttaacttcttcacacttcactttcctgttctgtgacatgggaataatagaagcaatcttacatgcttgccttgaagatgccataagagagtgcttatgaagcacttagcacaatgcctagctagagtaagtgttcagtcaatgtgatttatattattattatagaaaataaaatgctgggcaaaatatgggcccagccattgagagttctgagttttaaaacttcagggaagagtcatgtgatccctatgagggaaacatacactttgtagacaggaggggaagatctgcaatccagacacacccacggggatccggcaggttttcagggctgtgcaggcagcgacaggaggggttggaggagctgtcttggaaaaaagtggccatgggacattggacctgctgagcctgtggcctgtagatcctggcagaccaccactgatcaacatcagaggggccaacagtagatggcctgaacttggagttgcttgtaatgcttacaaaagctgtcagtctgcgagccagcaaagcatacatcagtttcccaaggtgagaactgaggcatggaaaaacaagttagcggcccaatgagaggacttggagaacaagcagcgggaaagggcagagatccaacactgggcccaggactcagcctccttctagccatgtgtccaagattcattgacttggcaattgtgcaatctgtgctgtttatattcattatccctcaaccatgttcaagttccaagaaaaggtgctgcagaccatctccatccccatctgctctgagtaattatggagatttcatgttgccctaaagagaagagactgtctaacgttttcagatttttttaacatgaaaaaaagataaagctcggggaccacaggcctataagtttaacagtgctcttggagaaaactctaaaatagatcattaatcagatggcacggaagcctttagaaatatacatcgaccagagggagacaaaactagttcagtaggaataagacatggtcagtctagggatagtatctttactatcaaaatgagcaacctcttcccccatgctcaaaaagaaaaataattacaaaacaaagacacctgtaaaaataaatatagatcctgatctctctttctccctctctctttctgaaacacacacacacacacaaatatccaaatatcaatggctaataaatatttgaaaaaaatctcaattccaacagtaatcaaataaaagaaaattaaaatactggactactacttttcacttattgaattagaaaatatttaaaatcacttaaataatttaaataaatttaatagatattttggtaatttaaatacaatttaaaatatattttaaaataattatgctcagcactgctgagggcaatgagatagataatcttatacattcctggtagaagtatgaattgtaaatttaatttttttaataataatgtaataattgactaacaatgagtatgtgtaaattgctatgcacatggatcattttatttttttattacaaaaaccccatgaaacaggtattggtattctcgttttgcatatgaagaaattaaaagggtcagtttcaaatgccccagagattctgattctcacttgtcatctaggggttgcagggagaatggaaatgggtaaggagaggatgaggcaagagaaagccctacagggggttctgatttggatataccattcccctgtttagaataacaacaatgcattatactgtacataaggacagataactaatttaggcagtatttaagagtgttgatacttttgactgattctctcctaagaaaatatttgaaagttataaaagtgtttgtgaacaatcacagccttcagtgattttataataataaatgctatcttagttggaaacaacttaaatatctagcaataggttaaatgatttagaaaataatagtaatagtagtagtaagagtagtagtaataataattgttattgcatactcattatgtaccaggtgctagtttaagctttacttgaattatctcacctattctttattgacatggtttgaccgtgtccccacccaaatctcatcttgaattgtagttcccataatctccacacgtcatgggaggggcccagtgggaggtaatagaatcatacggcagttacccccatgctgctgttctcatgatagcgagtgaattcttgtgagatctgatggttttataaggagcttttccccctttgctcggcatttctttctccagctgccatgtgaataaggacatatttgcttcaatttctgccacaattgtaaatttcccgagccctcctcagccatgcagaactgtgagtcaattaaaactctttcctttatgaattacccagtctggggcagttctttacagcagtgtgagaagggactaatacacttacaaaaaccttgtaagttagagattataattacccctattttgcgtataagaaaactgagccatcgaaaagtaacttgctcaagaccccaagccagcccatgacagcatcagaatgacagcccaggaagtcttactccagagcttttactattaatgatcaaactctatatatgtagttcatttccatgatggaatattatagagccattagagataatgttttcaaagggtttttgataacatagggaaatatttacattatatgcttggaaaattacatatattgtatgatctagctgtgtgaaaaatatacaaagaaaatgcctggaaggaaatgcaccaattaacagtaattgcctttcaatggtctggttatgagtcatttattttcttctttatacttttctgaatttttctaatggactaaaataaccatgtgtcattttttttttaaatccagggtggaaataaagtaagccatgttcatgccaaattacccttattttcattttgacagtgtattttaaaatttgacaaagtaacttatattttagtacattaaaaaatggaaacaagggaacaagtttaataaaaataatgcttagaattatttattaatgaagcaatgtttcctgtactaagtaaataaaagaggaccaagattaaggcttatacactcttgaatttctactccccttaccccagtatctagcagagtgccttatgtagtgtcgacttttggcaaatatttatagaatgagtgattttatcttgctgaacacttttaaaaatcaatgacaagacatagaaaaaaatgcttattgaatttgtagcgataactgatatcacagaaaatagagttaacatttgtaattaagccgtatacaggatgaaatttaatacttgtcaaaatttatggatcagaagtcttaaaatattttttattaattgaattgctaatgttgactatcccagggaagtaacagagaatgggcacaaatacttagacccagtgatgttccttgttccagtacttggtagaacctaaagattagaaagaattagatgtttaacggtatgtgataggttgcatatactttgggcatccttaaaataaaatcttatccagtaaaagcgttttgtagaaatttatgtgttgatgtagaagtattttttacaaatatgttaattttaaaaggcaggtcataaaacaatataaacaatgtgatctaatgttgtgaaaatatataggtgctagctagagataaatgcatgaaacagattgggaggctatacatgaaaatgttaggggtagatatctttgcatgatttaattataggtagctttgttatatttgtattttttcattatgttttgatgaatgtgaattacttttgaaaaacaaatgtaaaactattctctatacaagtatagaatgtgttctggaaaactgcagttggtgctgattttacatttcatatatagtttaaaaaatgggtctggatgtatgattgccccaagctctggatagctagcagtgcagcatggcagctaagaagacgttaattccaatcttaagtgacatcacgagaagcaaaatctcttggctatgggcagcagtgactgctctgggctccacagtgggcaaagcacagtgataattttgcattcatttcttgcattgttttagaaaagaactggcaaactagggaatccagaatacaacaagcaggtggtaggcatctgccatgaacatggcttgcccagaaaaagagtctattgggaagcgttacctccaccatccttcccaatctggtgtctgttttcttttacataatcctccctgagtctccaccactaggaaacattttgggatggttcctcagaataacacatgtgcctgcatggagggtggaaaatggtttgagttgtagttgaagttagaccttggaagaatagtcaggccatcatgaggatagctgagccaaggtgagcgggagaacaacaggcacaagagagagcaagagcaaaaatgcaagcctggtgggcctaatttgagccctgaaacccagatcttggtataagagcagtgaaaaagggtagagatcatcagcaacagcaagctagaaagatggctttggcagtagcttttcatgtgcctcaggtcaggaagatcatgttatattatactcattcaattattcatcaaatactacctgagcccttgttctgttcttgaactgtaactaggtgctgcacctagttacacaaaaccgagcatcacgccaaaaagtcccagcccccatggaccttggagtccatatcaatggaaagagaaggaccaaatggatgcttgaaaagtaaacgatatattataaatttgcatgccctttttgcagaagaatcatgctcatgttgtatgtatcattactttttatcataaaatagccttccacatttatgtcttgatggcataatttagcttatgagcccgctgggaaaattctgtaacttatgtggccatctactactttgttgtcactccagaactactgagtggtgataacacagcccatgaatccatctctggtcatatttagagaaggttgcccaggtttttaggacgaggagaaatatgagacgtgttttgaatatgtggaccttagggtttttcaatgtgggaaaagagaatcaaatgaagaactgaaatttcaaacaaggactattgaaaggagacttgtttaccctctatagagactgaatcaattaaagagtggcctcaacttaaagctgaagcatgataggaacaccatgccatgagccatttgctctacttggtgatttgaagttttatgcttagagcttcatgaaactcagaatgaaaccatagtcagaacacacaaggatatttgctattgacaatccagttccaaaaatagcaaaacaataatttctaggatatctgatttcaaagatgtgcagaaaagggagaaaagaacattattatattggctaggcacagtggctcatgcctgtaatcccagtgctttgggaagccaaggtaggaggatcacttgagaccaggagttcaagaccagtctgggcaacatagtgagaccctgtctcttcaaaaaaattttttaaaatagccaggcatagtggcacccatctgtagttctagcttctcaggagcctgaagcagggagatcactggagccgaggagtttgaggctgcagtgagataagatcatgtcactgtactacagcctaggcaacagggcaagacagtctctcttaaaaaaaaaaaaaaaaaaaaaaaaaaaaagaacataggccaggtgccagtggctcacacctgtaatcccagcacgctgggagcccaaggcgggtagatcacaaggccaagaaattgagaccatcctggccaactttgtgaaacaccgtctctactaaaaatacaaaaattagctgagcgtggtggtatgtgcctgtagtctcagctactcaggaggctgaggcaggagaattgcttgagcccgggaggcagagattgcagtgagccgagattgcgccactgcactccagcctgggcgacagtgcgtgaatctgtctcaaaaaaaaaaaaaaaaagaacatagttacatggtttgtgaaatttgataaacttggatctgcatttccattctaccacttacaaggcatgtgattgaggcaggttaatatattcgagcctcctttttctcatctgttacaaaatttaatgaagatgaaaattctgccttgtattattgttaaaagattttatgagatgtgtattgtgaataccaagcacatatcaatgactgtttcaatgtgagttcactccccaaacccccattagaatcaaataattagaggcaagcatgggttttgactctatagccagtgatacataccacagcagtacaagaaactctatcatgtgtgccaggcactaaggatgcaactagaaatgtggataaaatgccaaaaacaccttccaatacatgtaatgaagacttcaagaattcacttgtaatgttacttttatcatttgtattgcattcaattcaacaaacattgattgaatgcctacaccatacatactcattccctagtttagtagaacctcagagagctactgcattctgatgtgaggtcagaggctgttgtttcaagtctctacttctgacattgagaagttttcagtccctaactatgcagggccagtttacttgactattatgctccacaaaggtaaaacagagctctatcagcttcacgaattaacaaaagtaacgctttccatatagtaggagagcggatatttattcaatgaaaaaaaggaagaaaaaaggaacggatgaaagaagggaagacagacaaagagggagagagagatggacagtcagacactgagacaaacagagggtggttagaaagacagacatgaggacagtcagagggacagttagacaaagggacagacagacagaaaaacatggttatttgtccttttgttctcttatctttggaccatgacaattcctacctgcttcaaaggactattgaaaggaacatattaaaaatgagagaagcattagattctgaatggttatgaatagtgccaatattaggtggcaagtaaaacagacaaatcacactaacatagagtatttgatatttaaaaatttatttaattgtggtacatcccgataatgagatatcattcagcgctcaaaagaaatgtgctattaggctaggcgtggtggctcacacctgtaatcccagcactttgggaggccaaggtgggcggatcactcaaggccaggagttcgagaccagcctggccaacatagtgaaaccctgtctctactaaaaacacaaaaattagccaggcgtggtggtggatgcctgtaatctcagctactcaggaggctaaggcaggagaatcgcctgaacccaggaggcagaggttgcagtgagcagtgatcgtgccactgcatgccagcccgggtgacagaacaagtctctgcctcagaaaaaaataaagtaaaataaaaaagagaaatgtatcaagccatgaaagacatggaagatacttaaatgaatattaccaaatgaaagatgccaatctgaaaggactatagactgtataattccaactgtatgaccttctagaaatggaaaactatggaggaaaaagattagtgtttgctaggggttaggagtaggggtggggaagataaataggtggaccacagaggatttggggggcaatgaaactactctctatgatactataacggtgagtgcccaacatcaaaagtgaaccctaatgtaaactatagactttgggtgataatgctgtgtcagcataggtctgtcaattgttacaaattataccaaaccggtgtgaatgttgacagtgggggagctatgcattgtgggagcagggaatatatgagaaatgttggtaccttccacttaattttgctgcgaacctaaaactgctctaaaacataacgtgtgttaaaataaaataaatttatataatctgcatactgaagctaatcaatcttcacaaaaacaatctggaataagaggtcagatccattcaaagcttttaagttgagctgcttggttattgaagtgaaccagcccatgtctcccctggtgacatcacctagtcaatgagaagctgacagcaaccaagctcaacccctttcttagaagtagagaatcatttgtgatggttcttccaagacaaaagcctctttggcctctatccccttacaaaagtctctggggcaagttgaaggtgccacatagatagactctgacatgggatccaagctgcagcttcagagggaccctagtgggtaaaggctggcagttacgtgactggggtccaaatggggtcaagaagaggagctggggagagagaattactcacccaaagtgctgggactaagaaggtttcaatcacccatgaaaaaatctggacatttcaataatgaaacctgaactctgcctcccacatcagtgagcatcttggccttcatcacactaacaactttactgctcacagggcttccctgggaatgggggccatttccaactcatgacagccttcgcttctattcagcctcacctcaggcagggcctgtgtgactgcgagtgaacagggcagggaggttcatcttgtccaaggccctctttctggagggaaaatgcagggacaggtccattaggtgagatgccatcttaatcctaaggcaggcttgctgataaacatcagcagggcaagcactctacattgcttttcccacagtaggtatgggcgaatggtgctaagccctcttctgaacacccttgtgaccaagggcctgagttcacaggctgcttgacctggactgagacctgagctggagttgagagaagagatgggcggccttgcctctgttacaggctgtggggaaagaattccatggctgtgggcctagtttctgcattcataatagaaaggggctaggccaattgattgccaaggtccttcctggctctgatttcccctacaggctttatatctgtatgttagattctccacctagccagggatccaacactaggcactgacacattagtccagtgatctatccaacagaaaccagcaaccatagctcagggccagggaacccctggcaggagactctggcatgccaaacctcacttattctcccattctagccaggtgagcaagcatgccttaggttgcaatccaaagtggaactacaacctgaagagcttattccctcctttttgtttgctctaagacacctagagcagcccagagcaagagccttccctacacacagctgcagcccctaccaaaataacagctgcaacggccagcaatgaatagggcccttcatgtgccagccacctttcagtgaaggactcataataacaaacacttcttgtactttggcaacgtctcagccaaatatcacaataatggccaggctctaggcaatagacaagaaaaactccaatatcctagggatacaattcaatctcagcagccttaaacagaccaagaaaaacaagttgtgctctttctgggctcttggtatttactttttctgatgttgagtttcatgattcccctatccatgggtaggagcggggatggaaaaagcaacaatccatttttccatattgataatgcataagctagctgagatttctaaagcttctacaatttttcatttcttcttcccgccaaagcttacccagaagtttcccttaatgagaatttcctctgtttcatttagagtatgatgttcgacttggaaacctggaagccagcccttttcagactggcctttgctcatcagggaagtctcccataccacagtcagttatgtacataagacagagtagtactcaccttggtggtataaaattaaagactaaatgaaggaagcaacagacttcaaaagaaaagctatcccctccacaaaggaaggagatgagaacaagaatccatggaacagcccggatcactttccttttgtcattagtgagcccctgaggacggattcctgtttgacgtggagcctgtacttttgacaaagtccctgaacatgacccttaaattgattttaaatccctcttcagaagaaactgaaatgataaaacacacagcatcttttaaagaccatctgccagaaaccacccaacagatgggggcttaaaactctgttagcctgaggcctgccagtctttgtttaaactttaagagaactgcaggtgttaaatgggccccaggtttgcaggcttctttagggcacaggttctaatgaggattctatgagaattgctagacaattggatcaggacaggcctgcaaggctccaaccaagcccattttatggttcacatggaggtctcgagatacataaaatctccctctgaaataaaaaaaaaaatgcttagaccatgttttttttttctttaattgaaaagttgcaaagaaggctctcagagaacattgggtttccatgccactgcatgcaaaacttaggcctacaatgcaaaatacctaaatcttgcaacttttcctattttcatattagtttcctacatgaccttgggactagcagatgccttagggagtatttaatccaaactcaccacacacaggaggaaactgaggccccacaggaggagctacttgcctaagactttgcaggatgttagtggaagaaataagatcccactatggtacagtgtccttcctaatatctctgctactctgggtctacagtggtgggagagacactatggcagggggtgggttggagaaagacaaagaagtgtgctattctagttatctgttgctgtgtagcaaacaaccccaatacttagggcttaaaacaatgacagcatttattttgctcacaaatcttcagcttgggcaaggcttggttggggcagcttgtctctggtcaactctagctcgcttgggtcattcaaaggctgggggctggaatcatctgaaggctcattcactcacatatctggtgggtgattctgacttttttttaattaactgacttttctgggaaattattttattgattgattgattgagacagagtctctctctgtcacccaggccagagtgcagtgtttcaatcacagctcatggcagcctcgaccttctgagctgatgctgactcttggctgggatctcacctggggctttagccggaacatcatctgtaagaggcctttccatgtggccacttggcttttttacaacacggtttcaagatggggggtaccgagagagagagcagatggaagctgtattagcttttccaacgcaacctcagaactcatccagtgtcacttccactgcattctactcatcaggcatgagtgacccaggcaagtccattttcaaggagaagggaattcgactctatttttgaatggaaggggtgtcaaagaatttgtggacctgttttaaagccaccacgtatgccaaagatgtctttttctaccacatgggttagaaagtgaggaatcgattttcactgttttaaatacacagccccacaggaaagtgtgctttactctgtgcctaccatatactaggcactagactgaatggtttgtatggctatttcatttcagtttcaatcctgacaacagcagtcacactcacattttaccgaagaagaaactgagactcagagatcatctaatttgcctaaactcactgaattaggaagtggttgaggtagattttatcccagatctggactgaaggctcactctcttttcataacttcctgcaacttcctgccagcttccactgaggtgggaaactgtatccctgctggtacaacacccctgaaaatgctgggctctagagaagtttgatataaatgaaccctccaccatatataataaaatgagcaaaaccttccctcccagttgctggcaaggtctacttcttgtacagatgagaagaaagctggggctctcaatttgtttggagtactcctggtgaaatcgtgtctaccttatgcactaatgaaaggatcagtggttctttgcctgacacaatctttttcatcctttggacccagcttaaatgtcacctgctcaaaaagtccttctcagattatcctatcaaagtaggtccccgcttagcagcatgtcccatcactgcccatggtttgcctccttcctggcatgtatcccaaccaataattacacacgggcttagtcacttgcttattgtctgactgctaccatagtgcctggcagagagtaggtgctaaataaatatttgttggatggacaaatgactgaatgagggaatgatcctagactgtaaaaaccctgagatctgtagagcttctactttttacctcagaatgctaggaccacaggtccacactctcaagccccactatggaaaaatcaggtataataatagcaatcttaatgaggcacttaagtataaatcaggtacttttccatccccttatgattattatctcactgttccttacaacaaccctgtgacataggtattacaattattcccactttacagatgaggaaactgaggttcagagaagatacgtaacttgccctaagctaacaccactagaaagaagcaaaactaaaggttcttactgagatctgtttgactccacagcctgctctatcggctattaggcaatactgccaactatgggtttctttaaagttttgattaaaaaaaattaaaatgtagctagagatcagttttaaacaattaatttttatggaaaatgacaattgcttacttgactctctgacaacacattactaacacaaaggactgtttggactaggtccatgcatgctggtgacaggtacccaaattataggatcagcatttgtgagcctcttgaatcttcagaatacaaatagggaatggtgcaacaaagtttggctttgcttgaactctttaaataagagggtgacttgatctaaattattctaagttctcagttttctacccaggcatagggtttaatgtagcacgtggctctcatgccacctccagcatttcccttagttgtgggttgtgatatggtttaggtaacttagagaaaggttaatgagaaacctgacattttctgggattcactgaaactctaggtccttagtccagtttggggaggaaagtgcctgtaatttttcttaggtgctacctttgagatatctgttacattctaactttcatgttttctatcagtccattgtgtttgaaccatatgcctagtgtcttttcacctgggagagaaaattagaaaggcaaatgcaagccattctactcataatgtttgtgcagaaacatgacgaaataagccatgaggatgttatgctaaaagaaaccacagtccctgagatgaatctcacacagccctctattcctcacagaatctcaaggttggaaagtactgtaggaagccaccaagtccaggtcccttctcaaagcccttggcaatgacatctgacctttccttcactagttccaagtgtgtgtgtttgttgagtgggggaggtcactctatttcatgagtggccagtgctgactgatggaaaagccctcctcaattaaaactccagcttgacctctctcaaactgtcctatggaaaactagagggaaaacagcccatttcttctcctctaatcagggctttattcacaacaatatgttccaactagtctgaaagtttacaaacttatctttgaaacaggtgctcttaagaaagatcattttcatattcaaatctaaaaacaaatttcagaaacaattgtctacaggtaggagacattaaaaaataattgtttaatgaatgaatgaatgagtttactcacaccaataaaaatggaagtttcctttactattgagttaccatcaggatacatcggttttggagtgacaggaggagagcatctcttggacctcagagaggggctgatgtctctgtctcccttcccaccccatcctgggagacaggtagaagcatcagtttacatttttatcccctcaatgtccagcacaggacctagcacagagtgaatgctcaataaatactccaaagaatttccagtaatggaaagagccccagagaccatttggcccaatcattttcctcccagaaatataaaagagaaacaagtcagtaatttcttgtgggttcctagaaagcccctcccccaccaccaaatccaataccttttcatctgcttttgatgcctaaagttcctttgatggaagtctagagcctgtcatggcacacattgtcaagctttcccttctaaagtggcaaggtccaaaggaaagataaattaacctcaactcacactaaggtataaaggacagtgggcagacctttctggaaagctacataaaactaactagcaacgaaagaatgagtcatgtgaatcctaaatctctgcttctctgagctaggtatcatctaagctgatgagattgcctacctgtctcctctgggaaaacaaaaaagcagtttggaagggcggtcaagtggacttcccttcttaaaggggttgcaagacccacaacaagagatccacatggtgcctttgatgtgacactcgttaggtgtggatcagctctccagtgctttgcaaagacatctgttaccctgttaatcacatcctggacaagctccaggatgtctgagtcaggacccatgggacactagtacttttttaagagcccttggtctaccctagaatgacactttctactcaagggtgtgttgactaaactatgaatcagcagcccacacatagcaagtgctctaagcatatggcccttggcaatgcttctcaaatgttaatgtgtgtatgaatcacctggtgatcatattggaaatgcaggttctgattaagtgtctggggtggagcctaaaattctgcatctctaacaagctcccaggtgatgaacatgccgctggtcaaacactatacattgaataggaaggttatttctaaaattcactgggtgaaagaagcccgtgggaagcatgttgaacagacacaatcccaggtcaccaacctcaaaggttttgattcagaaaaactgaaatgggaccatagtgtatacatatttaataggtatccctcagtgattcagaagaaggcgcttagtcgatggtactttaagagatactaacatatcactttttttttttgaatcacagtctcactctgtcacccaggctggaatgcagtggcacgatcaaggctcactgcaacctctgcctcctgggttcaagcgattctcgtgcctcagcctcccaagtagttgggattacagtcgcgagccattactcctggctaatttttgtatttttagtagagatggggttttgccatgttggccagctggtcttgaacccctgacctcaagtgatccacctgccttggcctcccaaagtaagagatactaacatatctcttgaatgatcatactgaaggtgtgtcctctggcctgttacagaagagaaatacctgacatccacgcctcctgaccacttaggacagtgactgtcaaactccaaggcacatcaaagtcacctggagggcttattaaagctcaaagagctgccctcagtccccagggtttctgattcagtaggtctggggtggagcccaagaattcacattgctaaccagttttccaggaaatgctaacattggtggtttggaggtcatgctctgagaacctgtgatatagatgaaaggtaaccttttaaaaatcaccagaggagcttttcaacccacactcattatgaaatgcttggggacaccaacctatgtcttttacaaacagcacttcagttgctaagcacccactcagagaacaaatactccaaaggaaaggccccttaatcctgaatagataatagttttaaataaatattcttaggaccccagagagacatgtgggactgctgaccaactagacccaggggtctcagacagggaagacctcaggcccaaacccaaggaaaggcctaacagttgctgagcaggagggaagctgctccatagggcggtgggcccatcgttctcagtccccaaagcaaaggaggtcatggctcccccacagcccacagcatctccaaccccctgagcccagccatttattagcccacataaggcaacttcagtttagccgaacagcttatctataatatatggaaactagagagacacttgttcattgagatcttccccaaatttatcaagacagggagagaagaaatgagttgagtcttcctgttccacggaataggaacacattctacctggacctatggtaatcagaagtgcagtgctcctcccctaaaacactccagacccttgaaagcaggttcatgtcattatctcaagagcagcattagccaggaaggctaatgagggctccctgccaggaaggaacagcctagagatgcatttcaggaaagaggcagcaggcagagaacagctgccccagacagacagcacatccgccgagggcatgattgcatgggactcgagaagtatagtaatgcattgcttaacgatggggatttgttctaagaaatgcatcattagatgatttcatcacagtgtgaacatcacagagtgcatttacacaaacctagatggtagcctactatatgcctaggctatatggtatagcctatcgatcccaggccacaaaccaggccacagtacagcatgttactgtactgaatactgtagacaactgtataacaatggtatttgtgacctaaacatattaaaatatagaaaaggtactaagctgggcagagtggctcatgcttataattcaagaacctttggaggccaaggtgggaggactccttgagcccaggagtttgagaacagcctgggcaacatagtgagaccccatctctacaataaattaaaaaattagctgggcatggtggcatatgcctgtagtcccagctacttgggaggctgaagtgggaagattgcttgaggtcaggttgattgcttgagtggagtggagtgtaacggaacagaatgggaaggaaggaaggaaggaaggaaggaaggaaggaaggaaggaaggaaggaaggaaggaaggaaggaaggcaggcaggcaggaaggaaggaaggaaggaagaaagggagggagggagggaaagagagaaagagaaagaaagagaatgacagaggccgggcgtggtggcttgtggctcatgcctgtaatcccagcattttgggaggccaaggtgggtggatcatgaggtcaggagttcgagaccagcctggccagcatggtgaaaccccatctctactaaaaatacaaaaattagcagggcatggtggcctgcgccagtagtcccagctactccagcggctgaggcaggagaatcgcttgaagccaggaggcagaggttgcagtaagccgacactgagccactgcaccccagcctgggcaacagagcaagactccatctcaaaaggaaggggaggagaggggagggaaaagagaagaaagaaaggttacagtaaacattaaagataataaatggtacacctgtatagggcatttaccacgaatgaagcttgcctggactgaaagttgctttgggtgagtcagtaaggagtggtgagtgagggtggcctaggacattactgtacactcctgtacattttagaaacactgtacacttaagctacactaaatttattttaaaaaaattaattgtgctaggacattacgatggctatgacttcagcacgcgataggaatttttcagcttccttataaagcttatgagaccgctgatgtatgtgcagtccttcattgcctgaaatgttgttatgtggcccgtgactagtttgatttgggttctgcctgccccatggtctcggggatgggaaaggcgttgagttgtgtgtttatggagtgtgagcatctcagcttcttgtaatcccaagtaataactgcactttctgttcctcttgccttctgctactctgagttaatgaataacaccaggtaactagtttctgaggcagcctaggatcccaattctcaggttcctgcttgtatgaagcaccattttaccgaaacttagggacaattctgaggcagtgaccacctttcatgaggtgacatgttgccaggcacagtagaagcaaagcaagtgtccaccacgtcttcatgttctagatttttagggacagttcccagctcaagtattctgtcctcttgttcaaccaataagtactaattagtggtgatgaaaatatacataaaccctagagatactggttaaggatgactataaaacaacaatgatgataattgtagctaacatttttgagaccggagtggtagaggtattatccccattttagaggtaaggaaatagaggctcaggaagctaagataatagcacaaagctaacatcatctaacctgagtctgtctgtcatcaaagaccttacctgtactctacaaagacgttctgaacttatgatggcataacttaatgatcttctgactttatgatggtgcaaaagctatgtgcattcagtagaaaccatattttaaattttgcctttttttgtttatttttattattataaaataggcattgtgttagatgagtttgcccaactataaacttgtgtaagtgttccgagcacgtttaaggtaggctaggctaggctatgatgtttggtagcttacgtgtattcaatgcatttgtgacttctgctattttcttttctttttttttttttttttttgagacggagtttcgctctgtcgcccaggctggagtgcagtggcgcgatctcgactcactgcaagctccgcctcccgggttcacgccattctcctgcctcagcctcctgtgtagctgggactacaggcacgcgccaccatgcccggctaatttttgtatttttagtagagacggggtttcaccgtgttagccaggatggtctcgatctcctgacctcgtgatccgcccgtctcggcctcccaaagtgctgggattacaggcgtgagccaccgcgcccggccgacttctgctattttcaacttacgatgggttcatcaggatgtaacctcatgctagctcgaggagcttctataccctgttgtttctgctctcacatcctgtactgacactgcagaatagccctgaaggttctccttcctggaagaaggagcaacagtcttgtcatctgagccagctctgccaaaactgcttttcaaggagcgaaaggactcacccaagactgagacacacaagattttggactggtacaagggaaggggctttcctggattgatgcctacactctagcagcagcaagtaccccaatcttcagactcagacccagcccagggtcacaggtttatctccttcactaggaccattcaggctcatgtcttccttgtctccaccctgctaactgtctacaaactcagaaaaggcctttgaatgtcacacagttctgcccgtggcagaaacacacagaaggagaagaaaataggtggggaacttcagaatgtgccataagatagaaactcctccaatgttcccagcactgaagcattaaaataaaatctttggacaattatttgcctggatcgagaaagtaaagtcattttaggagctgccactaatcttaaaaaataacaagtgcgatttgatctgtgcaaggaaccagagtgcttgaagatttctctgccggaggctccgcactttcatgaggtatcgacaaagacccaagggtaagttacgggggggagcacgaccactgtgagcttttgcagaagtagtaggaactggctaagttaagatcaatgatttccttgattgcctggcttccccctctcttaagcctggtctccgtctcaatttccattcctatcggccagaaaaataaagattgtttacagagctgaaataacacctgcttggtttatcttattttagaaacaataaaagctagggagttggagggattaaggagggaaaaaatcaattgtgttctttcatgttggaaacattaaaaaataagtcaccctgctacctgctctaaggtccaatttggctctccattacccagggcaatttccaatttcatcctgcaatttcccaaagtttaaactcggctgaaccataactgaatgcccttgacagactccaagaaactttttctggtcagtttttgacaattccaggccatgaatctgatgctagacatgccaaaagaaatggaaatgtttgctttggcattagcaccaaaatacagtcagcagcccgagtctggctgaatcattttgaatgtttttaaaatgttttacatcttgttatttcacagcatctttgtaagaaaagtaaagcagatttgctccctctcccaccgaccgcgcactatacagatgtggatgttggaaaaaaaaaatccaaacaacaaaaagagaggaattggctggccccaagccacaaggataatagatggttaaactaggttagaatccaggttttctaactcctaaggcagtgctcattctgttctgctctagaccatgcacctttgcaggatgctgccagcccaaacgcaggagtgattgggctcatcagataagaaagccacgtcctcaaatccaggctatccaagggtggccacagcaagttcagcaggatgcagaatatagcagcctttctccctgcctgcatctccccacaaaaggagctttgaaggaggacagggcagtttgaagtgtgaccccatcatacacttcacgaactagcataccatagcccctgcttgccctcactgagtttaagcatgataccagtcactccctgactcagtctcttcatctgtgatgaggaataccaaatattctacagcagtgttccaacatagggggactccatctctacaagaaattaaaaaattaatcagatgtggtggtgcatgcctgtggtcccagctacataggaggctgaagtgggaggatcgcttgagtttgggagcttgcagctgcagtgagccatgatcacaccaccacactccagcctgggtgacagagcaagaccctgtctcaaaataataataataataataataaagtagagctctaaacttgtctgggaataaggacggtttttaggctaacaatatttgccaatccatacatgttggtatttataccttagtggccactaatattatttctcagaaaaaagttctaaatgagtttctatttttctacctacaacagcttctacatccatttgacaaatagtagtatagaagtgttcaggacaaaaatgtctcttggtctcaggagatgccggacgccagcatggatgtgcagatgggaagcctcttctggaagacccccaccccagagccggcaggaagcaccgtgattctgagcttggttgcctgtgaaggaatgcttataaagtttttccaacagcagcttctctaagggtaccaactctgggagtgggaggctgaagtgacagtagggggtcagtgaggaaccctctgggtttcctacaataaggcgatttcacgcagaagctggcgaccagcactgcagccaggggaccagccctctttagtcagaaacacctcaaccctgcactcaaagggactcatggacttggagtccctgccggtgaatggccctgtgtgagggcctgtgctgcatcacaaaatgactttgccaggaagctctagagtgtcaaacatccacacatccttggctctgggctgaggaaaatcccctggttggtgctttaagaaggaaccttgcggttttaggggaagaattctccacggacctattttaccacagcacctatttctgcagactatctcaggtaaccggaatttcaaagggcccaggatggaaaacgttagcttcaagtcttccttctctggaatggattccgctgagtagaagaaggctgggtttgaagagggaggaatgagagacaggctcaccattccggggtcccctgcatgtgccaggcaacaaactgagcacattatatcccttctaattatcttgttttttacgaggcacatattagtacccacctccccattttgttagtggggagattgaggctcatagagcttgccaatgagaggacacccagggctgactcaaggctgtgctgttcctgcggggctgtcactgccaaacagggagtggcaaaaaagagtcgcagcacctcaagcacctgtgccgcatcacccatccatccatcagtcttcagacctgtcagctcagccctttctgccagtgcttaaatgaactgaaaagaataacaaacccaagttttaataagtacatgcaaggaggctgccgttggcccagatgcacctcagttgtgctgatgtaagcatcaagccagaacacaaaaagcccgagcactgagcgggactaataggtttctacacacagtggcaaggagcccacatccttgggctccctgcactcctttatgctccttgaacattctgggcctaccccgcctccaggcctttgcacatgcagttcccttggactacaattctcttcttcccccttttcacttggctaaattggtcttgcttcatggctcagctcaaaagtccatttcccgggaggaccttccggaccttttaaatgctctcaagactcccaggacttttgttaacaactcttttcagattttatactttgtcagtcctaagtatctgtgtcatatctgccttcccagctaggttgtaaactcagaaggggacaaggaccctgtctgtttattcactaccctgtctcagcatgtagtcaatcctctatatactgtgttgatgtctttataactatttccatgactctgaagcaagccccttagcaaagtacagtagatcatttactcattgatttttttttttttttttgagacagagtctcactcactctgttgcccaggctggcatgcagtggcacgatctcggctcactgcaatctctgcctcccggcagattctcctgcctcagcctcctgagtagttgggattacaggcacgcaccaccacgactggctaattattgtatttttagtagagacagggtttcaccatgttagccaggcttgtcttgaaatcctggcctcaagtgatccacccgcctcagcctttcaaagtgctgggattacaggcatgagccaccgcacctggcccatttattcttcaaatatgtgccagtcactgtgctagggattaggaacattacagagaacaagatcactaagactctcactccaggaagctggcattgccgtgggagagcagaccatgagcaaataacacagataaacagtatcagggagaggtaaatgctgtgatgacagaggaaagcagaaagggggctagagagagagcaggaaaggcctttccaggagttacagttgagcaggatcctttgtgcattgaggcagtgagctctgtaggctagtagaaagaaaagtgttctaggcatagggtgccatgggtgcaaagcctttaaggcagtgtccaggaatggccagaagaccacaatagctatagtgaaatgtggaaactggggagcagcaggaggaaaagccagacgggcatcttggagcaggtgatatagtaacagctggtactcctgatctcttactacatgccacatactgttccaggtgccctagaggacaccatcacccccattttgcagttgacaaagccgaggcatggaaaggttaaccactcacccagttatatgagtggcggagctgagatacgaacccaggcagtgtgatccagagctcatactcctgctataccaccctttcatgtcctgtaaggaaggttaccaagtaaaatacaaaatgtctagttttatttgaatttcagataaaaagcaagtcattttttcatataagtatatcctaaatattgtgcaagcatcttgtttttgtttgtttgtgtgtgtgtgtgtgtgtgtgtgtgtaatctgccaatgccactagtaagccataataaactttggattttgtctaaatgtggtgggaatccactagagcagaggtcagcaaacatttttctgtaaagggcaagacagtaaatattttgtgccatataagaatatggcacatgcagcctctgtggcatattctggtttggttttggttgctgttgtttgtttataccagccttttgaaaatgtaagaatcattcttagccacacatcacaccagctgcagtttctgacccctgatctaaaggattttgagtagtagacagacagacatgatctcactcaggccttcattcttttcatgagggaaaacacacccattcccaagagatgatattcacaccttacccgcatcctctttttttttttttttttttttttgagacagagtctcactctgtcatcaaggctggagtgtagtggcctgatcttggctcactgcaacctctgcctcttgggctcaagtgattctcctgcctcagcctctggagtagctaggaccacaggcatgtgccaccatacctggctaattttttgtctttttagtagagacagggttttgctatgttggccaggctggtctcaaactcctcctcaagtgatctgcctgcctcagcctctcaaggtgttgtgcccagccccacgtactcttatttggggagcactgggggtggctgtgactttcccatcaggtagaggaacagctgcctgctggccttggtgttaggactcactttagcattaaggttcaaccatggcacctcattgacaagccactggttaaaccttttctcagtgccaggcttggcctacttgtgtctgggatggtgatttgactccagggtttcactgcccatgggatgtatcagagatgaacaggatttgtaccttgtagaccaagttcccttggcctactttctggatctcatccctttctgcattgaatacaggcacctggccctctccttggctccctcctcggctccctcctccctccccaggcactgctcaggccttattcatcatttgtctccatgggtgacctcctttctggcctcttcctgcttttttctctcattcttcttcttcaattaaaaaggctttagccaaaatgaattcctacctctgtcaggccttcaaattcctgttttctggacatttcagatttgccttgaagagtgtgtaagacaaagcctgttctcctttcattctcaccatgtcttactggggccctttatacacagccacctctcactgcctctttatagggtcggtgtttcctgtccaacaatttgccttctctgggaatacaggctaaatcttgctttttttttctgcaatccacaatccacacttcactttggacataatgaagacacaagaatataagaatatttattaaacgcagttcttccatttttcccatctcttttctgtgtgtgtaagctgtctcctccctgcttgtcagtctctcctcttgtctgaagttaaccagttggaatgcaagtctgcaagatggtcacacaagacctttttcttcattattgtactttcctattccttgagaatattcatcatctttcacctaactgaggttttctgtctgcctttccgtttagtcaactaagtgggcaagttagctaactgtatgttggcttgtatacaggaaatggcaagtaataataaaacagtcaagcaataccattgactgagacctccatgaggtactaaggaagtttgagagaaatcaaagatccctgggcatgcaagtgcatgtgtgtgtgcatgtgtgcgtgcgtgcgtgtgtgcaaaagtaagtggagagtggagaaagaggaatgtcactttgatttagccttctagggacaggatacagtgcaggaatctttcccttgacatgctttctgggaaatttccaatgtctggctttgaccactctggctgttttaaatcagaaacactctttggcctttgaataggtttcaaaatcatcacaagagagatgtccatgatttctctctttttgtctatattccagtcctttgggttgcatgatcttgtgaaatttgtagccagcgaaacccagtagtgataggcaccatgatgaacaggtctgagtatttatttaacactgaagattaataggtcactgcttccaacgtcgaaagccattgtcacattaattcatttgtgcatacatgatgtccactgctcctaagggtacaaataatagctttgccaatatgaaagcaaaacataattactcaacaataaacacactgtacactgggaacagctgttatcaacagcacttttgaagccaaaacaaagcaagtattacaggattttttttaaacctctgcctatcattctcacagaggtaaagttagttttgtttgtttggttttgtcacaacaagtgcaactaagctacaagtactttactcagacaccattctgccctcgctttcaggccagacaagatgcttggcaacatttttgtctagccagtgcccccctacacacccacacatccctacacacctacacacccctacacacacacacatccctatatacacacttccttttcctgatgctcagcctatctgtagagtctgttggactgagtgggtgggacttctggtgccaacacttactaactgggcaactccaggcaagctatttaaccctctcggccgcagcttcttcatttgtaatatggctgataataatagtacttacattcttatagagtgataatgaagtgagaaaatgcatttaagagtcctagttactataccagatacatagtaagtgcttgataagtgcaaatatcattggctaagctcctccagtgtagaacctcactaaggtccacccttcccagggatgtttccagtgcatttccatgtcaaaatggacccatcagactccattaagccccaatctttgctaactagttgatcaatgacctggtccaggtgagtaccaggaaattcacaagttatgctgtctgactggcagggtctttgactcttttgcaaagggcttacagacattattgttgggattactactaatttttatttgggggtagagggagtatttgaaactctggaacccaaccatgcagagaactttgcagacaactcaaaaacctatagtaaaaccaggtcagctgtcctcaacacacctcaacatgctctgcctccatccaagaactctgaaagagcttttggctgtttgcacacctacatgcatccagagtctcatggttctcccctacccctgccccttctgtcccaaggaaagaaacaactgcctggggctgtagacttctcaggaagctctaatgaatcacttctgcagttctgttcatgcctgcctggggacatagagccccctgcccagggagaacacagcccttctcttggaaccatgttgtagcaatgcagaatccagcagctgcagggttgacgtggccttagtagccccctactcactaacagagaatgaacttagggagtagacagggggctttgttgcattagaaccaagcagccctcacaatgatgaggttccatttataaatttgggacgtagtaaagtagataggaagagtgaataggctttgaaggcagatagatgtgggcccagttgccagtttttcctgccactctgtgatgtgggacatattccttgacctttggagctttggccttcctgtgttaaatgggagcaataggatgatgaatatgctctggctggaggagcaaactctcctgaggattagctctcccccttctcagctgaatcttgagggcagcatgacctcggggagtgtcagagttatgttcttcctggagatgtaaatcctttaaaagcacaaaggaagagtctgcactggaaagcaaagcaaaatagattggaaatgttcagtggaatttaagcaaagaatgcagagctgctctcctcttctgctgtctgctgggaactcactggggagtccctcagtgtccacccattaaagaggctgctgagcttgtctgtgggctccacatagccatacgtagatgaccccatctgcaaaatggcttgtcctctgtgaacaagagtcacctcctagacaaaaacagacttctggatggggtgagcaatctctccctttgggttccagtaacgagtccagaagcttagaaggactccaagccggaggcaaggagaatacaacgtatatttggtatctaatttagatggtttatttaaaaatcagaaagcattcacctctattcaaaaatggcccattctaggttaaattcttaattattctggaaaatgcaaatgagaaactataaatatagagtaggggaataatcgcaatctgcacaatgtaaattcaagtcaatcggtaaagggggaaagaaaatcatttgcctttgacattaaatccagctgttctttaaagttggttttccctagccaaggatttttattctctatgaccaaacaatgtccaaatccctctgagtttagacaatacttaatctgaacatctaatagttcattcttctctaacaccactgaacacttccattaaaccaaagttattattatcaacattatgaagcctgtcagaagcaggcccattgttcaaacgaattgacctccactacaattgaccttaacattgttcaactgtttgacagtcaattatctcatgatctcccttcaaatgggtctcgttgctgaaataactaatccattacagaggggaggttattttaatagctgcgcagagggttgcgttttgcagtctccccgtgagtatatattgtggaacaacttgtagcccttggtccatctgacaagaggaaatcattataccagatccatgtctcagcagaggaaaaatatgataataaggggttggtaggactcagttatggctgaagtgaagttagctcttaaaatgtagcagctcttagagacatagacatatgtggctctgaactacagaacagaagaggaaatgaggataagggaagcttaagcaaccagctaagatgttgcagccatgcaaggaggttagaggagagactttaagtccctttctagttccaagcatctatggcagggcctctttaaaagaaagggattggctgggcgcagtggctcacgactgtaatcccagcactttgagaggccgaggcgggcggatcacgaggtcaagagatagagaccatcctggccaacatggtgaaaccccatctctactaaaaatacaaaaattagctgagcgtggtgatgtatgcctatagtcctatctactcaggaggctgaggcaggagaatcgcttgaaccagggaggcggaggttgcagtgagccgagatcgcgccactgcactcgagcctaggcgacagagtgagactccatctcaaaaaaaaaaaaaaaaaaaaaataggactctgaagtcagatgacctgggtatgggtcttgtgccaccactttctagctgtgtgacattggtcgagttgtaaacctttgccagacctcaatttcttcatctgtacaatgagaataatagtatctatcatgtagggttgctttgaggagtacatgaaatgcatggtatcagtatagaatgaggcccgtaggtagacacctaaatagcattattataatcattataaatgccaacattctccttctagtcactttgagagctagctttttaccagatatgtgacctctaaggatctttctgcctggatggagaacttggcatttagaactgtaagaataaggattttctcagtccatgaatgaggcctaataaaataggacagttaataaaaataacgagtgcctcataaatcaggaaattaagtgcttccccattaaaccaggctcagcccccacatttatgggccactggagacccagctgcctcttgaggagctcatgcacctctgctgaagggaaactagagtgcctgcctggcaggtcacaggctatagcgaggattgagggtgctgtcccgctgcccctttcctatcagctttgagggtagtgctccacacttagttatgatttgtctgaggcccctgagattcctgaaaccttaactcatgtcccctaaccctagggcactgaaaggtgacttggctcctgttcacacacaatagagcccaggccaatagagggaaatgcagaggggaggagaaagaaaggggtagagaaagaaacagccttcttcagggccccacaccaactttcagggatctttgaaactccctctcgtaacaccctgtttattctgctctcacagccacctggggaggtggagatcactatctccaagacacaggcaagaggacaaaccctcagagacatcctgtgacctcctgtggtcacccagaaccagaatccagatttccttcaaccctaacccattgttaccagtgcagtccctatttggggtcaatcccctcatgttaccaggatgcaattcaaggaccatggcattcattacatgtgtccaagggtcaggctgaggccctgggttgactgcagggctgtctgagtagagctctccaagtgattgtggggagggtgggtccagccagagaggtgcctgggggtggtccctgagtaccaagtggtctagttgtatgctggatcctctcctagaggctcccaagaccccattgtcctcacctcatcccaagtttggtgaccacacttacagcttaaaattggccatggtaggagtatttacaccacaaatatcagtgaacgtcccaaatcaggaaaatagttcttcaacatttaccggcacaccactgaggaagcctcaccttttatttcttcattcatcaaacattcttagagcacacacttggggccaggcactgtgagagtcactacatatatgaaaataatggatcttgcctgcttatgttgttctgtcactggcttaatatatcccattagggtgggcagggactcccaaaagcaaagacattcaagtccagtcattttggtttatgtcatcagcttcaataataataaggttgcaagaggatttaaatttaaggttgctatatcatgttaaaatccttggatgccccattttcatgaaatctgtttctggttgtccttctgttggttattgatatgatttggatttgtgtccccacccaaatctcatgtcaaactgtaattccaaatgttggaggtgggacctagttggaggtgattggatcaagggggcagatctcccgatggtgctgttctcatgctagtgagtgagttctcgtgagatctggtggtttagaaaggtgggtggcacctccttctctctctctcttgcttctgctctggccacatatgacgtgcctgcttcccctttgctttctgctatgattataagtttcctgaggcctccccagaagcagaagccaatatgcttcttgtatatcctgtagaactatgagccaattaaacctattttatttataaattacccaccctcaggtctttcttcaaagcaatgtgagaatggactaatacagttctgtgaaagcattgcccaagtattcattctccatgactttctcacctgaaaatgatcgaaagttttgaagtatatagagtggcctcttatggtaattctccccttccttcattttctcactgccctatcccagcttctcatgagctctctccaggattgttggattaagtgatctcctaattgatacctctgctcccatccctcatcatgatgctgctatcagagtgagcttgcttttatttttctttttatttattttttattttgcagaaacagggtcccactacgttgcccaggctggtctcaaactcgtgggctcaagtgatcctttggtctcgtcctcccaaaatgctgggattacaggcataagccaccatgcctggcgcttttagaataaaaaaagagtacctttttttttaaatttaaatttaaaaatgcatgtcaattttaaaaacttggaaaatacaaatgagcaaagaaataacctctaatctcatcaacaagtagtgctcaggtttttctcttaatatttatatatacacagtggtgggctgggagatgtttaacaagctctctgtttttttaagcccttatttgtagtatttggcaatttccataataaatacttccacttggcttatttcatgctaccaacatgatatcactgaacatggacttggaaagagatgctagcaaatcagatcttgcgagcttatgtgagctggctgcagtgcaccactgtaaaactcatatataatttgaagtgaaatgtggaaatgctttgtcttgctttgtaacacactctttaaagtcttttcatgccaatgaatatatatcactaatataattttaattagctgtacagtattttgttgtatcaatgcataattaactcaacagaatccacataaacattatgatttttgctggtataaacaatgctattatgaacataattacaaacagatctgtgtggacacagcaatagttccaattcagaaatctggttcttgcctccttcttaaacatctggtatggatccttttgcaccaccacaaatcccaactccttcacggggttgttcagaacccttcaggctgcttaggatcttccagtcctacaagcctggcatttattcttacacagcatagctcctttctctcccccagccaccatgaatcaccccatgttctcaatacaaacatatttgcctcacatatttgagtattgactccccagtctctgaaacctccttctcttccccaccacctcctgttcattcatcaagacataccctaggcagtgaatatttcccctgggtctcccagcattgcacagacacctctgttatggcatctaaacaaatatctgtgatctaaatctatgttgatctgtctactcagcaggaccataaccctttgaggatatggtaagaatgagtcttcctcatcttcatatgcatagtaactagtatcaggcctggagcaaagctgaagcttaataaatgattgttgaatataatcctttatgtacttttccacctgccatcctctgcatgatttactttctgacagaaagcatgaaagtgtccctgacagacctgaaacccatgtccaggagaaaaggagaccagtgctgacagcttctgagtgtatctcctcactttcccagagcctgacctccaaaaggctcttctagaagctgtggaacaccccagccttctgaggctccacctggcccctctctggaaaaacagcaatccaacccaaagagggcagagttgactttcttaactccaaaatctcttacagtgacaatgacatctagttttggcaatgtactacaaaataggaaccacagctatttataacttttaataggacctactatgcaccaggcactgtgatcaggagtttacatataatttttacttttcatttgattctcacaacaatctgatgaagtgttcattagtaagaagatcaagcttaaacaggccaagttacttgatcaaggtcacacaacttttaactctgtctcccaataccttcctaatgtttactgcaactttttaaaggcagagcagggataaatgtcaagagatgggggctcagcaggataaatgacacagtcaaggtcaaatacctagaaaaggagatcatcccagttttcccaggaccgttgtgattttaaaaatgaaaaatctcatgtcccaggaaacccatcagtccctggaaaaccaggatggctggtcatcctatgaaggcatagaactcagggcctctggctcctggcatagtgctctttccatcacaaacatatgtcctactttctcacttcatggagggcctaatggaagatacagtcattaggatgcgtgtattcattttcccgggcccttagtgaaataggcattttggaatctgtttgggacatcagtcactcaggctctcaagaagagacagaccccagctggacatgttctttatagtacactccagtgatgaaatgcccagtttctcccctgcctcctccccctgcctggcacacctggactgctgccactcatctgtataatgtgcctggcgccatctggcctggcatcttgtgtcctgtcaacagggatgtcaaacaggcaagatgaaaggacataactccaaggaacattgtttgtcttctagccccagtctggggaagtcgtgatgattactcattaggtagctacaagggaagaaaaatgacttgttactgtccgggtgacagttggtgcctagaacagtctttgctatttcttgtcttagtgagtcttctggggagcatcctaggagtttcaaatgaaggtggatatcggctggagtatcccaagaggctcccagggaattttcatggcttagagatctgatgacagctgtggccacgtcgctggctctgcttgcagtgagcatgcccatcctctttgtgaaagtggcaaacgggacaataaacagatttagcagagctggagctctaaaaagcccaatccacatcttctatctgagccagccttagaattctgggtaaacgggggcccagtaaatggtaattaaacaacttcagggagagctgatggctttttgagaaataaacctccccagggaatccacctcaggaaatctactcagtatactttcttggtataaagcaagaaaacattgcaaagaaagacagatagccttgattgcataaaaatctaatactaatttccatatgtcagaagatgtcaaaatacaagtaaaaaaggaaaataatacactgatggaaaagatacaacaaagttccattatattggtatataaagttcttaattaaaaatgataaatctcaaaatattaaaatggacaaaatttgaccaggtaattaaaatcaataaaaaataattacttgatatctaaactataagaggaggtatagtttaacaaaattataattttattaaattatatatgtctgtgtgtgtgtgtgtgtgtgtgtgtgtgtgtatatatgtatatgtgcctataagcaaatatttataataaaatgttaaaagtggtctggttaacagtaactttaaattttttctttatcctttttatcttttttttttaagacagggtctcactctgtcacccaggctggagtgcaggagcacaatcacagctcactgcagccttgacttcctgggctcaagcgatcctcccgcctcagcttcccaagtagctgtgactacaggtgcacaccaccatgcccagctaatttttgcattttttatacagatagggttttatcatgttacctaggctggtcttgaactgctgggctcaagtgatccacccacctcgtcctcccaaagtgctgggattacaggtgtgagccacagcatctggctaaattttttcttcatagttctctttatctctcaaatttcccacattgagctggtattacttttgaaattatgaaacagtatttcctattaaagaaggcaaagaagtatatggaaaggggttggagtctcttgacttccatctttccccagccctatttttcccatcagtctgtagaatgacgtgtctcttcatttctaggctgactttcacttttttctgtgtcttttttcatgacaaatagagagtaaggaaagctcacgattacagccatcacttctttctttagccaccaagatgtcaacaggcagaagttggctccctgtggttggacaggagaaaacagcacccacctataagctccttgagggcacagacgagtgcaccagtatctgagcctcagcacctagccccaggcctggctcggctactgaacagacctcagggtagtcacacttcagcacatagtgatcttcccctgctgagtactgagaactattaagcatgtggatgcatcgcttccttcagaggtgttccctctttagaggagtgatcagacagatttacaatgaacgataacacaaaaacgtgacatgaaataaatgtgcatcgagatgctacaggaggaaagggggcattaatgtgcaagggtaaagaaaataagcaagcaaacaacagcaacagcggtttagatactgggcagcaaatggatgactagactgatagccaattgattgaacagtgatcagaaagctgcatccgcaactgatagtgtggaggcctagcagcagccctattttcccagaactcctaaaaaggattaggcattgattgtgctatctctaggagtgttggtgggagggacgagaaactaagcaaagaagccttgatgaaagttcattcaagaagcagctggatccacaaatccccttcccatatccagcaagagaccaaaggcttctttactatctggaattggagaaatggagactcccggtccagggacaccaggcacagttagaggaggagggtaaactaccaagtgtaggaaggagtgagtttttgtatccaaaatgccgagatctccaaactctttccccattggattgccagaatcatggccactaggcctatacctctaagcaggtaactaggagagcttttccaaggggatttgaaaagctcaaaaggaaagacctaaaggtactgaccacaagattctctaacaaagtcgtccagtcacaccctacactgaagcctacagatgacacgtcccaacaacaagctcagggcttccaaacagcattctagtgtcctactcttactaagagcagaaactagtgttgacagacatctgagggaaatctctgagtttaaatatggcaatcaaatcaagcaaacgggataaaagcaaccaaataagaattatgtaagaaaaacattttatattcagaatatatttaatatgctgagagatttaaaagaagataaattacatttgtgaaaaccagagctggataatataaaaaaattatgatagcaaaacaagactggtgaaattaaaaagattatagtagaaatgggaaaagtcaacagagggttataagataaagagatagaaaataggacaggaaatataagaaaagcaaatcaccagtccaggatgcccagcatgtaaataatgagagtgccagaaagagaacacgcacagacacacagtcacacacacagtctcacagtcacacacatgcacacagccacacacacagtctcacacacagtcacacacacgcagtcacacacacatagacacacagaaacacacacatacacaaatacacagacatacacagaaacacagacacacacatgcacacatacacaaatacacacaaacacaaacacatacatgcacacatacacagacaagcattaacacagacatgcacacatacacagaaaaatacacacgtacacatacatgcacacatacataggcaaatacacacacagacatagatgcatacatacacaaatacacacatatatgcacacgtacacaaatacacacacacacaaaggaggaaagaaaattaaccacaaaacaattcaaaaaaatgtccctaaaccaaaagacttgaatttctagattaaaggagttcatactgcaagacaaatgaaataaactcaaaccataacacagtgtcatgaaattttagagtacataggacaagttctaatcaaacaagcttctagacagagaaagataaaacataccccttccaaagatgatgagtctgaatggctttgaacttctcaatagtaataccagagaccagaaaacaatggagtgatgtcttccaaaatctgaagggctatgacttgcaccctggaattcttctcttttttttttgggttgggggagctgagtctcactctgtcgcccaggctggagtgcagtgtcacgatctcgactcactgtaagctccacctcccgggttcataccattctcctgcctcagcctcccgagtagctgggactacaggcgcctgccaccatgccccgctaattttttgtatttttagtagagacggggtttcaccgtgttagccaggatggtctcgattgcctgacctcgtgatccgcccgcctcgacctcccaaagtgctgggattacaggcatgagccactgcgcccagcctgcaccctggaattctatacccagagaaactaccaaatatgaaggtaaaataatggatttgtcagataagcagggcctcaaatgtcttatctcctctgcactctttctcaggaagctgactgaggaggggctccttcagtaccagccagtaccatttggacactaaaagacagaggtctaacccacagggcagccagataaagagaattcccgagatgaggcagatggcagggcccaggatgccagaggacaacccacccagatgggagcagggaagagggctccaggagagatttcttgaagatgagattggtgggatggcagaggcttctgatacttggattagaaatacagacaactggcagagtctgaggttgacacagtgatacaatcagaggaaactaagctaatataaaaggacataatataatctaaatgtaaatatcaaacaaagcaaaacaaaaacaaagcaaaacctctagggaaaataaaagatggttcatgaaaggaaaaataaaggcttagtcatgaatatcatttgcattgctatataatataaacactgaatattgatttgaatgaaattaaaatttagctctattggaagagtgaagagaaattaaaggcatgtcttggcacatatgcagatgcaggggtggggtggagaatgcgagtggagtgaaccaattcctcgcctcccacacttcctcaccatagtgggaattccatggaaagggtttaaaatggcaaatcaagaaacagcaacacaagtgtattatttacagaagtctagctgtatgcccccctaaaacagctgaaagagttaaagggcgtctcgctgctgagaggagatggagggtaaggggtagaggactactgtttttcacgacaagccttatacactatttgcttttttaaacaatgggcatgtataaaatttgataacatgttagaacttaaagaaagaatgaatctcagttcttcaagtgccccagcctcttacaggtcttgataatattttcctacctggtctcatgatcaaagcagaggactggcttaccatgcaacacaaggacttctgtgtagggggaatgacttcttcctcctcagaactctaggaaaatgggatttgtggaacgacgtgctggagttcccacatttatctttgttgtttcactgttgtcttgcttgtcaatgtaaacaaaaacaccaaccaacattgatgttggaactatactcatttgttaattacaaccatatgttgactattaatacaaattttggtaaaatcaacaaaagcattctgtgagaatccattggaattttcaaaaaagaatattttattatttgtaaattgtacactacacatcttttctatcagtaaaatacacagtaaatgtacacacacacacacacacacatttttttctttttagagaactagttgttcaacacttaccagcacaccagtgtacctataagcaattgctcaggaatgaggaatgagaaatcctatgtagaaacagagaattggccaaaacaatctttcaggggccctctgttctaggaagtgacctctctcttcccctctttacttgttgctaccaggatagaggaagtctctgcttttaggtctttaagtctcaggtctgactcgactgacttcagttttggtgagtttcctccaaggacactggcactgatgaccgcaaagggcaaaactcattagataatgatgagtttctttagcataaagttaaagattattgataactgacagaatcattatttttcagacaaatataagtaaaacatccatccattgagatggatgatgggaaagacaactgaaatatttatggcattaagtgctaaatgcatttttggctgaattttgtttcatcaacttccctatgaaattctattctttttaaaacgcatcataaaaaataagacttcaaagaggaagagattaatttagaatcgtgaagggaacaaggagaaggaagaggatctctgaagacgtctttaatgtgaaggcttctttcaagagaaggtcttagaactgggatggtgccagatttatcaaaatcttgagaaaaacataatttgataagataatattcaatggagagctagtctgttgtggaaaagttctaaaagatataaataagacccttgcccatcgatgctcagagctgttgcaggcaaggcacagtgctaaccagagcagctcacctgtgcctaatgccacttcccaaaaacggtccaggttggcatttatataatgctatctttggtgctatttacaaacaggatgcttaattagtgctcattaaatttttacaaatgactgtcagctcattctctcccccctgttgctttgaaactccctgactgacacatttctgactgacaggaacgttaatctctgaggcaacttaattccaaccaccctcccctgccaagacatctgcagacactcactctagaaggacaagaatccactgtggggttgaagctgtggggctttcttgttctctggttcccacatacccacatcgtaatcattctgggaacccagtgctttgacctcctattgccataccatgttacagtttactaagtgctctgacatacatctctgttttgagcctctcaacaaccttatgacaagggcagagctggcagagtggctattttctcaagaagaaaccaggattcccaaaggttaatgccttgaccaaggtcctagggcagaatccaacctgggactcactcagttgttttggctttgagcccagttctctttccataaagtgctgacatttggactgtgaggtgggcctaggaggtaaaaatacaatgccatgcgcctgagaaattccttccagtagaatgcgaaaggcaccactctagaccagacaaagatggatactgacacccgtaattaaagagtttctgttgagtacatatgacttctttttgaaaatggatgacgtaactacttccaagaaaaaaaattagtagctgaaacaaacttcaccgaagagttaccaaaagggatgattctaaaattctgaatcggggatgggttaatgtaaatttatatagttgttcattctataattaaaagaatagatttctttgtggatatagttaacccagatgctcatgttaagcagacaaatagggcctaaggggagaaaagatggagacaagaaatccaggttaaagattcagaataagaccaaataaaaagaattcttattttaatcattgaaagtgtcaataagcacaaggtcccctttgactgactaaaagataaaccaaaatacaacattatgctcagtggaaggttataaaaggagccatgaattagatggggatttgaacaaaagggcctttaaattcccttccaactctcaggtcttggttaactctgagcaaaccattctttaactggaaagtcagagaaatgtttcactgaagtccataatttctgctaacaaaacacctgacagtcttgttattttgctaaccaaaggaattggagattgtcatgccaccagggtagaaggaaatccctcctaaataactgcataccacatgaatgaagccttagatgttataccccaaagcttttcctcatagtcagaaacctgttccaccatgtaggatcggagtggactccctccccctacaaaaaaaaaaaaacaaaaacaaaagcagaaatcaaaagagagaatgggtctctctgtttatacctttagggcagtgcttagttaatcacttggactcttctagacagacttctttgggtaaaaatccctgcttccccatttactagctgggtgaccttgggaaagttacttaatctgtaaaatggggatagtaattgtacctgtccatagcctattgtgaggattaatataagtaaagtggttagcacagggctggcaatggatagtaaccacccagtggatagtagaatgatcaatgactgtagtttaaagttttagtaagtattgcagtgaaggagaatcataaaggtcagggcaccatggggtatttcacacattcttgagcattttgaaaaagtcacatgacataacccaggaaactcccaggtatactagggtaacatctggaaggcagtgatggagagagacttttctgattgccacttttgaagcagcaaaccatgttattgatggtactacaagccttttgctgaatcagacataatgttgatcaccttctccttgcaaggcatgatgtgaggcacagcacaaggcttaattatattcagaccttcctggaagaagcatgacatatgtaaccctaatatggaactgtaactacgctaagaaaatgcaatggaattttgttaaaaaaaaaaaaaaaaaaaaaaaaagaagcttcttactcccacaagacattgtgatgattaaactggctatttaggcataagagagaaggctgttcatcaaaaatcaatttaaaagtaaaaaacagcaatggtaaaccccctcctcattccttccaatcctaaccttgattcagcgttgagcaagaaacagtggcagacgatagtttgaaaacagcctttgggagggcagcttctctctgatccactctgacctcctgcaccactttggtcagagggctaatttgtccctctcgctcatggcaaatgggagtgaaatgatggtggttgaatgtatagttagcttatttcaaatctgagtcagatctgtttctcattagctcccggaggctaagatatggataaactcaaaacaagtcctgattttgctgggcatggtggcttatgcctgtaatcccaactactcaggaggctgaggtgggaagattgcttgagcctgggaggtcaagtctgcagtaagctatgattgtaccactgcacttcagcctgggcaacagagcaagaccctgtctcaaaaaaacaaaagaaagaaaaaagaaaaagaaaaaacaagcccaaaccccaagtcttagttcacgtcaagtcctagaagctaagaaaatttcaggattccttcaggataccaccttgcccaggtgaaccaggactacttgtgacctaagaatccaggtggaaccccagaaacaagggttctgacccccaatctaccatcaactagctctgtaattggtagggggccatggagtcgggattttcctcatctagtctcaagaatgtgtctcctcaaactacagcaagggcagggcctggcacccagtgggaagctgagtatgtgcttagggagggcatcaggggctcatacactaaactagcatttgctattttaaagcaagaatcaaaatattcatccaggagaaaatcagaatcctattagatttttaataacctattttgcaatgtactattattttatttttgattctatggcaggagtaggaaaaagggtacatcatgaccttcttagagaccagggtctcttgaaatcatcacccagcctacgagtcactggctgaggtcacctgacagtgagtcactggcagctagtttgtagggaagaagaagagaagtgaatgtcagagaaggtgaagtttgtgcagaccttctctctacatcccctcttgccatccatctattttgcttattgctaggtacctagggtcttctaccacccagaaacctgagtcagaaattcatgcagcaacttctcgctgactggctggctttctcttccccatgtgggcattttcttggtgcaatgtatctcagaaggacagtcaaaagaatatctcataagatgagggacagactgactggctgtttactggaacatacctacagatcacctgagaatcttgttcaaatgcagatttgaactcagaatgtctaggatggggtctaaggtgctatgttctgccaagctccaagatgatgctatttctggtcctcaggccacactttaagtaaggaggcactagaaccctttctagctctgactgcccaagcctgtgagctcaccccagaacgatctcagccagaagttcccagatcaatagtctcagggattattcctgcaggcccttgctttctgagccatcccaatacaccagtccagccttccacctggcaaaaacagtgatgctcagatgcaaaagtactccaggtagcagggggacacctcagctccaggtagggaattattgctgaggaagcttacaaacacaccagaattactacagcgggtcttcaatagctccagttatcctccccaggggagtcctcaggacaggacaacaagtctaggagaaaccccctaaaatcatttgcattcacagcacaggaaacacaaaggcattaggatgcgctctgcagtccttggtggcaggtggcagagttaatcacctctaagcgaatccaatgctgttgatggcagtgatttaacctcccttcagcatcactctgacctcatatgtgaggataaaagactgaaaacactctcaaacaaataaagaatgcctatgtggttggaccaggctccaaggaagggtcatggtcacagactaaatttcggttcaaatgctaaatttggagaagatgacttcccaacagagcaggaggtggagttctgtgtgcattcctagatggttcaggttggccgccatcatgcgtgggtgcaggcatcgtgtgtgtatgtgtgtgtacatacatacacgtgcatgcatgtgtgcaagtgtgtgtgcagcaggagtgaggtggggaggaagtattgagcacactgatgctttttctgtgcagtggctgctatctgcttcgcaccctcattcctatggcagctgaaagtttcctatggcctagaaaaggcaacactacaactctgtccatcaaaaattgaacaaacctgaataggaaataggatccactcttataaggaaaggggaggggctgtattacaatgtctgtgcctgctgaaccccccgtgcgtcctgccacgggttttcctgtctgagagaaaatggaataaagaaaaccttaaggccgggtgcggtggctcacgcctgtaatcccagcactttgggaggctgaggcaagcagatcacgaggtcaggagatcgagaccatcctggctaacatggtgaaacccggtctctactaaaaaatacaaaaaattagccgggcgtggtggcgggcgcctgtagtcccagctacttgggaggctgaggcaggagaatggcaggaacctgggaggcggagcttgcagtgagccgagatcgtgccactgcactccaacctgagtgacagagcaagacgccgtctaaaaaaaaaacaaaaaaacaaaaaaaagagaaagaaaaccttgaggtggttttactaggcctctaggaagggttaagtcgaaataatttgctcctggtgtatcagacagccctatttggaagcgctctgtgctccaagagcctctagcaccccacctggggcctgggctgagtgggctaaactgctgttatggtgggcacaggctggcttctccaaggacacccttcatgcttccttggttataatgaacagacacagataaaaaggtgtgcactttcaaatacctcgagggggctttagaaaagtagcttcatttggggattaaatggggtctcctgagtccgaattcaagccaaggctctctcttcaccagcaatacggactcctgaatagagtctgcatcattctctctgcagaatgctcggtggatgtttagagaagtcacctgacatcaaattctgcaaaagaagctccccaaggaagccagtctttggttctgcagataatatatcatgtgctaaatcactcagggaaatgtcacacagttgttagaataaagaaggtttaattgccaaatattgggctttaaaaaccaatcaagtatagaaggtaactttaattagagagaagaatcagataaacagagtgtaaaaagctcagtgcttgaacagcctatatctcattgtgccttcattctccaaggacatcgagtaaaaacagagattagacctctgctagccactttgggacaattataggcaaagggaacaaatgtattacttcactgacaccaggaaactgtcttacatttatggggctttgggacaagattccttgatcttgggaatgctgagaaccaaataaccagcatcattgtggaccaagcatcccagccccaaacacagtgagtattgactctggatctctacaggtgctctcaaaaacgcagactgaagattatcaatcgacctgcagtcaatagtgtctacacactgcattcatcttgaaaacaaaatttttgagggccattttcaactcaggctcttcagcaaccctcagggtcttggtgcctgcctcatcttccgagcacagagccctcctgtccatggacctgagattgccaggggacagaatgctcactttcctattttgtctctaagggagcccatttccggaaagtgtgaaggtgataaattcacccaagtgagctcattgccaagccctgaagaccctcacccactggagcagctttgaactgcatggcgtgggcctcccacctctctagggtatttttagaactgagcatggaacaaaactgaacttttcaaacagaaaggaatgcaaagtgcttagggctagttttcaaagggcaaagcttattttaaaagattattgatcgggcctaactgcaacatgacagggtcaaatggagtcaggaatgcacaggaggaatccaggttgggagagctaagccctgaacaccttagggatatctgagcagcgccctccactgaacttgacgggctacgttagcacaacccatggcgtttcggggtaacagatgccacagcaaaaagcccatgctggttaaggaagatgatactggcgagagtgtctccaaatctttctagcatcttttcagttgatgaagctctgactttatcattatatggaaacctaagctctaattttttaagatcagttcctcagctcttcagcaaaatgttctttgatgactttctagaggcctaagtgtagtttaaagaaaaggtcaggtaggaatggattaaaatatgccaaggcattcaaacatcatcctcagaaaagaaagaactaccctgggcttcactctcccctttcattcattctgataacaaggattttctgtgcaccttctatatgtctggaagcttccaagaataaacagaacaaagatgattcagacattgcccccagggagttcaaggggtagtgagagagaaacttacacacaaatatttaaaagacacccacttactatccagacagagcatgaaggctgctcaacatctgtcagggctgtggaggcagcagcttgttccagagaacaccatctttgttttctatcccaccctctaccttggcagggcgattccctcaaagaactgtaccccagcctttaagcttttacacaaatctctgtattccagagaccaatggaaaccactcttctgggcttctcccaggcttactgataggtctagtgtgccagtttccccatcctccttgcatgggccttgcatgtcaccaaaaggctccccacctccaggaaggagagagaacatgcctgcaatcacacagccaatgcaataggcacactttttaagaaacagatcacctgcaaagtgacatcaaatcattacaatgtgcgaagcaaacaaagaatctgtctcacccacataaaaatgacactgcatgcctatgatgggtgatgaacggtactgaggtttttctcatctcctaaacctgtgtctgaaaggttgtaagccataaagtagtagctcatcattgagtgcaacacactcatacctcctgttttgcaagagaaaaagctgggggatcaggagagaatttctctagccaaattctccatgggctgtcttctttgtctcctgtcctctgctaacctgtcctacgacacaaaataaaccttctcacagcttttgggtgtatgaactgcccacagggagtttcctctagacagaaagaactgggcccacagtggtcgccccgacagcctgagtgcaagcttcaaaagcccaggagtcaagttagtgtcaaaagaaaaacaagtagggaagtatagcaggattgacagttggagatattaactgaggtgctttttattccatagatttccccttatctgcttaccctatctcttcctcatgtcattgcctcaggggaggggggacaataatagaaacacaaaaatgttgtttaattctaagagctaaattgctttgcaagagtcttaagtaagagatttggaacacagcccatcaatcagccttgcctgccctgagattagacaaggattctctggagtcagggagccagaggtggatcagagagaggtagggtgaagagacctgtgggtttataaggaggactgtgccctctggagccaggcatgagtttcttcatgggactccatccaacttgctgtctatggtccccaagctggtcagcccactggtggccccaggattcctgcagccctcacacttccaggggctgcaggaataaagcattttcttctttggtgccccgcacccattcaccaccatcactagcccctcgcggccttccctctcctgtgcctggccagcgttaaccccgccccactccagcaagatcccctctggcgtcagaacagttatgtacctgttgcctttcccagcctttgtcagtcttccaggaagggagaccaattcccagggaatacctttaggaggcagattgaaagccaggacctaatttcccatcagccatcaagcagtaaccatttcgagcagttaggctttgaagtgagccagtgacctacacagaagtgaaaagcttcaaatgccattatcattccccagagccagccttctgtgtgcctctgcctctcatctcacctttcaagagtatagacaaatgagccttcttgacatgtttatgccagttcctcttccccagtcctcattctcaggcccttttgcagaatgccctctgaccatattctagaaggatgtcctgttgtgtgagccattttgctgttcatgaacattactcaaaacatctttctttaacataactcctgcctgcgatggtagcagtgttgtgttctgtttctaggctgttcaaagaaatctgagccagtgcaaggcgtttgtcattcctcaagggcagtgacttaaagacaactggttacattacgggctcttcgctttttcctacttttgtctctgggatgtgtttttctctcatctacatcataatcaatagttcttcccccctttgtgatggatcatatcagtcacaactatgctaaattgtcacctgacatttagcttcgatgctattctcttggatggaacacagttttctctcttttcaaatgcctggaatactgaaagggcctaggcaacaatgttcaattatgtgtcaagtcacagttttgctgtaggaccaagaaaagagaacacatccacaggtggctcccaactcactacagacccataaagagcaaactcagtaagtgtcaacctgtctcctaacaaaagcccatttattattgagaaatcagacacataaaaattagatcaaagacccacaactgcccattcatgatgtactatccatgctgagtgactgtaaatttttttgattgcaagaaaaaaattaaaaatatcctcagtccagtccaacaataagagaattttgtgagaaatctctactgagttttgctgtcccaggagaggagttggtttagctgttttatcaaaaagctttgaaatataaagtgctcccgaggagttcgaaaggacacaggaaaaacactaccctttagggagacaaagaactgtaacatccctgtcctcactgggttccctggggatagaggaccctccctcccacggtcacccccagggacaaagtgttgttacggagcaggtggcctgagcacccatcccagtcctccaggattccaccaagtggcagtcgtgtgtaagatgttaatttccctgggcatcagttgtctcatctcacacataggagctagaactgagaaactccaagggctacttcagctttgaaatgttgtaattcttatatagaagaaagaacaggaatgccatgatattagatatgagagagcgagacaacgagagagcgagacagagacagagagagagagaaaagagagggagacagaagaagaaagaaagaaatgagggagcaaggagatagaactaagaaaatgtctttaggaaaccacaagagaagtataacagaaaatgaaagtgtagacaaagtagacaacaagacaaagatgggatgaaaggaactttagtgctaataaacatgaatgacgagagtttctctttatctagcacctatcatgctgcatatacattttctataatattcacagttttctgaggctggtaggaacacatctgtctcataggtgaagaaattgaggttgagtggagttaaagaactggtccaggctgggcacagtggctcacgcctgtaatcccagcactttggaaggctgaggcgggcagatcacttgaggtcaggagttcaagaccagcctggccaatgtggcaaaaccctgtctctactaaaagtacaaaaattagccaggtgtggtggcaggcacctgtaatcccagctacttgggagactgagcagaagaatcgcttgaacccaggaggcagaggttgcagtgaaccgagatcataccattgcattccaggctgggtgacagagcaagacctccgtctcaacaacaacaacaacaaaaacaacaacaacaacaacaacaaagaactgatccaagttcagactgctaattatttgaagctatgattgaacccaggaatccaacctagcctttgcactatgttattacgttatagtgcctcctaaaccattctccctgttgtttagcaagagatgcagtgctctcttctgctttagtttataaagcatggctcaactagaagacctacgagaaatccacagaggcagtatctccttccaccagcagttttgaatgtgcctctgacacagaagggaggatcaagtcgagctgccctgaaccactgacaagaagtatcccttttcaggatggatcctgctgtgggggacagcatagcaaaaagagggacaagtactggcttagacatccggagagctgggcctacactctggccacagatttctcacaggactctgccctctctcccctacctgcctctaagcactgctgatatcctggtgcacgtaagctcatgggtacaaggagttagacacaagcagaggacagttctgtcccaggcacttcctggtatatatgaggggagtggggaggtgggagccatttcagcagaacataccgatatcctgcaaacagcaggcacacagttgttgcttcaggaaaaccagactcagctttaagaaaattggcgataaaaacacaaaattacctttcagaagaaacaaactggaatgtgagtgagattgctgaagtctttttcattttgcccaagactcaagcctaccttctgttaaatagaaagctcccaaatacatctgaaagatgattcgatttacaaaagttccatttgtccacaacctttcacacaaccttgcattaacagaggtgagttacatgggcataagtccatgtgacttgcaaaaatgcgtaaaacaagaagcaaagcatacaaatgtgtgcaggctgcaaggctgagaccaagaaagaaagtagatggggttgaaaatgaatcctgcagtgggaaaattaatttagtataagccccaaagccacagaccactaccacactactgaccctcaccaccccccacccccggcctcccgtcagcaaactctctgtgacttctgactgctcccctatctttcattcccttggtatcaggaagcacaggagagattcagggggaatatcatttacatagggggaaatgtttttgagtatacacacacacacacacacacacacacacacacacacacacacacacattaccctctctgcaaggttggaactaaatatctttcttattcactgttcctggataaagtggctttaaaaagttttcgccattgtcatttccattttcgccttcactcaggcacacaatgaagaaaaaacgagactaaggatgattgacgttccccttttaatgacgaatgctaccgattttcacgtcccttggagttttcttgtattcattttctttgcctaggttagtttttttcttccttttcccatccagtcttttcgtttctttcccttatattatctgaaatgtctatagaacccgagaaggataggagatcctcccatagccctaaccagcactcatcagccaacatgagtggcactctctaactatatgaaaatggaaaccatcttattccatttaactaaagcctctgcacagccatcagggattcttttcagaggacaatgcaaaggccagcaagttgcacttgaacaaataacttctcctagaaaggaaatggcatccgcagcaatcaatgttatacctagatgtgtgttaagagcgacggtgctggagggcttccaggagttgtgtagagatcaccacgtggccactccctcagtaaacatttataaagcaccaattgtgtactgtgctgggtgaggcaaggaaaaggtgaataatgtagtccccgactgtaggaggtcagagtctcagttgtgggagcccaaagtccaggtggaaaataaatgctaatgaaaagttcccttgtattcactctgcttattgagtttacatagacaaatgttctgaggatttccctgggagttttttttgtttgtttgttttgtttgtttgtttgttttgagatggagtgttgctctgtagcccaggctggagtgcaacagcacaatcttgactcattgcaacctctacctacctcctaggttcaagcgattctcctgcctcagcctcccgagtagctgggactataggcaaccaccaccacgcctggctaattttttgtatttttagtaaagacagggtttcaccatgttagccaggatggtctcgatctcctgacctcgtgatctgcccgccttggcctcccaaagtgctgggattacaggcatgagccaccatgcccggccttccctgggagttttttgaaagggaatggaagccccctcaacagaaagaagcctcttgaagtccaatttcatacatgtttcacatcaggttcgatctaacccaagcaaataccatttttaggcaaggcacattagcactgcaataatctatctagtgattgttcatctagaatacatgtacttactatgtccgagacacagtgctgggtgctgggtaggggatacaaagatgaattaattagggctttattccttaagctacttaatgtttttctatgactgagccaaaagtcacaaagggcaatccaaggccagtgtttattaatttgcagttaaatgtatacactggcaccaaagcacttactggactcatactacacacatcatgtatgtgaagataaacaatgcacaggcttttccttggagctcacagcaatatgacaagcggtccatgggacgtatgcatagggaaagagagtagcccaggaaggctttacaagggagctgatacattcgtgggtcagattttagaaaatgagtcagagttagccaggaagagaatgagaaaaagacagtctgtagagaggaagcagtaagtatgcagataagaggctgtaagacagtagggtgggttaagtaagggagaatatttaagtggtcctccaaggaagaagaagaaatgatgctgaaaatgtgggtgggaccaaatgacctacatcccaaccaaatgtcccaaccaaagaagaatggaatcaaaatcaccaataatctttggtattcttctgtgaacatgaattccattcaagtgagattagaacctacaccttaattcaaagtgttagtatatggaaatattggttaggtgtggcacatagacatagtcatggaaatgaaaacacatcatcatttgcagcagacaccagggatttgtataaaggcaaaaaaaagtttcttgaaacaagcagtgatcacaattgctaagagatgtacctcacagcctctgtctgctctttagcctatgacctgtctataaggacaacaaacgaacttgtcttagcttatccagccatctggctgtagtacagctggttagattaaggagcatagtgataactcgctgagtgcttcgtgaggtgggtcgaggcctggccacatagccacagcacctgtcatgacaggaagggctacaatgtcatgggaggcaggcagtgagggatattccagtggacagattaacatgacattccttgtcagagaaggaacgagtgtctagctgccaaaaccagagaggtctagacagatcccaacagcctgctgtggagaccaggagcaacagttgctttctttccctttccatttctgttgcttgcacgatggactcccgggtctgggagaaattagaagttatatagggacttgggtattcatgagaaagcgaaagggagggaactagacaaggacccagctcttgaacaagggattaggaaaggttcacaggcaaccgatgcagactgaatttctgggaacatagcaaagagactcaaagaacctcagtaagactaactgactgtcataatagaacagaaagggacaggaagagcttctgcagctgtaggacaggtaatcccagattccagggtcaaaggacttcagctttacaacctggagggctaaggaacaagagccaagggacccattatagctgaacctcaaatacagcctaagaagtaaccttgttttcttattcagacagagctttatggtttttgtttccagttctctaaccaatgtcactttctatattgacacttctttctgaaggtaaaagagttagtagactggttgtttcttccttccaccaccaactttagctaagttttgcaaacggccgagtctaaaaacatgctccatcctggtacactgtgtgtgtgtgtgtgtgtgtgtgtgtgtgtgtgtgtgtgtctgtatgcacatgcctatgcgtggctgcctgggtctgagtctaggtcattgcaatatcccaaggcaatatgaacaccataattactaccatttattgagcacctcctatgggcactgtgatgaactcttgaatctctaatgcttgtaatgctagaggatatcatttcatttatttttttacagagcaaatgctgagaatctccagtgctccctagcactgagcttatgatggaaaataaatatcatcacacctccttgtaaaaggcaaggtctagaagagtaatgaccacacttagccaaccaggcaggctattctatccggaatggctgaatcagccaaccaaccaatttgactgattctgtccagtgaactgaccagttgattgactggcttggcagagtcacacagttacttctgcaccatgttgccacagctttacaatgtgcctgtgctggtgaaatgaagtgaaaagccaaggaattaccccgattatttcctgtatgaaagatgccagcctggattaaaacctcaagaacttctgtcataaaccaaactgtatggtggagaatgacaaagtgaagccatgggcagacccctagactggggtgaatgaatggggcttctcctgggtctgctgttgtccagctaaatctcaaccatgattattcattagaatcacctaaggagcgtttaaaatcattgatgtggggaggtcccagagactgcgattacattgatctggagtggaacctggataatattatttttaagcttcccaggtgattaacatttggccgtggagaaccttggagtttagtagcatggcccctccaggcctcagtttcctgtttatttgttgaggatgtcagaccaggtaatatccagggccctgtaaagttctaagattttatgttcatcctgatcccatccccagctggcaggcagctctgaagacaccactttctctttgcataattcaattcccgaatgccgtcaagatggccgacctaccacagagggtaggcatgtgggttaatgagatcacatttgcaaagtgtttggggctctagggaagaaatctctaatgtatgcagctaaagcatgattacagcaatgttaatgtcatttttttttaagaagagtaaaccacagttcacaaccctgcatctgccgtaattagactatcttgtcaggatggagggtggcggagtggaaagtagattaaagcagggctgctcatgttaagaccagatgccaggttaagcctccaagagccatgtctatgcaatcacaagtgacatagactgggcttgaaaaaatgttaatctatgcaaaatcctcttgttctcagtatacaccagaagattccttcatgacacacattcttgtggacctacttccatataacagagaaaaaagatgaatcttgtggttcttttccaagggtaaataatcatcagtgggactttatttctaaaatgttactacccattgctatttctgacatattgacattggaacacacacacacaaaatctttctttgagatggagtcttgctctgtcacccaggctggaatgcaatggcacgatctcggctcactgcaacctctgcctcccaggttcaagcaattctcctgcctcagcctcccaagtagctgggattacaggtgcccaccactacacccggctaatttttgtgtttttagcagagatgaggtttcaccatgttggccaggatggtctcaaactcctgacctcaggtgatccacctgcctggtcctcccagagtgctggaattagaggtgtgagtcacctcacccggccaaaaaataatcctttaagatcctatacattagacctgtcactccaggctgcagaaactggagtgacagcaaaggctctgaagcccaagagataggaatctgtatctgggtccacctcttacagtctctgtgacctcttggcaagtctcttcctttcctttatcttatttttcttctattagataacatgtgaaaaacacctaacaaaatgcccagtgtaactcaataaacatttagtttcctatctctgtaccatatgtaattgatgttgtcagacaatatttccacacatgcacacatatgtttattgcagcacttttcacaatagcaaagacttggaaccaacccaaatgcccatcaatgatagactggataaagaaaatgtggcacatatacaccatggaatactatgcagccataaaaaaggatgagttcatgtcctttgcagggacatggatgaagctggaaaccatcattctcagcaaactacacaagaacagaaaaccaaacactgcatgttctcactcataagtgggaattgatcaatgagaacacatggacacagggaggggaacatcacacaccagggcctgtcgaggggtggtgggtaggggagagatagcattaggataaatacctaatgtagatgacgagttgatgggtgcagcaaaccaccatggcatgtgtatacctatgtaacaaacctgcacattctgcacatgtatcccagaacttaaagtataattaaaaatatatatatatatatttccaaacaatagtcaccactgcccagatgatactgaaggcctctggtagaccagatctcttgtttttcatgacgcttttgtaatctcattcattcatccatccatttatttattgacttactttcaactagtttatatggtttgtgcaatatagaccaaaagacagtctttgtcattcatcatcaattaataattataatttgagggaatttgaaacattgcatttcaggattttctctaaacaatcgggtgattcagatgcactaagttatctgaaaatgagtattttgtgttttccatagatgtttaggaatcagcaattctgatcataacatgagcttatgaaataagagttgtaaccttgaagtgtccatgtataggtttaaacaattctaaccaaaacatgaatataatttctttggaacttgaaaaatgattctgaaactcctctgttgcaacaaatagctaaaaatagttttaaccttttttgttagggaaaacaaatggagggatggggaattctctaactatacattaggtattttataaagctttcattcttaaaatgtgtggtgctaacacaaaaacagatggaacagtggaacagttgcagaaggtagatagatggaataatggaacattccagtggagactccagaaacagactcaggtctgtataagaatttaatatgtaataaatgggacatctcagtttcagggggagggtagcactagataataattactgctgggggccactagttaagttttggggaaaaactcatttgaaccctcaattcaaatcatctaccacaataaaaggcagataaagtaagtgtaagaaaaataatccataacaaaactcaatggaaacacaaaatggtatttcacacatctttagataagacaggattttctaagattaaaatcagtaaaaaggattaaaagaaaatgagcaaaatgtgaccatttgaaatgcctcaatgatattgagggtttatttccagaccactgcaataaagcaagtattgcaataaagcaagtattgcaataaagcaagtcacacaacattttttggttttggtgcatataaaagttatgcttacactacacttagactattaagtatgcaatagcataatctctaaaaaaatatacacatcttaatttaaaaatactttattgctaaaatggctgacaatcatctgggtctttggtgagtcataatctttttgctgatggagggtcttgcctcaatattgatggttggggtgtctgtggcaattgcttaaaataagacaataatgaagtttgttgcatccattgactcttcctttcatgaaagatttctctgtagcatatgatgctgtttgatagcattttgcccacagtaaatctttcaaaattgaagtcaatcgtctcaaaccctgccactgctttatcaactaagtttatgtaatattttaaaccctttgctgccatttcaacaatgttcacagcatctttaccaggagtagattccatctcaaaacaccactttctttgctcatccacaagtagcaacatctcatccgttcaagtttgatcatgaggttgcagcaattcagtcacatctttgggctccacttctaattctagttctcttgctatttccatcacatctccaattgctgcctccaacgaagactctactgaagtcttgaacccctcaaagtaatccatgaggactggaatcaacttcttccaaacccctgttcatgttgttattttgacctcctcccatgcattaaaaatgttctaaatggcatctagagtagtgaatcctttccagaaggttttcaacttactttgcccagatccatcagacgaatcactatctatggcagctacagccttacaagacatgtttcttaaataataaggcttgaaagtcaaaattagtccactatccatggattgcagaaaggatgctgtgttagtaggcataaaaaaattaattttcttgtacatctccatcagagctctccagtgatgaggagcatggtcaatgggcagtaacattctaaaaggaatcattttttctgagcagtaggtattaaaaatgagcttaaaatattccatttattgaatattcagtttacatggtttaccatgttgtaaacacttgtgttgtcattcagcccttgttgttacatttatagaattcaggcagagtagatttagcataattttaaaagccctgggattgtcagaatggtaaataagactgacttgaacttaatcaccacctgtattcacccctaacaagagagtcagcctgtcccttgaagtttttgaagccagtcattgacttctcttttgtagctatgaaagtcctaagtgtcatcttcttctaatataaggttgttttgcctagtttgatggtttagtgtagccaccttcatcaattatcttaggtagatcttctggataactttctacagtttcttcatcagcacttgctgcttcacctcgcactttcatgttataaagatggcttttttccttcaacctcgtgaaccaacctctgctagcttccaatttttctcctgcagattctccacctcttttggccttcatagaattgaagagagttgaactttgcactagattaagctttgacttaaggaaatattgtggctgatttgatcttctatccaaaacactcaaactttctctataccagcaataaggctgttttgctttaaaaaaaatcatttgtgtgttcactggggtagcacttttaattttcaataattttcctttccatcacacttgattaactggcacaagaggcctagcttttgatctgtctcagcttttgacatgcctactcaccaaacttaatcatgtctagttttttactgaaagtgagagacatactactcttcccttcacgtgaacacttagaggcgactgtagggttattaactggcctaatttcaatatttttgtatctcagggaacagggaagcccaaggagatggagagagttaggaaaatggcaggttggtagagcaatcagagcacacaattattgaataacttcgccaccttataggggcatggtttgtggcatcccaatgcaattagaagagtaacatcaatgatcaccaatcacatatcaccataacagatatattaacgatgtttgagatattgcgagaattaccaaaatgtgacacagagacatgaaggaaacacatgctgttggaaacatggtgctgacagactctttccaagcagagtcaccacaaaacttcaatttgtgaaagttgtgatatctgtgaagtgaaataaagcaaagcacgaaaaatggaagtatgtctgtgttacaactgcatacaaatattgcaaaagactttcaaattgggaaaaatttacaacaaacgtagtagatggagggttagtcctgatatcatccaaataatttagaaaaacactaagacaggcaggtgaaaaggctatgaacatcaacagaaaattcagacacacacacacacacacacacgcaaagagctaacaaatatgaaaagttgttcagcctcgctggtaagcaaagaattgtaatttaaggtggcagtttttctttgcccatctaattaaaaaatatttttaaataatatgcagttctggcaagtgttgcgtgagataagcattcttatacacttctagtgggagtataaattgttctggaagagcattttaaaaaactctctaaaggcaaatatagatcgcctttacaatatacctattttttgacccagtaatttaactcatcgaaatccatcccaagaaaattacctgttatacacataaaagcttttttgcataagaatattcactgctgcaatctttataggataaacaaaacagaacaaaactaggaagcaaagtagctacttgaaataaaaagtgataaagtaaatatggcatgtccaaaagataagttattatgtaacttccaacaaagatgactaagactttatgtaatattaaatgaaaatatcatcttaaaaattttatatgaatcaactctagtctttaaactcacaaagactgatttaaaaatactaaattgttaacagtagttatctttggtgggtagtattatgaacaattaatttcttctttttcaattatttgaaaaataattactatgcattatttttataattagcatgacatttttataaaaaggacataactgcatattccaattattactttgcaacaggagaaagataggatgaggttgacaacggccttcgaactgcttttccttctgcccttcttttccttcctaatctctctctatgaggtccacacacacagccttgaaggagaaataaaagaatcatttgtaggcctgagttttctcttttatccttatggtcaaatgagaagacgtctaaacagaagatctaggtattatggcagaaaaatagataaatagataaatacttcacaaagggtctctctgctagggaagagctcctggaaccatcggtagatctgtaataaagcatccagtctctgtggctgtcttcttaataagccagaagcacatttactgtagcctggtgagtgacgatcagcaaaacttacgaaaaatacagcacggatttcctccaaacgttagcagccaatttcactctgggaggtaaaattactggaactgataagccaatattaaaagaccaaaaaagctccttaaatattacaaagaccaatttgagccatcagacctgcatctgaacaaatgggaagatggcaatctgaaaattgtaataagaatgaattgattttgtacctgttctctagtttcattatgatcactgacaacagaatggattcattttatgtcattttctcctaagcctcatagaatattttctttcaggtcctgagatatgaacagaaagcacagatggccctgtctgcttcaacccagcagagactacgaataactttggagttgtttaaactcgtttcttttctctaagcaacctagctattcagcagctgttcatttcaaagctcagaaagatgcaaatggagctgcaactaccttaaaagaagctccggtgtggggtggggcacggggtatgacaatggggagaggaggtgagctacctttcatgagtttttttaaatgtagaagaataagcacaaataaaattctattagtgtaattttaggagacacaaggtcatgatgctcacaacttactatcaaatggctcaatgacaacaataacaaaaattacatacatatatacatacatacatacacatatatgcacgcacacccacacacacacacacacacacacacacatacacacacatatatatatggagaaacaatatggcaaaatgtaaataattagattataaaatctaacagaaagatgtatagaaacaaacaatactatcctagcaacctttctttagattgccatcattttaaaaaaattaaaaacaaatgaagtttagcagctctctgctcataacttcctttaactgtcccatcctgtatattctaaccagtccagataactctgtttcttgagctcactctgctctcccacttccttgccatttgctcatgctatttcctccaccaaaaatgctcacctcctgctcctattcataagtctttcaaagatttttttcaaatgcttctccttgaagcatcctctaatctttgcccctgcaccccagttatatttgatttcttgcctgtgaatctctcttaagatccagtttatcagacactctccttctcccatcaaaggacagcaaggagtaatatccccactatcattgcttgttcatgtgtctctctcccttttggaactctaggatccctgaaggcagggaccatgtctgtctcattcaccagtatagcccaagtgccagggacattgcttagtgtagaaggactcactaaatatttgctgattgaaggaactgatattctgactagttactggagtagtgttagatttttaaatctccttaaatcagggactctttcctactcatctccatatccatgcacaaagtaggtgctaaacaaatatttgttgatttttttttcaaaaagcagataaataggatttttttttttactttcaccaaagcactatacctgtttattcatttactcattgacccaagaatttgggtcaagaaagctttagctgtggccatccaaagggtaccagaaaagatgaaaaggagtaagtagagccacctgcggaaggccacggggtggtaagctccatatcttcctggttagtaaggaagtcttaaagctgcctgcaggcttgtgaccaggtatcttaagggtgagcactatttggtgttgccatcaactacgatcccagagggcaaagcctagcagccagattcctcacacctgccagtgtccttcattacatcagctaataaagaaacaagcacagaaggctaaatccaaaaggaaataaccatcaccatgttgggacttatgtggccaaagcctctctttgtgtgtgtgagagagggagtcttttggatgctttattattaaattggtatcatcaccagctcctttccattttgggaaagccaagtacactcagccctaggttcactcacagggacaaaattagccacagaaatcccatcaaagggaaatctaaggaattagaattctattgcatttggaaactggtgatttcaaatattgctggaatgtgagttgttgtttaaaatttagaaaccatacatgatttgaagagattttgtgctggacagaaaatatgtagaatttggtcttttcatcacaaagtacaaaaacccccgctcctcgcatccaggtcttttcagcaaatgtaccttaaaaggcaattaaagaatggtgaagctctcgagaggtatgacagtctttggccacattctatatttgccaccatatctagaaccctctatgcttccatggacatccaaaggtaggatgataataacccaaagaacttttttcttcctttaagccgcacttaggtaaggacggctttatccccaccccagggagaataatacccagaaacctcaatcctagagagaaggactctgaccgttctggagaattttcctgggggaaaaaaaagagagggagaaagagggaaagaatggagaggtcatcggtgtgatggcgaggacactgcatttagtcaggggccttggctctattcctcctgtgcttaccaccagtgagaacttggatatgccattgagcttttctgagtttccattctctcgtctataaaatagaaattttagaaaatttgctccacctacctcacacagctattgtgagaaatcaatgagatgaggggatttgaaattgtctgaaattggaagccacagctgcaccagctagatattgttcatatgggctttttcaccagccaggttactataaaaaccaacaaactttccatagttgcttctctatcatttgtttccacttctcttttgagtgttgaaaagaaacattttcagaaacttctaaattctgaattagccattgaaatccagcaagggcaccaacttggatgctgaagtggttcagaatggggtcacagaagagttgggttggaaagaatgaccatgtatcactttaaaaacactaataaagtaatagcagctgggtgcagtggctcacacctataatctcagtgctttaggaggccaaggcaggagaatagcttgaggcccagagtttgagaccagcctgggaaacacagtgggatcctgtctcaaaacaaaacaaacaaacaaacaaacaaacaaacaaaaaacaggcacagtggcacacacctatagtcctagctactcaagagattaaagtgaaagcatcacttgagccaggagttcaaggctcagtgagctatgattgcaccactgcactccatcctgggtcacagagcaagccctgactcagaaataaagtaaaataaataaaaatgtaaaacaatattttaagagagagaagagttgacaaacaaaaataacagaaaaatacattaaaaatcatcataaagacctcaaaatgagaaaaaggcatactgtaatattgtattgtcatcaataaaccacatttggctgatcaagaaatgcaaaactagaccaaaaagtacaatgacaacaactgtggccgagccagcatccttgcattcatctattcattcagcacacctgtgttcagaactttctctgtacctggcactgtgccgcattagggtgcagaataggacaaagctccggactccaagtaggggaggtgaacatgcaaagtaacaaccataattcagtgtggtgcgtgccgtgctctaagaatgatgacagtccggaatgaggacactcattggagatgaaagtgaggggtggagaggaatgtgaaagccagggaggacccctcagaggaggcaatgcctgagaggaggctgaagagtgacaggtggggcacagccctcatggctgagagatagcaggattaacttctcagaggacttcaggaaagtccagccaccagcatgctgggcaaaggcaaggaaccagacttagtccttagcatctgagcacagaaacaaatccttgcatgtttcttcatcattcccagccgtttcctgaagctcaggcaaggaatgtgaaccattacttggttttattgcgttcacaggcaatgtaagatgatcacataaaacagttggaagaaggtgttgggactatgcagaggataattccttatggaccaggaatcttggcagaagtggctggtcaacagggacagagaactccttacaaccccctgcagctaccaaccccagccctaaaatcattaggattagggtacccaggaatttccactgaagtgtggcaacagggaggttgctgagaaggaccagagccctggaggcactcaggtttcctacacctcagacttaacaacaagctcttctctttgagatgcaaggagagccctctgggctcaaatctaccccacacccatccaaccaccaaggtaaaacaggcagagaggaagaaccacaatattcccaacgcatggggcttctgagtcctaaataaggcaatttggggagctgagtaatttacagtatagtcatttgtcatctgtgatgtgtggtgacagatcagagccacgccgctaagcgtgcccatgctcctctctccctcctgtgggctcccgtgggcgctggcctcccctctctcacccaaatcggggtaggtgggtcctactcactgtgaggggcagagcaacctcagggaggaacaggtcctgaagcagctcccccaacctcccaagaacctacagatggcaagagagacacaaccttcaacctatggaagaccatgaggcccaggaatatgctcccctacctagctgatggaggaaaaagaaaagctatgcataataactagcagatactgtgagaaatgtcttccaccaagagtaggcgaagaaaacaagaaacatggaaaacaataacccatttgctttcccaatttccagttcctcttcattgcacctaatttgaaaaacacatagaatttttaagctcaatgactagtcatctatcactcagtcccagagacagttttattaaaaaaacaaacaaacaacaacgagaaaaaaacagatgagcattctagctcctacctatactgagcaacacctcagttttctcatttgcttttaacgattctaagttcggctcctagacatataggttttgcctgcatcgtgcattctgtatgctattgctgcacgactttcagccttcaaggatcagggatgccacacaaccactttagtagaaattggcctctattccttggttttgccttctgtttttcacttaactttttttcattttctgttttccttcctgcctccctgcctgacttctttctttttccaggaggacagaaatacagctctccatttgctagtgcaaaccataaaagttaaaagggctcctagaaattatccagtaacacatcatttcaatattgaggaaatggaggctgagaaatcacagcctaaaaccacagttatttattaagaatcagctttaggatcctgaaggtcacttgactcttatgtcagtattctttctactacagagctgcagtaccactgcagggcaaatcagtttgggaaatgatagagtaaacaacttcttaacccctaggtctgggggacataaataataatgatgataataatgataaactccaaatcaaaatctacctcttgttctgtaaggaaaactgtacaatcaaagaaaataattctgtttaaatgttgacttggtttaaatgtcaaaacaaaatctcccaaaactaatcaagattaaatatatttggctcagtcacataagaaacccatgcatgtctcccaaaatagttacctacttaagctcagtgaagtatggagactgaatgagaaaagaagaaagcttagaggttgattgcactgggcaacttccatggtcttgcttatcaagagaaagaggagagtagagcagagaagaggaggggagggaaggggatgggaggggagaggaggggagggcaggggaggggaggggagggcaggggaggggaggggaggggaggggaggggagggcaggggaggggaggggaggggaggggagggcaggggaggggaggggagggcaggggaggggaggggaggggagatgaagggagaggaggggaggggaagagaggggagaggagaggaggggaggggaggggagaggaggggagaggaggggaggggaggggaggagaggggaggggaggggaggggaggggaagagaggggaggggagaaaaccctccagagccaaatcccaaatctatattcagggtatgattatcaagttggtagattattcaggattttttctctacccatccccttctgccaatatgatttttagatcactgttctatacccttgtacctacactggaaaggggaaaagaaacaaaagagactggaactcttttttttttttttccttttttggttatcagttgtggtttataataatgaggagaaggaggaaagggttgaaaaaccaaacagaaggcccaagacatattttagacagtgacagccatcccctcaacactgacccccaaaccatgcattttggcttaggtacagttctctgtttcttggaaaaatgcaaataacctaaatgggattttaaaaaaataacagaacttttaaaaagtagttacaatgtattcaaaggaattctttcttaattatctaaaatggcttgaactgttatgcaagtaaggaattgcttttattaaatgccaaatctttttttaaagcaacctcagggagttactcattctcaatgagctgtgtctatgccagcaaaacaaaaagtggcaatttgggcaatagtccacgtaattcagaccaaagaaatctgtcattgctgcaactccatcaacatgagcttctgaacaacctagcccattaggcagcagatgtgggcagagaatgggccagaagagatgaagctcccacaaagtattattgtaaagctgaatagagtcagactcttatttgcttgaattccactgattccttaataataactaaaaggccagcaactggtgattaactttgtaaaacaataattggttgtttacgcaagtccactctcacgcttggggtattcttcacagtcaaggtgtggaaactgaatagaggggtttagccatatccgcctctgtttagagagaaaaataacattgggctgtcagggtgctggtctttaccttcttcaccattatttccgattgctctatgtttcatccaatccatcacatggcaattgtctttttatcctactaaggagaaataaattgactgcaccagggttgattcattcatgtagaataaacattgtctcggcttgtctacatagtgaaatgtagatttaagaagtaatgcagataaataatgggatgccaagcttagaggttggaggtgggggaaggaagcccaaaccctttggtgcgtcatgcctcataaaagacgctgttctccatttccttacatgtgtatatgggctctgcctcaatgtcccttacaggaggcatttttagggaacaaacaacttaggctgagaataaattaacctcccccaagcaacagtggtaaatagataagtaagatgggagacataatatacatatgttcagtattagaagctgaatgagaaagaccaagtcaattgtttttcaagacaattaggcaatactcaggggcagaccaggaaaactaaatctctttttctttttgctcattacagcattgcaaaatataaaagcctgcctatctgtgaagcccgcagttagaacattttcagaacagtaatctcatcttctaagaactagctactgaatgtaaagatatgtttccaagtgaaagttaaaagtggctgcctgttgccactggccccacagacaggtggggtacaaggcagggcagcccatgctctgtctcccttgatgccatctcattccactcccaactaatgagactttaaatatctagaatgggcctggatacaaggtatggatttgtccctgaagcctaacacggactaatgcccagcattgtttgggtcacaacggactttcaaaccctcacctcatatgcagcttaagactgtaaccatttaaaagtaaggcaggccaggaagactgtgtgccttcagcagatatggcaacacaggttcagagaggttatcgagccatcatagctcacttacctggcggccgtggaggcctgtgactcccactctacctccattgccttccattgtctgcgttgggtttaaggtgataccagggctggcgtcgcagcccattagtcctaattctgactttttccaagttggaaagtatgcccaccctctctgtttcttagacccatgttgggggctaaagaaactccatcttggatgctaatctgccatgttgacttttgagtaaccctagttctcggaaggcctgtaagatttccagtttatctattgttcctgcataacagcactgtatttactataaatcctgcccctagatgtcaaaacaaccttgatgttatggtgcgttgattgtcctacacatcacttctgaatcacatatccccctttcccgggcctgaggagtaatggtgcagagatctactatcttgtctggtttctgtttggaagcctctattaaatgtttctgagaaactggatctgtcagcctctttttcagcctctcagcttccttgaactttgggggctaagtttgcacagacctgcccactgtgaaacaactcatcacctattaaatgaaatgagaacagtcatagtgcccacctcgccaaccccacagaatgactgtgagggcagctaacataacagacaaggagtccttacacattaagggctacaggatagaagcactatacaaataggctcgagctcctgggagcactattttaaaaaatattaatttaatttaaagttcttggatacatgtgcaggacatgcagatttgttacatagtgtggacatgtgcaggacatgcagatttgttacatggcatacataaatgtgtgccatggtagtttgctgcatgtatcaacccatcacctaggtattaagccccacatgcattagctatttatgctgatgctctccttcctcctgctcccagacaggccccagtgtgtgtggttcccctccccgtgtctacgtattctcattattcagcttccacttataggtgggagcatgtggtatttggtttcctgttcctgtgttactttgctgaggataatggcttccagttccatccatgtccctgcaaaggacatgatcttgttcttttttatggctgcatagtattccatggtgtatatgtgccacattttctttatccagtctatcgttgatgggcatttaggttgattccatgtcttggctattgtgaataatggggagcactttttaatcatctctgtttatgtgttcaggctgctggtttctcccacctctccatccctgactcttcatctctatttcactcctgtatctgagcactatcttcatattgctgggctaggtagcagagataccagctgaggattacagaacccaaaccataaggaactcagcacatttgacaagccatgtacatgtgagtgaggaggtgaaatggaggggtgtctgtgtgtgtctatacgtccccaggcttcagtaggtaagtaatttccagaagccttcaaatatccagatgtttaaataaaaatcaatgcattgttatcttttttttcatagtcttctaactgtgataccatatggaaaggcctgaatcccttaggatggtcttaagactaaggtaagaggtcagagagagttgaatgcaaagcctaaatcacacggtgtgcgtgtgtgcattgggtctgtaattgctgtcagtggggagaggtgtgggatgctgaagcttcttaatagcatgggagaaagactaacagtgttttaaatcagaagaaaagggttccatgtgataacagcagaggaaagaaatcatttagaaaagagaaaatgagatcgaaatctaggaacaccccccaaaatgaaagatagcttagaagctaccgttaaacaattaaagttgggagagaaggagccgccagctgatgtgggcaaacacaaaggtaactaaaattgcacagtggctgaaaactttgagctgtgctgaagcccagttgagactacctgcccatgtcctcacctggcaggattttctacctgagcaatgtcaatatttgcagatgttgtccggaatgctggggtttgtcaaaatagattggtgaggacttaaagccttccgggggaaggtagaggagttggtgacaccatgaggaagtcagatggggaaatggctgattcatcacaactctccccactgcatagggtatgtacaggcacgcatgggggccatttctgggtggcaaagacacaagaagcaaaacaaatgagttgcagaagacggtcttaggttagatggtggtaagaggaacaaacagggttcttggaggaaaagaccacaggtctgtgttagacaattgtaaggaaaaacatagatgtgtgcgcacatgtgcacgtgcacgcacatacacacacaccataattaaagagatcttagacaacccgaccacctaaagtactttcaaatttcacttgggagcaatccttagcaaggattacaatctgtgcagattgaagatgacaattaaaactttaactttcttaaagcccacaaatagtgccttgagtctttatggcaagttgtcaggtgctaccaagagctcgcctttcctatctctccctgacaacctagaaatatctgttattctcgcccctgtggctacaacagtgacataataagaaacaagggaggagacgaatctctccccagactctcatctaaggaagccaagggagggtgaatgaaaaagaatagaagataaccatagcggtgtgagtcttgtgctattgattttgcatctgtctgaaaacattactcattggaatggtggcagccctcaggaagagggtgaggaggtgtccttctgccagggagggctctgtgctcaggggcccaacacatgccaggagctttgggcagaggaagtctcagggcttgttccttggcctgcctccaggctctgatgatttgctgagtgaaagtgacaatggttttagcacctggaagttgtttgaaggtacaagtgttaggtgggagttcaaataaatgccagcttcatacaagccagtaagcaagtagtaccagtgaaaatggaaatataaatggttaataaggtgatcattatggataatagatgaagtaataaaaatgtggagttaaaagggaattaaagtttccttgtagaattttccccacagtatagaatccatactattgttgttatggcatctcactgtagatggtttgggaaatgctttccataacacaggcatggattattaaataacattagatcacattgtgagaaggtgatgtctgtttttaattctcttttaacccttctgagtatctcaaagagagagagtttcaattaggtgctgcttctctgacacttgccaagctcctttttttaacaaagagagagcaagcttcaggcttagagactttgatttggccaaagcatctatcaaggatctaatctcattgtttggttttcattttatctctttttttaatgtattttctatatgcaattactaaaccatataaggtttcttccttaaaaataaatgcattgaaattaaaaacagtctatgggaaaagatactaagtacaagttacacaaagaggacatggataatggaggtggcacaaatgtgaccagagtttggagaacaaggatgttggtcccagtgcaggaaatgacttgcccatagtgtcacatttgtctggtgtctcctatgaaggtggagagaagatgaaaggcagcctcgtctgaaaagcatctggcactcagagaagccacgtgacttctctgaagctctggatcccaagagtctcagtccctccttttcaggccaagaaacctgaaacccagagccaactgatccccaaccctgaggtgcatcacatcgtagtgacagaattagtcactttgcctcatttttcttccatcaatttcctagatccctgggagatagagtgagctgagacccaggatacctatcagatggaaaaacagacaagccattaccctcttctcactggcccgtgctccaaatccctgctgctctgaatgctcccccataggaggcagtggccatgaagggtggtgtcagcacagggttttgggccttctggtggctgatcactgcctttccacattgcagcccagcatgaccagcatacaaagtggaaagcaaaagtccatcctccactgcctgccatgcatcacatccatacacaattgcatcttgatggatgcggcaaacacaactttatatgtctgccacggccccagtgacctttcagatccctgagttaaagggaccattattcatctttatgtacagcttcctatgacaggcctacatgataaagcccagagacactttgatgaagtaaataatttagccccatccatactcacctgccattcccaaatcctaatgtctttccagggattgcttcaccaaaccagtggaataatgagtcccttattgatgacaccaggtcagtgtaaactttatgcagaagctaaactacatcggagagcatatgagttttacagaagaatatggatgaagagcatttacttaagcaaggttctggaaacacaagcttaccacacaagtacatttccattttaaaataatgaatattatgtgttgggcacctactatgtgccacatgttgtacttggaccttccatacattgtttcatttaatcctcaaaacagccttccttgcaaggtagctgttattatctccatcatactgagagtttgaaatcaagatggctttctgaatgtcatcctaatagcaagtaataaggcagaaagccattcaaaaattttactggaacaaaggaggatgtgaaaaaataaatgactacatggcagagttggatgtgaactacagttggtctgactcccttcatattcattctactggaccttactacttttatctccgtgagggagtttggtttaaggataggaggggggctgcctggcaccttgcttcctaacagccctttatcctggtttgggggtgcaggacattaggaagagtgtgtgagatccccatgatccctacttcccatcttcagatgcagtcacagcataggtttggtgggatcttgatgtgtcttctgctgctctgtcctgaattcaaatgattactttccagagacatatacaaggccagggaattccaaagagcaactagtattgtccagcaggtttgtgaagagcacagggaagtggctgctggatggtccagcttcactgagaaaggacttgtctatctgtaaccagtttgtattttgtggtctgtatttgcctatggctttagaatcttcccaagtcagacttgaagagtttgacaagtccatggatttctcattccaacttcccattgacaactgagtctaatgactatatatgggttaaaaaggtaacacagacaaagaacagtgatggtgtcaagatggtggtgttttgggtaaaattttctccttcacaacttaatttaattgagataccataatttctaaaaatggacagagagtcagccggacatggtggctcatgtgtgtaatcccagcactttgggaggccaaggcgggtgaatcacctgaggtcaggagctcgagaccagcctggccaacagggtgatacgccatctctactaaaaatacaaaaatcagccgagtgtggtggtggttgcctgtaattccagctactcgggaggctgaggcaggagaatcgcttgaacccgggaggcagatattgcagtgagcagagactgtaccatttcactctagcctgggtgacaagagcaaaactccatctcaaaaaaaaaaaaaaaaaagggatagtcatactatcaaatgttatcaatgagataatggctgagaaaagactattgcatttttagttgggtatgacttgaatcttgaataacttgtattggagggcctgggagaacaatgtgaagagatcaggggcagagtcagaaaatgcagattctcctcccagtttcaacgttgactggcctgacaactttgtgcaagtcacttgaactttctgagctatgctttcctgtgctgataaagtggcaaccacagggccttttctggctgtctcttaggccttatattaagaatatatacattatggattgaattgtgtaccctccaaatttatagcttgaagccctaattcccaatgcaactgtatttaaagatagagtctttaggagggtatttaaggttaaatgaagttataaagatagggctctaccagggacaccagggagctttctctctgcacactctcagaagaaaagccatgttaggacacagtgaaaaggctgctgtctgcaagccaggaagagagacctcaccagaagccaactctgacagcaccttgatcttggacttctagtttctagaactgtgaaatcataaattttggttaagtcatccagtccatggtatgttgttatggcaacccaagcagactactgcagagtcgaaagagatgaggtaagaaaaaaggtgtcaagtgtcacacagataaggagctttcatacagtgctgaggtcgaaggccaggctggaggggagcaggggacgtgaagcgggagagaaggcacattctgactccccccctttgaaactgaagagcacaagaaatgagacatgaagtagcttgaggaggtagcacaacagaaagaagtttggtaggatggaaagccagggtctctcccgtgaatacttacaaaagaagcagagataaccagcccatgagatatttacaaacagtatttacattgggtcatcataatgtcaagcttatctccatgtctcaagagaagaggattagatcaaatgtaatagtccttaaaaaatggatgttccctgattctaaaagctctgcatggatggagctttcatgtattcaggtttgtgactcactgacaggtgtgagatggaactaactcattgcttcacacaggaaatattcccgtgctcctaacacaaactgatttcatgccaaaggcatgactctaaagcacaaacacaataaggcatgtagctgacctggccaaacagaggatggcagattgcactgtaggatctgtaatctttctgctcctccattcctggctctgatctggatttcaagttcatgttactggtgatgcctttctcttctcttgatactgtgtatctcattgcataaatgatgtccagagtaatgcattggtatctgtctacgccccttccagttcaaatgtccccccaggctctataatgctaaggtggcaaagctatggcacaattagagtaaagccttggaaaaggtggcatagagggtgcaaggggcaggaaaactgaaggggtgaaacacacatggcaaagatgacaaggtaaatccctgttttgaaaaggcagtaattcaggttcttcatgcctccttgtgcctatcaagtgttacctagggaggaggttcccgaaggaaggacaagtatgagacacaaaaggcacacagttctacatcctggtccatactcacccatatctccttcacagatctcaggtgttgtgcccaatcacagctacacacaacaaagccaagcacacagcatctaagcctgccggggtgggggatgggagcagccaatggtaaatgtttaacaaccagctttgggtaagagggtaagagaggaggtaagctctgctctgtagtatttgctggtttctatagcataaatacccccgccatcatcaatttctagctaccaacaaaaactcactccatggagtcagaaagagttgtgtacaattaggtctcggggcactgggtgagctgactgcaacacacccctgagaggagggaaataaggctactaacaactgctgagtgtcttctatgcaccactcaccctaagaatttacattattatttcatacatataaaaaattcccttcctgtttttaaatgatggggtttcagattaaactccatttgccttttaccaagcacatgtgagtgtactggtataaccaaggtggtgcctggctccagtgaaacataagaacccctgatctggctgatggtgccatatagaggggagaaggtcacctgtccggagacctccacttctgaggacccaccatccagggctgcatttcctctacaacatttcccacctgggcttcacgtagtcatgctcatggatcacttatcatgtgttaggactgagctggacactagggctgtacatccctccaacacacacacaatctagaatgtgctgttcaagttcacacacacatacacatctccctaatggactccatgctaggggctgtatagggaataaagatggtgccaacttggtcctgatctgaagatgtgtacagtccttccaggaaaccaggacctgggtatgacagattgtgaagcatgatgctccattaagagataaacttcatgggatttcagactggaagacattatttctagatgaagacaccatcaagaaaagcttcatggaggaggctgaagaacatcccagtaaatacggctgactccgacagagtacagcacattcatgcctttctccagccagtatttcctgagcccatctactagaggttccgcactgtgccaggcaccaaagaagattcaaaaatgtcttttccaggtgtcctcacctcatatttaggtaaaggccaaacatccatttcagtctgggcagtaagtgcccaagaaagatgcagcagagatgtcacaagctagaatctcttagcactaagaatgggggtttgaggggaattagggagtggatggaggaggaggaggagggaaagcaggctaaggaaataactgtgttgagggctcaaggttgcatattcttgttacaccagaagcaaggagtcactgtctcccccaagacagcctgctaaattcattatttatattaaaaaagaagaggcataaaaataaatttcctagaacttacagggatatgggtgtctgtttctttataaaatgagaggccctgccttgcacaaataatggcccactgtagtaatatcagcttgtaacccggacccgatgctgaactctacagcatccacatctgccgactccaagtgtctcatctaaactcagtctgttctccttgtggaaccccgtaactcacaattgtgtggcaaatagcatctatatcatcagtcccataagcagcttcctgggaaagatccttctatcattcatatccagaatgaatagaattttagtgaattgaattctattaagtccatggctgtcatgtctggaagaaacttaaggagagaaagaaaggataagttcatatttcagtaacatccgagaggctatctctttaaacctctcttccaaagtctggggcctgatttctcccacagtggtacaaggaataaagaaacttggggctgacctcccctggggtgcaacagcccagactcaggtccctggaagaagaaaataacaaaaatagctaatactttgagcactctgcaaatgttaacagcaaccctaggaggcaggcatactattctgtttcatagaagaggcactgaggcccagcggctaactgacttgtccgtgttatgctgcactgtaagtggtggagctgtgagtttaatccagacagcccagtggtgatcctcccagttcccttcatggtggtatatatgtcctttctccagtcaagcacctcatctctgcttgggagttaagagtcaggcatgaccaaggccgggcacggtggctcacacctgtaatcccagcactttgggaggccgaggcgggcggatcacgaggtcaggagatcgagaccatcctggctaacacagtgaaaccctgtctctactaaaaatacaaaaaattagctgggcgaggtggcaggcacctgtagtcccagctactcaggaggctgagacaggagaatgtcgtgaacccgggaggcagagcttgcagtgagccaagatcgcaccactgcactccagcctgggcgacacagcaagactccctctccaaaaaaagaaaaaaaaagactgtctctaaaaaagagtcaggcatgcctaagcctgaatcttgggtctgctttactagttgcatgaatttgaccatgttatttaacttatctgagcttcagtttcctcctatgtgaaatgggactaatccctattcacaggattggtatgagaaattgtaagtacaatttaaatgtacttacagtgcctagcaactagtaaactgtcagtgcagggaatgttagtggcagtagtcgtggtggttgtgatttagaatcacagaatgccaggttttacaaaccctctaatttaatctgaaatgaatgaatgaatgaatgaatgaatgagtggacggactcggcctcagtgtaacatctagcatctagtatggtgcgggccattagtggaaaatcatagaaatctagagtgttttgcaaggtatgtctggaacctcagatattcctggtgaaactgtctaaattgagtttaaatcccacttctatcacttaataatggtgcaacattggataagttcttaggctttcttaggctttgtcttcttgtctgtcaaataggataacagtaacttgcaagttgtgaggacagcagtcgaagtttggaaaagatttagcacagtacctggaaagattttatacagtcactactaaccttcttaatttacttaaaaataaaggggaaggggtagcaggagctattcattaaagtctctgagtgaccccgctattcctggcctaccatatgtttaatataaagagttctgtttaaaatctggttgttgcaaagaaggtgagggaggcactgggactctgcgccgggccccttcttccaccagtccctctctgaggaaggagaagttcttgtttggaactctcctgctgttgggctgtagaaaggtctctcgtgtgggattcacagaggaggccatgcagggttgcctggaatcaactgttttaatgaataatattaaggtagtagtgacattattaattaatgaagtaagaatgtaatgaaagatcaaggaaacaaggaccaggaatgggttggccagatgcctcctcgtacctcctgtccactgtcctccaacttctgctacctgatgcgcccctgagacactgacccaaaactgaggccctggaaattccatatacactctttctcctggctttgtgtttacagtccctttgtgtaaggagtccatgaatgtttagttaccagcctgttctcaaagaatttgaaaggaggcaaatagctttaatcacattttacagggaagaatgagaaacacaagaccgggaagcaagtgaattagggccacatggccaacggcatttgtgtgtctggacagaccctgtctccttggggttggaggcgctggtagaaaactgcctaatttcttccacaagtacacattatgaatctgctgtgattactgtaggctattcgagaagataaagtatttttaacacacagctcaagctttctagttaaggaaacaaaacaaatccacatgaaacattaagtaatagattcattcattcaggcaagcaggaataacagggacatttgcagacagaggttcacctgggtgagggctgggtggttctgagcaagctcttcctttctctaaacctgtttccttctctctagaggagataaaaataatctctgcctcacgggttgttgcatcgatgagatacttacatacatatatgaaagtgctttgtaaacagtggcctcctaatccaatagaccttattattattattattatcagtgaatgcctactttgtacaaagcaacatgcccagcaggcaggggatgaaggattcatcaagaaaggcgattctaaaagtgtttactaattatacgctaataaaaaagccttcccaagagagcaagcaccagaggaaagatgccgacaataacagctctgagttccaaagagggaggctgtccagtgttggaaggaaagtctgggccacaaggtcggtcccccttggtttctagccagctccacaccacctggctctgcgaccttgagcaattggctgtgcctctctgtgcctctgacttctcatctgtaaaattagggggttggatttaattatctgcacagctcctcccagcctgacgggatgtgatgtatggtctatgaggggctaggccttgaaagctgaatcagatttcaatagaggagtgggagctcatgaataaaggcacagaggctgagacaggaatatgcaagagagagggaacaataaaaagagctgacatttattgagtgcctaactttgggtcctgttttaagtgctttgtgcgtatgaactcattacatcctcacaacaaccctaggaggtagaaaactgtccattcctcttttacagaggacacgatggaagcatggggagcttcagtagtaacctgcccaaggtcacacagcttcaacactgccacttattgctccagcctgagaccaaccaggtgggagttcaaggtttacatacaagaggaggtgggtgtgtcacactaagcggtggggtgtgggggatgggtgggtggtgacctgaatactgatcttagtcctagtcctttctttgatttctctgtgacaactggataggtcagctttcatggatctcagttttaactaggacaaattataaatcatactgcatggttggagtgggggacaagatgagaggtgaataaacaacgtgactgcaagatggcatcttttctattggccttatctgtgcctgtgagcaacatggctgggccatgtcttctgccacttgtctgtccagccaaccactctgtcccagtggaggggacccgcaggttggaaaaactgaaagtttcacaatggagagtcaaaacagaaagagtgcttagggatcatctgcccaaattcttctccactaccattatactgacttggaaacagaagctcagggaatttaaatggtttgcccaaggacccgccctccgtccctcccttcctccattcctctcttcctccctttatacataccactgtgttttgtccaagtccacatagatgcagggcagagctaaacacacacagattaaacaaaagtaatgaagagaaaagagccccctgatgcggaaatggaaggaattctcggaacttagagctggaggccttaacttgggccagggaactagaggatgccttctatagaaattgtttaaactgagctcttaagactggattatctaattttagagaaagcaagaaatgaagccaaaaaccaagcgcttatggccagtcctcatcaggcctgtgctagaatactaacgctgtatttcctctcgccatccagtgtttctccacagagaacaaagtgcattacagataccctcttggctcgccaaactccactgtgcgagaggcagggagtcagacttattattcctcttattatctcctattactgtttgcttccatttttcccagagttgtgaatttataaaactgacaggagttttgatgtgacccggattatacaaacacctgcatggatgtcactgctgttttctctctctcgaagagaaatgactgcaagtgtgtgtgtttgaagcaatttggtcattataccgtttgagtttttcccttttccctggcctatttttagatttcttctttcatttcccgagctctattagaataaggttttcattttaatcacgctctctgggcaggccaaatttaggcataatgaaaacaaaaagtgttatgcaaaatgagacgttagaggaagcccggcccggcgcgtgccttgcatacccaacacgctggctgggaacagcgcgcaggttttccacgctggcccagctctggagcctcaatctgcagcgcctgctgttcgcccccaaagcaaggcagcctgttagtgctccaagaatattccgttgcataagaaatatagcatcaaacttttctgtccaccgtgcctccagcagcgcagtagcagatatagggtttgactgtggctggcacagcgtgaggcggccctggccacagtttctgcaaagggaaatgagactggtcaggttctggattgggtggggctgcagagatatcattagtaatatgcagcttgacacctagggtcttggttctgcactctagctgcatgtgagaatcacctgggatgcttttaaaacctacttcctttggaaggcaccccagaccaagtgaatcagaacttctgagggtggcacataggcagaaggtttgctttttctttaatatccacatcctccactttaccaccatacctgtgatcccaagtccagccagagtggagaaatactgcccccaggaaaagaaatatgggggaagggaggagacatcttgttgctgaaagtgtagttcctgcctctcccgtccctccaatcaggatcatcagggagcctgttataaataaagaatctcagcctccaaccagaacctattgaatccaaatttgcatttttaacaggatcccccagactccgggagattcatgttcacattacaaactgagaaacactgttttattcctgtttttttcatccagggctatgtgtaaagcactaagaatgcctaagagcccagattctgcagtcactactgcctaggtttgctctgctgctcaattcacatggaatacgttacacagcttcttcatatctcagtctcctcatctgtaggatgagttatagcacttacttcacaggattcttgtgtgaagcagattagctaatactgcttgaaacactgctggcttgcgcgtgttctctgagtgttattattaccatgagagggatgactgggcgatgccctggactcctgctcacccaggtgttttcaccgctgactgcattctcccatggtgtagagtaaaattcattgccataaaaagtttcttagcaaattgatcttaccaactgaatgaaaataaatttatgttggagcattaggaaatggttaaaacaagtaaactcagagctgttgcatgtgtttttttgtttgtttttgttcttatttgctgaaaggactttgttctgaatgtttcagctcctgtgctagactccccatggtcagcaggtcactaaaaggtgttactggaagtgactgcttgccttccaccatccacattccccaatccatgatcctacagggatagaacagaatgaaatgtgtctttcttgggtttgggccccaatgcaggtgaggaacaggcaattcccatattcatttggcacaagacaggaaaacaaaacatctatccctaagactggggtgccttgggtaacagagcgtgatggtttttaaatacatccacagattctttggtattcctctcttcaagagatggagcataattccttcctctgtgaaagcgagccagccttagcgactatcttctaatgaatagaatatggtgtcagtgacagtatgtgacttacaggattaggttacagaaggcattgcagcttcctccttgtcctctcttggaccacttgctcagggagaaaccagctgccacgccatgagctcagttaagcagccttatggagaagtccacacagggaggaagtgaggacatgccaatgagccattatggaagcagattctccagctccattgaagccctcagatgactgcagccttgaccaacagcttgactgcaacctcagaaaagaccctgagccagaaccatctagctagggtgttcctagatgccgaacctacccaaactataatgtcacagatgttgctgtatttttaagccactaagttttgggggaatttgttatgctgcagtagataaccaatacattggtcttgaaaacatcaaatagatgttttctgaaagcctgagcaatgtacaaaactgaaagaggatagggatccagctgaaaaagaagcacgtcccatgccatgagagaagatgaagattcatgagattcttgtcttcttagtacacttacaagacatagactctggagcctggaagtgctgggtctgaccctggctttgccactgactggttttgtgacctgagtcccttaactaatcttcctcttagaagaacagaagtgatgtgatgttggagaaccaacccagcacttgccaaatgggactcagagagctggagctactgctcctacagtgttctctttccccttctccttctgttcctgactctcagaggcctgcagcctttgacctcagcacacttgttttggggatacatgttgttctcaggggttgggggtagagcagagtgatgctgtgtggagaagaaggagctagtggatagcatgcttattctacctggagcttgcccgagtgagggcgggtgtctggctgaagcctccactagaggaggggatcgagactactgccaaatcaagtgtcacagtggcactaggggaaggtggcatcacatggaacccaccttctgttttcccacccactgttgccagaggaagaagaggaaggttgtgagaataatggcgggtgctctccccaccaaccacccatcttctcctaccctcggtgttatagtttctagggaggtggccctctgagtcactagggggagactgcttctctctcaggctctagcttggttttactctcctctgccctctctgaacccacactcatctcccctcccctcaaggatctaccacttgggaagactttctcggggaaggggacaagcaccaattttgataaatctctcttgcacagatcgaagtgaagagcacctgaatttgagggccaagaggttctcatatcctggtgagaaggtgcaatccctgaaattcagtcctgctgccctgaaaggtccaagaccaacccccacaaatgagagtgaaaaggaagctggtgccatccccagccctggccaccttcccctgatgaagggcatctgtaggggttctggggcactcgattgctccagatcactctgctcctgacatcctcctggcattaagaggaagacctctggaatgcatttcaccaattgaattgtcctggcctccctcagctgttcccattcctcaggcctgggggaagagaagggaaactcaatctcctgcctgccagccaggattaagtggaaaatcaatcttgtctgaactgcccttcccactgtagcctttccgaagatgagcacagactggggattcaggggttgaagggccactctgaggtggctattgcacacattgtctggacattccttcctacctattagaaaggaaagggacctcaggaagctctctcaggccctgtatgcttagcttctaaacctgaaatcaggccttcttctgcagaatgagataataaggatgtctggaacttctattgtccttttccctaaagagtccaaaggattttatgcacatttctccaataatccagtaaaatcagctcccaagtcccaatgccacctgattcagcagagggaggagtcaaaggactgaatggcgaataatccaaggcctcatccctgccccctatctaacgaggagatctgaaatcaaaaggccttggctcccaacctggttgttcttagaccattacctagcacctgctggcagtttataggatcagcctagagaactaaagtcccagggtacttaggcagaggggagacaaaggcagaacaagttttcaggtgggaggaggacagaggaaatgggaaattcatgtggccaagtctgaattctgcccatttgctcagggagcatcactgtagctccatgtatagtcaaagtcacatggtttttggctcctgggctgcctcatttcagccagcagtggctatgatcagtggctaatgcccatccctgttctctaggacttgagtggtgtgtaaaaattgacctggagcaaggcccttggcctctctgagcctcagtgaggttcctcacttataaattgacaaaaggattccttccatctcctgaaggtctacaagtcacaaatatgaactccttggggatgcagcaagggaaccagaagagttactgcaataggcattaggagagctggattatagtccttgcccattagctgactgtgtaatgtgcaacgaatcactggacttctcacagccttggtttcctcacctatcaagtgaggctgttggttatattcttcctaaggactctctcagttctggcttttatttccgaattcaatgattctacatggagggagatataatagaaagatactgttccagacattgactcccttctctgctgatatggtttgactgtgtccccacccaaaactcatcttgaatttccacgtgttatgggagggaccccatgggaggtaactgaatcatgggggcaagtctttcccatgctgttctcctgatagtgaataagtctcatgagatctgatagttttataaagatgagttcccttgcacaaattctttttttgcctgctgccacccatgtaagacatgatttgctcctgcttgccttctgccatgattgtgaggcctccccagccacgtggaactgtaagtccatcaaatttctttattttgtgtattgcccagtctcagatatatcattatcagcagcatgaaaatgggctaataaagtaaattggtaccagtagagtggggtgctgctgaaaagatacacaaaaatgtggaagcgactttggaactgggtaacaggcagaggctggaacagtttggggggctcagaataagacaggaaaatgtgggaaactttggaactccctaaagacttgttgaatggctttgaccaaaatgctgataatgatatggacaatgaaatccagctgaggagggtctcagatggagatgaggaacttgttgggaactgcagcaaaggtgactcttgttatgttttagcaaagagattggtggcattttgcccctggtccagagatttgtggaactttgaacttgagagagatgatttagggtatctggtggatgaaatttctaagcagcaaaacattcaaaaggtgactctggtgctgttaaaaaccattcagtttcataaggaagcagagcataaaagttcagaaaatttgcagcctgacaatgtgatagaaaagaaaatcccattttctgaggggaaattcaagccagctgtagaaatttgcataagtaataaggagttgcatattaatccccaagacaatggggaaaatgtctccagggcatgtcagaggtcttcacagcagcccctcctccccccatcacaggcccagaggcctaggaggaaaacattgtttggtgggctgggcccagggtcccatgctgtgtgcagtctagggacttggtgccctgcatctcagccactccagtcatgactaacaggagccaaggtatagcttgggccatgacttcagagggtggaagccccaaaccttagcagcttccatgtagtgttgagcctgcaggtacacagaagtcaagaattgaagtttgggaacctctgcctagatttcagaagatgcatggaaatgcctggatgtccaggcagaagtttgctgcaggggaaggtccctcatggagaacctctgctagggcagagcagaagagaaatgtggggttggagcccccacacagaatccctactggggcaccacctagtggagctgtgagaagatggccactgtcctccaggccccagaatggtaaatccactgacagcttgcaccatgagcctggaaaagccacagacactcaatgccagctagtgaaggcagctgggagggggcctgtaccctgcaaagccactgaggcagagctgtccgaggctgtgggagcccacctcttgcaggtgtgacctggatgtgagacacggagtcaagggagatcattttggagatttaagatttgattgcctggctggatttcaaacttgcacagggcctgtagcccctttgttttggtcaatttcttccatttggaatggttgtatttacccaatgcctgtacccccattgtatctaggaagtaactaacttgcttttgattttacaggctcgtaggcagaagggacttgccttgtctcagatgagatgttgaactgtggacttttgagttaatgctgaaatggattaagattttgggggatggttgggaatgcatgattgttttgaaatgtgagaacatgagatttgggagaggccagaagtggaatgatatggtttggctatgttcccaccaaaatctcatcttgaatttccacgtattgtgggaaggacctggtgggaagtaattgaatcatgggagcaagtctttcctgtgctgttctcatgatagtgagtaaggctcatgagatctgatggttttataaagaggagttcccctgcacaagttctctttctttgcctgctgccatccatgtaagaagtgactttctcctccttgccttccaccatgattgtgaggtctccccagccatgtggaaatttacgtccattaaacttctttgttttgtaaattgcccagtctcaggtatgtctttatcagcagcatgaaaatagactaatacatctgcttcatctcttcatctgtccatccattcattcatcatatatgtattaagtgcctattgtgtggtcagattccctgttaggtcctgggccataacaacaagcaagatgagtatggtttggtccatgtcttaatgaatttacaatcaaggaaggaggaaaggctgagaagtaaatatatatcacagtgtatgtaaagagccagaggaatgagagaccttggtatgttcaaggaacagaaagaaagacaacagggctaggccatagcatgcaaggcagggaatactggcaggtgaagctggagagtaggttggaggcagatctggagggcttcaaactccagattaaggatgatgacttctaaaggaatcctagagaaaatcattgagtgattttatgcatgattgtgatagaattaagtttttgtcttgaaaagatcattttgtgtgtttttttttttaaatcgttgtgtaccaaagattcgacagatgaaggtaaaagaaacaaagaggccagtgcagtggtccaggcagagatgatctgaacttggactgggattgagatgaagaaagcatcagatgaagcatctgagaaatactgagaagttagaatcaaaacaacaaaaagggcaattggatgtttaggtggtaggggttagaacagagtgactatggaaagatgttctagaggctctggtagcatgactgacagtgcctggtaacccatgacatggtcttgtgactctctgaatgctaaaccaaacaagttaagttttccctacacaactgctctcctggggctctttcaggtgacaggtgcccacctgcaactgtccttccctgcagtgcccctccccaccccctagcatctctgccatggcctgctattctgtaggaaggacacatagacctgagttctgaaatctctttaaagccagcctctccatatggggtagtagaaatccaacagcaaaatccaaactattacagaaaaagaaagagtgtgcctgtgattttatgacttttttgtgtgtgaaaaatcaagcaaaaataggaaatacgtctgcagtttgtggtgtttgggcttgatctatcatgggctttgatatatcacaatgacaaaattctccaatgagaatcatcaaaatattctgagttactacagacagcatcaccagttgatttaaaaaaaaaaaaaaaagacaatcttaggtctttaccagtctctctctctctgtctctttatgtgtcagggtttagcattcacatactcagtcagtcttatacaagcctcatgcaatattaaaatgtttatgcaactctttctgtgcttgaagcagcagcaaatgttcttggtgtgcaaggaatgaggagaataatgttcttacacttcccaggagaaagtccaacatcagagcaatgcctgcctgccctccatgattaatcagagcaataaatcagatctccctttcctcagctatcttccactcttccttggggcccccaggcattggctgagtactaaaaagagagcatcatgtggtttatttgccataaggaacaaaaattggaggggcactcaaaatgtttttacccaagctcatggctgtaattctccaggcatatgccatgtcggtattagtcagatgtcaaactttaaacccattaaaggggcatgttaatagtgcagcatttcaaaaaggtttgccttcagctgctgtacccttacaggagattgatttccacatatatgaacccaaatccaagtgtcagagactaacagagatatcggtctcaatctggtagctttcaaccaatgatcataagacatttgatgggtaactattgctagagggaaaagagagcttaaagacatcaagcaatggtctcagaacagcacgcagatcagaggcagctctgggagcatggttttccaagcccagaaaaattagaatatcagagctggaagtgaaggcctttaagattattttatagatgagaaatcaaggtccagagagactaaggaatttgctcaagatctctaatttgtggcccactgtctaatgcaaaacccaattgaccttcaaagaggtcagacatttccaacaacacttgcttcctgtggctcactgtcatgatgtgatgtcctctaaatccacaggtcttctctgcttctgagcttctaccaaatgatgaactctttgcagattttacatattagagatgctgttttctgattagtatttatcctacttagaccaatctgtttagtgagctttgttggcaaaggcagtctcagggtattaattggtaggctcaaaccctatgtgaggtgatttactactcctactaagaaactgattccacagcccaagactactactggctttgcaaggagactgagaatgaaagatgaagatggaacattccacgctcatgggtaggaagaatcaatatcgtgaaaatggccatactgcccaaggtaatctatagattcaatgccatccccatcaagctaccaatgactttcttcaaagaattggaaaaaactactttaaagttcatatggaaccaaaaaagagcccgcatttccaagtcaatcctaagccaaaagaagaaagctggaggcatcacgctatctgacttcaaactatactacaaggctacagtaaccaaaacagcacggtactggtaccaaaacagagatatagatcaatggaacagaacagagccctcagaaataataccacgcatctacaactatctgatctttgacaaacctgacaaaaacaagaaatggggaaatgattccctgtttaataaatagtgctgggaaaactggctagccatatgtagaaagctgaaactggatcccttccttacaccttatacaaaaattaattcgagatggattaaagacttaaatgttagacctaaatccataaaaaccctagaagaaaacctaggcaataccattcaggacataggcatgggcaaggacttcatgtctaaaacaccaaaagcaatggcaacaaaagccaaaattgacaaatgggatcgaattaaactaaagagcttctgcacagcaaaagaaactaccatcagagtgaacaggcaacctacagaatgggagagaatttttgcatctactcatctgacagagggctaatatccagaatctacaatgaactcaaacaaatttacaagaaaaaaacaaccccatcaaaaagtgggcgaaggatatgaacagacacttctcaaaagaagacatttatgcagccaaaagacacatgaaaaaatgctcaccatcactggccatcaaagaaatgcaaatcaaaaccacaatgagataccatctcacacctgttagaatggcgatcattaaaaagtgtcaggaaacaacaggtgctggagaggatgtggagaaataggaacacttttacactgttggtgggactgtaaactagttcaaccattgtggaagacagtgtggcgattcctcagggatctagaactagaaataccatttgacccagccatcccattactgggtatatacccaaaggattataaatcatgctgctataaagacacatgcacatgtatgtttattgtggcactcttcacaatagcaaagacttggaaccaagccaaatgtccaacaatgatagactggattaagaaaatgtggcacatatacaccatggaatactatgcagccataaaaaatgatgagttcatgtcctttgtaggggcatggatgaagctggaaaccatcattctcagcaaactatcgcaaggacaaaaaaccaaacaccgcatgttctcactcataggtggaaattgaacaataagaacacatggacacaggaaggggaacatcatacaccagggcctgttgaggggtggggggaggggggagggatagcattaggagatatacctaatgttaaatgacaagttaatgggtacagcacaccatggtacatgtatacatatgtaactaacctgcacgttgtgctcatgtaccctaaaacttaaagtataataaaaaaaaaaaagaaagaaagatgaagatggttaaactgatgcagtttaaccatattctttgtgccttctaggcctgagtttgtagattgtagtgtctctttcaaggctggggagttggatgagatgcagtctccaggtggttgtttgtaagagcagagaatgagacttcccttactctcggtcctactgcatgttgcccaagactattaccaagcaagtttgtgtatactttaggcttatcacaggatatgttcagaggaccaattatttagaatcagactataggtctgcatttgtatgaatgaggtgggtccactactaagaacattttcacctaaggggggtaaaatattcatcagattaattcttggtgaacagtgaacctatcctaatactattgagttctgctgttagaaaaatccaaaatcaccagtgcaagactgtctctgattctctgaagcacagtgccccaagctatggatgtatgtatctatttctcagcctgcatggccctaacctgtgaagctctctccctactggactttgatttctctttttagtggctacacagcaaaccctatgggctgttgggagcacagaagctgtcagcctctgggtgaacatttgagatttccattaagttgatgccataatttgctgtctctctgcaaggttttgctctccattctgggcatccttcatcactcccttggcaaactgaagtggcatggagccactggctgccgagaagtttaacgttgacttggctctggcttgctgaagacagagtgtttgtgtagtggatgttttagtgaggctcttggctgtaaatactttcaggaaaacttgttttctattatttatttcaactctgtgaacaaatacatgctttgtccttcacaaagagaccaatggcaaggagttcttttcccttccaattgaattaatcattgcaggggaaaaattattcccaatcttcaaaaagtagggttgttgctaacgtaatctaggagaaaaatcattggtcaatttccaggacctgggcatagcctagtattccccactgaccaccatcacctttccagccctagaatgtaggaagaccctactgagaaagtagatatggagctttcaaaagagacttcaggtaagaggagccctattgacacaaggtcttctttaatcccatccagggctaagacccttgctattcacagtgatccagtgccaatagcaccagcatcacatggaaacttgttagaaatgcagaatacattgggcatggtggctcgtacctgtaatcccagtgactcaggagactgagggaggaggattgcttgaggtcaggagttgaagaccagcctggaaaacacagcaagaccctgtctctaaaatagtttaaaaaaaaaaaaaaaaaaaaaaaaaaaaaaaaaaaaaaaacttagccaagcatggtggcatgtgcctatagtcccagctacttgggaggctgaggtgggaggatcacttgagcccaggagtacaaggctgcagtgagccatgattgtgccactgcactctagcctgggcaacagagtgagaccctaactctaaagaaatgaagaagaagaaaagaagaagaagaagaagaaaagaagaagaaaagaagaagaagaagaagaagaagaagaagaagaagaagaagaagaagaagaagaaggggaagaggaaggggaaggaggaggaggaggagaaggagaagaggaaggggaggaaggggaggaggaggaggaggaggaggaggaggaggaggaggagaagaagaagaagaaggggaagaaggggaagaaggggaagaaggggaagaaggagaagaggaagaggaaggggaaggggaaggggaaggggaaggggaagaggaagaggaagaggaagaagaagaggaagaagaagaggaagaggaagaggaagaagaagaagaagaagaagaagaagaagaagaagaagaagaagaagaagaagaagaagaaatgtagagttccaggacttatctctgacctcccaaatcagaatctgggttttcattagactcctaggagttctggatatatattacactttgagaagcatgctttagagcttctctctttatgccctgaggcacaatgactcctctatacgctaaattcttagttcctgatcagctcctctcctgtttttactgtgtgtgctgtgtcccctcctgacctagctccaactctgttgatccacatcagtgtatatattttggcttcttattctatcatcactataatttacaacttttacaactcaagtctggccagtgcaatgccttctcaagattcaacacctaatagttagccttgggagttgatagaaatcacttaacctgtctaggctatagtttctccagatgctaaatgacgatatacatatgtgtcactctctatgggacacacatgccaggaggacaaatgaggtcattcatatttaatagcactcattattatacagtgagtgcaagacattatttgtgagcatctgtctgggttaatggccaatatctcctgaataggcgaaccattttcactgcatgcttaattctgaaaatgttagaaaagtagggatttcacagtgttctccaactgggtatggtcttatcgttcaaagatctcagtatactgaatacgatttatgaagaacctctagcaacaggaaaggaatcttgagtacaggtgagtcttcaccatgacactgggagatgaggttccctgtatgcattgtcatctcgtggaaatggacaaacaagaaacagtaataaagggcatctcaacatcatggagaaactgggttgaaattcaggatgtccagacaccaattccacatgactttggactaatgagaagaaaagcagagggtggagaacccagaaagcagatatatggagcaagcaggtggcagtttccaaaagctgggtgtggggtcccatcacataggtcgccggcaggaggtctcatgagcagagaagcagaggcagagcctgatgtgtcagaactagggaactgaggtgaattgaagaggaaggggtagatctttcaaaggggcaaaccgatgcacaacaaccaagaagcccaaaatttgttatctttgggggaagagggatatgtagggtgcacatgagagtgagtgtgtgtgcacactagggctacacgaatgccctacatttctgtcatgcctcttctcactatgtatgtgggtattttgcccagagatctaaagcttctgaacatagctacttcgaggcaatagcgaagctaaagcccttgcttcttcagcacattgggcaaaccacggaccattgtacctgcttctgaatactcatccatccacccatttatccatccagcctacaaatacttagggaacacctaccatgtgccaggctctgagtgaggcactgcccatcttcatgggtctcaaagtctagtgggcatgaatcaagtaagaatagaaataaatgttcaattttcacttcaccatgagagcatgtaaagaaactgcaggtagttgggaaatcaggagaagcttgcttcctgagaaggcggcagttgagctgggctctaaagtatgtgtagggattgacagggcaaagagaagtagggagagggctttcaacagaggcaggggcatggaaagaaagagagcccagtgtgggtgggtgcacagcccagagagcacttgaggtagggaagtggagtcacactacagaatacagagagggctgtcaggggacaagacctccggactccggccacatagagccctcatgcctggaaggaaagtgagcatcaggcccttcttctcctctcctctgttggaatctctccaggtatcagattgaaagaacgatgaaaaggcatccctgctctgcatccctgtgtctctattttcctccaccacccctcacggcacctgtgcaaggagcaagtccacatcaataatgcagcagcctccaggcagcagcctccgggcttggccctgaacctgtaagacactgaacaaaataggaaatctgcctgttttcaggtccatctttggacacgatcatctctcatgctctacagtgtgaattttcactagttgggttgaagcactcatttattttccgtatcctgagctttctaaaaaagatggaagcaaacattaggaagaaatccaacagcaagaatccttcagtgcccagaataatcactgccttttatggagcacttaccaggtgccaggcactgggcacatgcttcacaggcattgtttcatttcatcttgactatattgcatgttccaggcattttagctcccattttacaaatgagaaaactgaggctcacagatgtagaatttactcaaggtgacaccgttcataggtggtagattcaggattggagcccaggtctaccctgtatctccttgaaagcatctcaagcatgcagcatctcctttcttgaaaaattacaaacatatctcaccacatccagctctagacagttttgatgccattgtccttggaagcttaattacatgattactcgagatctcttatagactttgacattaccaatatcaactgcactcctcagcccaacccagccctcattatctcaagccagggagcacagtttaattctgcaaaatcaataggacacatggttgggcagaaaaaatggggtatacgaaagcactttgtaaactgcaaaggtatataaaatattattaaactcatcctaagacataagtcaggagtatgagactctaaaatgttagttaaattaatatgaccagcaaggccacacatctggtaaggtcaaaaccactaacttctcagccaatgatgtttggggaaaatatgagactgcttctttctgcctgagagctctaatcacacagtatgtttattgtctacatggtactcacccaattagaaaaaaagtgaaaaattcagctgattttgccaggttttgtgggcttgacacaatgccaagtagcagtagccagtctcatcaattttctcaactgatttgacatgttattttggtatatgagttgacagagctggaggcagaaaattctaggggaagtaccaactctaaacaattaggacaatgtcagtatgtggaaagtaagtagggtgggagtgaacagtaaagatttttcaaagttcttagtgaagtttgcttagacatcagctataatgccaatataatagacattttatcagcttaaaaatcaagatgaaaaactgagattgcaataggaaatactttgtctagaaatggcaacaagccaaaagggtgcgagtatagagaggggagatcacaaaaataggaggaaaagaaaatgaggggtatgattctgtactcccctaattggcagttggtcccaaaccactttactgtggtgacctgagaagtctttccacattagtcacaccaaaacacagaaagaccagagtttcctgatctgccttcagcactaacagtaccatcaattgcagcaaaagaatcacacaccttcacttcaaatcatggcaggcaaaattccatttgctttacctttcaaaagagcacaaaggcagtgtaactcattcagagctcatggtaaagaaaactgccccattagacaagctcgcagagccttgcaatctaagccaaataaaaaggcagcagtcattcaggcggggctggtgagtgggtaaatcaagtggtgacaaagaaacaagcaattttgacccatgtctttttgtgcagcaaaaggctgagtatcctgctagcagctagcaaataataagtagcaagagttgaaggcaaattttgatgctctttttttcattctaagctgatttagaggctgagaaagtagcagagaatgtaaacgttttggggtaaaattcagtggccatattatagggatatattgacagttaagacctaataacataaggggggaaaggtatttccatctgagagtactgaaaccaccagcatttctaccctcaaataacattgctgtgcatttcttccatgccattcttacaagagacaagaaacgatgtgtcttcccattgtacagaactgaaaatgaagttatggagtgttttctttctcccctgggatcacagtagtataccatgctggtgcttcatccagatgttcgtgtatctccttctacagattccccattcaccactctcccttccccaacccagactgtatgtggatataagaaagtccatgatatggtttgcctgtgtccccactcaaatctcatcttgaatggtagctcgcataattcccatgagttatgggagggacctgatgggacacaattgaatcatgtgggtggtatcccccatattgttctcatggtagtcaataagtctcacaagatctgatggttttatagggggaaaccccctttgcctggctctcgttcttacttgtctgcctccatgtaagacaagcctcaccttccgccatgattgtgaggcctccccagccatgcggaactgtgagtccattaaacctctttttctttacaaatcacccagtcttgggtatgtctttatcggcagtgtgaaaatggactaatatagtccaactcacttgccttgagttgagacatcaccgaggcacaacttccattccatagctcccctgtagatcatgctgcagcatgacaaatgagggggttttgcctgagatcattccataactcagcttcttcccttccccatcctgcttcctgcacttccttagcaatgttcccagggagcacttcttttaataagtcccttgtatactaattctcacttcagggtctgcttctggggaaccaacctagacaatcaaaatagcaaattttatcaaagttatctgtatcactcaggttaggctaaattacattatgaaaatatacaaacctcaaaaattgcagtggttggacataatagagaactacctcttgctcatactacccggccattgaaagtagagaggggctctctgctaacattagtcacttagagacccaggctgaccgagtcaccattttgaacactgctagtcaccatgaaaaaaatagagattggaatgctcgtgtcagcaataagtgttcactcagaactgacatataccacttctgctcacaactccctagccagagctaattttgtggccccatccaactagaagagagtttgtcctgctaagtataagtaagtgtaatatcaccttaagccagaataaggaagaacttcactaatggctactgcagcaaatcagagcttagacccctaatctgttacctccttgtgaaacatgctttggttttcatgaatatcaatttagctccaaaatctatttactttctactagagattacatggttggttggagaaaccaggagctgaaaaatgtcactgttattccagcttaatatggagctcttaggtaatccatggtcaatgctacagttcctccatatgcaaaatgaactgacagcattactttatgtgttctttcactttggtcaagataaaataactggtacagagctatgtgtcctagtgcaaacatttttgaaactaaaaaatattcatattaaataactgctttcaaacactggacagcaggcagtaaaggactgtaatccctgatcccactgtgaacacagacatccccctcaacttttgatagagaggtattatgaactagaagttgtcctctgttgttttaaaccactgatattttgagagttgtatgtttcacagtataacttagcctatccggaattatacagataattttctgtagggaaacagataaggtaaggcatggaattgacctcattttctatctggaggcacttgttggagagtgacatcacaaaagaaggccaaaacatggtcttgctgaggccagggaagagatattgggatttggagctactgaggtgcctggaatttgtaggatatggcaccagaaagaagggagcagtgcaaacaatgagatctacatatgtgcataggtattcccttgagtctttggctgaatactgtgctgcacatgtgcagtataagacttcacagagccaggaaaatatctactagagaaagaaaaattaccaaagataattgctcccataactgcaagatactgtaccccaatctactggagatggcacaagactgtggagaatcctcgataaattcatagaagccccagaaagtccatgcttaggagtagacctaaactagccctaggttaaagactactttagatcatctctttaaaagcttaaaagcaagcttcaaaaggactaaactgattcacaagtaaattgcctgccagaacaaaattcaactatttattaaggaagacaatacaaccaaggcagtcaataatgtaacaccaataatgtctagcatacaatcaaaaattaccagataggcaaagaagaaagaaaatgtgactcatttccagaagaaaagccagtcaatagaaacaaatcagaactgatagagaagaattgattagcattcatttaaatgactttaaaataggtattgtaagttgttcatatatttaagggaaaatatgaatttaataaagaaacaaagaaacaattacaatggagaaatggtaagcaaaaaaattttaaaaagaatccatctgcaattctagaacagagaaatacaatatctaaaatgaaaagttcactggatgggcttaacaacagaggacactgcagaagaaaagattagtgaacttgaagagcagtcataggaactatcaaaactaaagagtagaaaaatgttaaaaaggaaaaaaaggagcagagccacagtgatctatggaaaaatattaagcagtgtagcatacatgtaattggcctaaataaaagtgagacaaaaagttgggtcagaaaaattatttttgaaaatagtgttgattattttccccaaatttgatgaaaaatacaaatctacagatctaagaagctcaatgaaacccacacatgataaatacaatgatggctctaccagggcacatcataatcaaattgttaaaaactaatgatagaaagataaaagatttgtataaaaatgtttatagcaactctattcataatagctacaaactggaaataatccagatgtccatcaacaggagaatgcacaaactaatggaataaccatacaatagaatactataaataaaaaggaacaaaccactgatcgagtcaacaatgtgtatgtatctttcagatattatgataagtggaagaagccagacatgcaaaagtacatctgtgccatttcacatatatgaagttctagaacagacaaaaggaacctgtgggtgaaaaatgaataacagtgtttgcctctgtagaggagattactggcaaggggcatgaggaacctttctgtgatgatagaaatattatatatctcaatagggaagagggttatgcaggtgcatgcagttgtcaaaactcatcctactggacacaaaagataagtgttttcatggtatataaattatttaaattatttttgaataaaaatgtttaaaagttatttaaaaggcacaacccaacagcttatgtataatatactttaatgttttaagtagatactggcatcacttttaccacccaaaatgacttccctatatgctttctgatgcctaaagttacactgataattatttatatattctgaagttctaggcctggtagtctgcaaagggctcttaaattggtcccattgaaaaccatttccaccttagtgcaaattagtttatctgtttcttttctaagaatgtgtttttgaggagatggctgggtcaaattccatgggggtcacaggagatagattttcttgcgtgttctaatctcccttcaataaacaaatattatttatataataagaaagatgagtaagtttttttaagtacctagagatgccggatgactggcagaggggaggacccagtgagagagaaaactggtagaagaatgagtggctgagaattccaggaaacaaatctcatcatcttcaagatttcacataactgccttccaattcagaccagcaaagcattaggataattgcggcaattttctacacagggagacatggcaaggtatctttatggaaatttcagagtcaggatgaatacattaagtgatcacaacacaagctttttgttcatgacaaaatggttgtctcgccattcccagcccttggcacattctctcttgcttccctcctttgtttgtgtcccttcttctgcgttctctggaatgaccttttctttatctctgccaatagaaaattctcttatccttaaatggtccagggtcattccccacaaagcctttgctgagtgctcccttctctggatttctgtggctcttggtgtctcttctgtgagatatattatgacttggtgttgtgtcgctctgtaataatgataatgatataataataattgtgagtttactacacactactcatagtgctgagcactttacacacatcagctcatttaatccttacagtcatgctccaaggtaggcagcattaacacaattcatagaggaggaaactcaggtttagagaagccaaattatttgctcaagacaaagctagtctacttagcaaatctgagattacagtgcaaagctgtctaaatctatagcttttattcttaactgctacgttataccgcctccttgacatatatgtctcatatatcctaaaacaaacaaaaacaaacccagaaatctatctctttcttttaagtcacttactatgtgacaggcagagtattcagtgtgccttgagggaaggggcaatatcttgtacatctttgtattgcctcctgcatttaacgtggtatctggcaaataggtacatgtcctacaaatgcttggagagataaagagatagataatcccactgcaagactctagttctttccacagttccaaaatgtggattcctagaacttcaagcaactgaaatgaaagaataaatggataaagacaaagctcagttcccacttcagtctagtaacagttagtaattcaaacatattctcaatattgtctataaatcatctggttttgcttagtttcttgaattcctttctgttctaaaatctatgaatctaattcctttccctttgcatctcagaaatctttctatgtctcttttcaaatgtgttttctgttgaaagattacaaagaaaaactatggctgcagtatggctatatgagatcttgaattcgggaaagaaagaatttcagactttcacacatactgtgtcactaaaatttgaaacattaagttattgcatctattaataactgaacatttacatggcacattgtagtatgcaaaatacttctattgcattatcttatctgaccttcacactttggagtagacaaggcaatttggattatcccaattttacagatttaagaaaactgagacttggtgaagtgatttgctattaaataaagtcaagatttcaatctaagtcttttagatacggctactgttatcttttcaccctcactatactgtcttaactcaatggccatcaaacactgcagtcaccgctccaagtattactctaagaatcattttgttagccttgtgttaggggataggattaactcttctccctttgaataaatcatattcggccagatttttctgaatgtggtttctatcagttatagtaacagaagattttaccttaaaaggtcttaaaaagccaaactcccactaccctaacattacccccatcatttaaaaaaaagacaaaataatgcctagagatattaagcaattttttccaagataacatagtgaacagaatcaagtcttgaacatatccaacatgcaagtgttttataaagctctatcatcagctaattctagaagagatacttccggtcaagacactggcttgtgttcagaaagaaacttaaagctaatctaatccaagtttccttaatgcagcaactgcttctattgcattcatggcaggtgctcttccatttgcacctttatcatatgaatacagtcttatcagtttgtatgttagagaaggataataaccagtactgccattacagttgaacatcttgatgtcttccaccaaattttgctcagtgttcttgggagccctctattggccttctgggtaatagcaggcagcctctgctgggggctgcgctccgtgagtcctggggagttacaatgaacaagagccttagtgctgtctgaaacacaaaggggagtgaagaaatctgtttgccaaattgaaacgggcagaattgacaatgaaataaacttccatttcttcatcttccaaaaatacccatcgaaactagtttatccaaaaacaaaactctctgttctgaatcaaggccttatctgacccttcttcatggaaaacttagccaataactgttccttgacccttatgcctttgacctacctcatcctccactcttaccccagccatggtacacagtgtaatgacgtataggctatgcaggtccctcctgaaaactaacgttcccttctcctttccttcctccatcctcctcttcactcctcttttctaccttcttcctctccttccttctctccctccctctttttctccatcctcccccctccttccttccctccttctcttttttcaaaccaattttcatcagaagctagaaagttgactttgaaggagagcctgccttaagaagcctgtagtgtgataggttaaatatggcagatacatctatgaccatcctaaaaaagaaaaaatatatattatatctatgaaagacccgaggagaggttctggctagattctcatggttgcaacgaacagatatttgtttgagtgacttcaagtaacaagggatttattggaaggaatacaagaaaagccccaccgtcacacttcagaaaaagcaagaactggacgaagaatctgaatctgggggtgttcttgggctgtactgaccatcattctcaggctttaccagggcacacagctatatcccacatgtctgttcttcttcccacttgacaatgaactttctcaccaactaccccacacagttaccacttcactctccaaggataaacactcaagttcccaggttagttatggttaaggggcagtgaagactctggacagttctcaatttagtgacagctgattacctccaggacccatagcatggaccacaggctgggactggaccacatggagatggaggatagtaagaaaggactgagcaggcagggctcatttctatcagagcagctttgtcatgtgcctgcattggactgtgtagacctaacaacagtagtgtgtactgagctcctggggctgcgcaaacatccattccagcacctggttccaccaacattcctctcttgcaggtggggaaatgagttgcaggtgggaaactataggcttcccatcttcctcggatgtttctgtggcaggatactgaaaggaagtggaggttggagcaaatgctctagcataaaggacagaggaaatgagaacagggaatgcccacagcttctcatccttgtgaggtgaggttctccccactgtatgaagtccccagaacgcagctggaccaaatggcaggggcagagtgagcaggtaagggtgattgggtaagaaaaatattggggcttgagacttcagtaataccaatattaggttgtgttcatggagaggaggggaatatcaatggggatgaggggaaaagacccaccagctagaaggggtctcggtgccccactaccatgcagagtcaatttcaactatgaatcagaattattggtagtgaaattttgccctactttacacctactcccacatacggggcacacatatacacataaaatttcctccaagagttgtgtgtgtggtgtgtgtgtatggtgtgcgtgtgtgtcacattctctacttaggttgcgagggtacctgtgcaactgctggaagaaaagaaggaaggaggaagaaaagaagaaagggaggcaggaatgatggcaggaattatgaaaggacagaaatgtaaatgtgatcatatggatggctgctgatggatatggttatcatatactcctgcagcctgagggtgggcagagtgatgtccaagttctgcctgacgctgaattcattgaaggggatttctattgtagaaccctggccaacagctttgcaaagaccaaagtggtcattgatttacttaaaggacaaaacctcccataatttgtcagtaaaatggatgcaagcaaaaaattgtcacttttcaaaaccagaagttaacagaacaaaatctctgggaccatggaatgggttgctttgatatatagggagcattcataatcaatgatcatactctcaccctacgcgaagttactactgagcacttactgtatgctgagcacattattaggcaccaaagatccagcacctgccctcatgaaacttgctgtctagtgggggaagccaggccttaattaattaatctcaaaaacagaggtaaatttcaactgtgacatacgcttttgaaagaaacgtctacagtgctatgagaatacaggatggataatctgacatataggacttggtaaagggcatagaatggatgatctgttgtataagttctggaaaaggaggtgaaggaaatttccttgaggaagtcaccccggaactgctatctgaaggataagaaggagttgtctggacaacaaaggaaaaaagacattttagggaaagaaaacaacgcatgcatatgccttgtggaaagcaggggtgggtaagagcaagaactctcagaggtgctgttgcgtggctagaccagcagcagatgggggcagagagaatgagcagtgccccccggggccagtggggagcaggtgcagatcatgtacctcgtgtgccattttagggaatattttaccttatcctaagagcaaggtgagacaatgaacaacaggatttaaataggtattcaaggaacagttattaaccatatcacacataaggggtaccaaggacataaaaaggcctgtaaacctctgatatagtaggtgaaatgttacttgaatctccatttgtgctttttctctggggttaggtccatagctgttattagattcccaaaggagttcacaatcttctgaaggttagaaccattgtcctggttcttaggggaggagactggagactggatgatttcttactacgtcacttccatttctacgattcatgagccgaaaaccaacccagatccatccaagtgactgacaaactaaggtttactgtcatcagcagggaaattagagccaaaagtttaaaagtatgtgtttgatgttgctagcagcagagatgagctgagaatgcaatcaccttcaccctgataacccccctgcacacacacacacacacacacacacacacagaggcacacacacacagtacacacactgctcatcctacagaaaggctcctcacaggctgtggacctcaactctttgagaagcttatcactgggggttccggggctgtcgtctaaggcccaagagcattttcataaccaacccagtctcagcccagtcccagggggttatggatgtgagtttactcatttcctgtctccaggcactcccttgtcctgctagcaaaatgaaaataaagcaagtggatcagggctaacataggcacagttgacactcaatgatttgagtcactggaggggatcatcaccatgaattatcacgggcacaagtgctgaatcacagatgctactgatccctcaggctcacacaaaccctggcttcttcttcaacagtgattcccaaagggtgttccctggcactttaattctgggggatgttaatagggactctgtaaataaataaggtttcacggttaagtaagcttgggacatgttggattacaaaaggtgagacaggtgtctttgctgcaaggcttcctcaacctttaacgacatttttttttttgagacagagttttgctcgtgtcacccatgctggagtgcaatggcactatctcagctcactgcaacctccaccccccaggttcaagcgattctcctgcctcagcctcccaagtagctgggagtacgggcatgtgccatcatgaccggccaattttgtatttttagtagagacaggatttcaccatgttggccaggctggtttcaaactcctgacctcaggtgatccacctgcctcagcctccaaaagtactaggatgacaggtgtgagccactgtgcccggacacattttttaaccttggagaataaaatctagtttaccatttccccaaacttttggaagactcccagaaacctttggttgaggagcacctcttgggtgctggtgctccaagacagattctgggaactgtgactctccacagcactcttaaaaagtgtctgtgctccagttcatgccagggttctctgtagcacaatgcacaactttatttcccatccaaggttcatactaaatcctgcctcatgaaggaagccttttccagtggtctggtctatatcatatagtgctatagtgtggcccatacatctggcccatggttataaaaaagaaatctggttttgggcttgggagtgtgatgttctgtgatcagcaggctctcataatctggccctgccaatctctctgatctcacctggaattggcctctcccaggccagttaccctgaactcctgtctgtttcttgaacacaccacgctggttctaggatctggttctaggatctggcccttggcacttgcccccccacctgaccgcatagccagttcacgctgactggctcctttattaaccactggaactcaacagcacccctccccaaatttcctactgtcctagaaccccgttttattttcttcacaatactcatcactatataaaattgccttgtccatttatttacacacttattgtctgtcttcctttcaagaatattagctccatgagaacaagaccttgtctaggatgatccttgtctagagcctggcacgcagcaggcatgtaaacatttcttgagtgaatgaatgctctcaatgagttcttgcttataacttttataaagcagaggagtctacttggtggtagagactctggtcagtgctgtaccaaagtccacctcctcccccgggcattgaaagatttttcaaactgcaagaaagcaataccatcctcctccagagattgtcaaaagtctggcaacttccttactggataactgctaagtagcactactattatcatattagccacacttgttgagtgtttaccatgtgccaggatctatgtgaagccttttacatacatcttttgatgctcaccagagattctatgagataggttctattattattcccattttacagcagagaaaacacagctcagaacagtcaggttatttggcccgcacctataagcagatctgtctgactccagaactagaatcttgctgagctatagaatttgtaaacacacgtaaaaaggagcttgtaaagtaaaaaatggccctgccacagttgccatcacccctgcagggaaacgtgaaaggaggtccaggtggcctccaccagcaaaaacacagagaggaatctcactgtgggttggatgtggtttagggattgccaagagaagccgtgttcccaggggctcctcccttccctccacgatacctcggtattctcatctatgaataggcagccccttcttctagaggtgaccataatgagctgctcaccacacagttggcaaaagtactatcaggaaagtcggggaatagggtggtggtagggacgtgttgacccaggacctctggacctgggctcctatctgcactggagatgaaactgcctgaggcccaaggagttgaacaaatgccccaggagctatgagatgcctagaaaccaacaggggattttaataaaagcaacttgctgatcaggtacatacttaatgttataattaccccgtgatgacagcgttgtgaagtacagacaagcaggaagtactgaccaagcaattttaaaaggttggtctaatgctcttcatttttcactaaagcctaaattgagtttgtgctttcagggaataatgaaaaagacagaaaggtgaacatgacaatctagttccaagagccctagattgaaaaaagaacgggaaaataggtggattttcctctgaagccaaagaatggcattcattcattcattcattcgtttataaactttatagaatggtgttccatgacaggcactgtgctcaatgatgaaaacattggcaggggaaggggtaaaaaaagagagaaaggagaagagaaatgagagagcgtaggaagaggacaagaaggagagggaagatgaagcaaaggaggaaggagaggaggatgagggtgggggaggtgtaagaaggagaagcagagatgggaaagagtctcagctttgatacgctcattgtctagtggcgagacaaacttctggctccaaaaaataggcccagctagggagccagctggacttaaatccccccataagtggcagggatttccaagtatccaaaaagtgctctcttggctgctggtgaggctcggtacgcagctgccagggtccctgggggatcaggggcagcgggtgtgaataggtcttagtgcctctgggaggaggaagtggggaggcttttcttcccaaccacctaagcagtacagtgggacttcaattctgatgtcagtgcgaaaggcaaaaattgatattttgaattgcatagattcaaaactatccttgaaaatcccttaaattcccccagaacatgcagcctgcatgtttcatgctgaccaccttgttcaggaaggctttttttttttttttaaactagcaagtttgagaaccactgagctagacttaaaggaaggaaggaaatgaacatgtgtatgcagatatgtgctttctaaccataccaccttcaaggtaattaccaaactgctggataagtagagaattctaaagtgtttctgctagcctgcagggcttttcgcatagtgttttaatacctagcctgtaaaaccttaataaatgttaatgaatttgtgtattgttgagggttacccaggatggaaagaggggtaggctctctggtttgtggaaagggagaggcttccagcaggtctcagctctgagcttcctgtggctaaattctggaatgggtgccaggagggtgaggtgggggctatgtcgctctgaaggctaggtgaaggtcttgagcacatatcctgcgggctgttggcagaagctgacttaggagaccggctggggaggaaagttgagctcacatagaatgcacaagtcaggactgcagagatgcggccacgagggaccccaacagcagcaaagctgcagattctagagtgcgaaatattgattcaggcagctctacgtggactgattggccacaatgtactcctagggtttgtgttcccaggacagcccagagacacctctcccctccccatagtctcacctgcccttggcagtgtccctgaccttctgacttacacatctccatgcacaccaggagcgtcctcgagctgccccccatctcacaggacccgcctgctcttcccacctctctaagcatcaccttcctgagggccccactcgggcccctcctcctcagaaaagctgggcttccccaccagctgctctggggaccgctcactgtctgctgtcccttctgtttagctatgctcacttggcagtattcaagtgtcacagtggcagttagagcacaaattcaagcccacccctggctttgaatgtcccctgactaactgtataaacctgggacaccactcaggcagctgtgcctcaacttccccacctgtgcatgtggtaagaagagggactacccacagagctgtggcagaattacaggaggcaggaggcggaacatgctgagatggtgcctgatgttggcctaagtgctcggccaaatgtgtttcagaagatcctcaaggggaggatgtcacaccccactgtattctcagggcctacgtggcacctcatagattaacaggaaacacagacactttattatatcagaaactcattcattcaagaaacatttaccaagtgtccacaccaagccatctttaaaaatgaacaagatacatttcctgcccttcacaggctctggagggcaatctaccttggccagttttgctggtacctggctgtcagcacctggttgcagtggtgtcccttagcttaggccctctgaggaagaagaggagtggggaggaagcaggggaagaaggggagaggagaggggaggagggaggagagaggtggctctctggtagtgccctcccccctcatccctccaatctcgtggtgccaatttttcatttagtattctttttttatttgtttccattgtcaaacacacatacaacagagtacaacagttttagaggagaggaaattagtgacaataaggggaatctgagcaaactgaaaaggaagacccaggtcaaagtttaaaatgcaacaaaatgatagccccaaactgcaaactaccaaaatgcccattgacagtagaacaagacaaatcaatggcagtgtatacacgtcacctgatggaatatcacacagcaatgaggatgaatcaatctacaactacaggcaacactgtggacatagctcacaaacatcacgctgggaagctagaaaccaaagagcccatagaagacaaaaagcagcaagttagaagtcgggactggttccctgcagggagggcagtgccagatgaggaatggcagaggcgggggcacttccgggtgctgggaatgtcctgtttcttgatcatgatgtggggaggcagggggaacataggtgtgttcatttgaaaaaaattctttgtgctatgcacttaaggtttatgtaattttttctatgattgttatacttctataaaaaggtttaaaaacaagggcaaagccagcaactctcagggatgccccagagcctgataaagagactgaacagggaattctcattggcaactgcagaaaaaggcctcaatcccttgcatgaggcctcccaaaagggaccttggccacaacctcaaggatagcttcatttggggtcaagatagtctggggtctatgcagccaggctcgggggtgtttcctctccctagacttggttgtaccatctggtctcagctgtgcctcccagtgtattttgtagtacttcccaagggaactgttccccgggaatacagagaaatcctttgctcatctctgcccctgtgctttctcccaagccctttcctcgtccaggaagcctggtctggctgccccaacacttctttagctacccaccctctaagccactgccacaaccagccctgcccccgggggacttaacctggagatgcctggcacccttcaccggtgccggtgtgtgcgcctttgtcttgtcctctcacccagcttctcaatcccctgaaaggagttgcgtaactttctgcctccttcatagtgcctagcacagtgccaaacacataatttgtgtttaatatatatattcaaagacttccccaatagttgcattgtgccttctcccgaattagagtgtaagctctaattaagacaattaactgcccttattggattgtaaggaaatgttttaaaattacaatagcatgttattgacagaaaaggcccttctctgctccaaaccccttaatggctttcaattgaccagagcataaactgcaaaatcttttccccggtttacaaggcccctcacagctggctgcttcctttcattgccttctacacttgctcttccttggctcctaccacactggactcatttcaatttctcaaaaagatgaagctgtctcttgcgccaagaccttcctctgggatggtgttctgaatctcgcattcccttcctcttggtctgtctaagagctgattatttctcagattttattaaagtcattttctcaggaagtgctttcctgaatgcctagaccagttgttctcaagcttaggtaggaatcaggcactcctggagggcttttgggctcagtaagtctagggtggggcctggaagtctgtgtttctgtccagctcccaagtattgctgctgctggtctgggaaccacactttaaggaccactgtctagaccaagcagctcgccttattcatcttcctcaccagacacacttccatgagaacaggggcctggcggaatacatgcaaacaaatccccatttctacgactctgttgttaccaaagcaccttcacacctgtggtctcttttgctgcttaaaacagctctgggagagggtagagcaggcatagactgctccttctttacagatggaccagccaagatgcagaatgtccaagggactggccaaaagaaggtcagcagcagtaagtagtagaatgagaggtagaacctgtattttcttatgtgcagccaaagaaaagtttcttcatattattactctgttctggccatatctgcctgcaggggaagatagagaacggaacaaaaactcatcgatttttctcttccgttcccttagatgccagcacaggaataagaaacgaagcccctatgtagcgtttatccaatgacctgtggcacagagtttgtttccttggaagaggctatgctaaggtaggtaaggtggtgatggactaataaagcttgcaacttcttacattttcatggcatggcagccttcccccaggtgacaatcagacagcagacaatgggaggtataagtgcagaggctgtgagccatctgttctgcaatgaaatctgtgtggccctccttaaccccttcagactcaaaaaacagactagcagccccactcaccattacctaccaagatgggccacaccagccagacctacaagtaagacagttgctgactatactttcaaaggtgtggggaagggcccctccatgccatgagacagatctctcaatcccagctgcagtggttggaattggataagcagcctgcccagcagaggattccaacagttctggaaccttcctccacacctattccccctctcctaggtcacttagttacaactactcctgatggtacacaatctaatgggtatgcctgacaactcctatggaccgaatgtttgtgtacccccaaaatttatatgctgaagcctaaatccccagtgtgatggtatttggaagtgagacctttgggaggtgattaggtcatcagggtggagccctcatgaatgggattagtgcccttagaaagggatgaaaagaccagagctttctctctctctctctctctctctctctctctctctctctgctctctaccatgtgaagatacaaccagaagacagccatctgctaagtaggaagcagccatcactggtggacactgtatcagtcaacaccttggttttggacttctcagtatccaggactgtgagaaatagatgtggttgtttagggtacacagtctatggtattttgttatagcaacccaaaatgactaagataacagctataaccaaagaataagacagagaaaactcataaactagcagttgctgttattattaatatatgggaatcgaaagcagccttattgatttaggctttaaacatcatcaatatggttgacaacttttatttttatctctccactccccagcttctgcacagcctgtttgatcttgccatttggatatttcacagacatctcaaatgcaacatgcccaaagcctaaccctgtgtttctctccccacaccagtcttacccattttagtaaatgacaccttgatttttccagttactcaaccaaaatccaggctttgcatccttagttcttcaccttctctcacctggacagactggacatccaatctctcagcaagtctgttcatgccacctccagacaagatcccaggccccccacaccttgctctccccacttctaccacccagttccgccaccttcattgctcatctggtcttctacggcagcctctcaaccagcttccttcctgcctcccacctctgctctccctacctaccactctccatgcagtcttcttaacacttaattcagatcatgccatctgccaactcaaacctcatcaaagactttctgttgcacttgcaataaaatctaacgtcactcagatggcccaggagactttgcagggtcagcccttgctgggctccccagcctcccatacctctccctcctctcctctccctccctcctcttctctcttcacttgggggttcattcttcattcagatttgccacgtccctccccacctcctggctttgggatttactgttccctctgacaagaaagttttctttcttttcttttctttttttttttcctgagacagagtctcactctgtcacccaggctggagtgcagtggcacgatctgggctcgctacaaccttcacctcctggattcaagtgattcttctgcctcagcctcccgagtagctgggattatgggtttgagccaccgcacccggccggaatgttctttcttatcctgtcctcctccaccctgcacaggatgggtctttctcgcacgtcattgatcatgttgtcacctcctcaaggaggccttcgctatcacactagctacgttaacgttccctgtattctatttgtatatggattaatataatttatttaggcaatgatatcatttggatgtttgtcccctccaaatctcatgttgaaatgtgatccccaatgctggagatggggcctgctgggaagtgttttggttatgaaggtgaatccctcgtgtctcactgttagttcacacaagagctggttgtttaaaggagcctggaacctccccctctctctctcttaagagctccctcttttaccacatgatatgctggctccccctttgccttctaccatgattgtaggctgaggcttcctgaggcctcaccagaagcagatgctgacaccctgcttcctgtacagtctgcaaaactataagccaaaataaacttttatttaccagttacccagccttgggtctttctttgcagcaacacaaaatgcactaatgtagttcatcatccactgttggactttaaggttgtttccaactttctattaaccatcctggggtgaaggatctttgcaattaaatctttccacatcccataattatggccttataataaagccctaatgattgaatatattttttattaaaaatatacttccatagcacttcctctgtaaccagcaatgttctaaatactttaccaatataaattcattgatgtgcgtgcatactttcttttgtagttaaatatactagctcatttatttatgtctttattttattgcggtaagagcacttaacatgagatctaccctctctttctttttcttgaaatttaccctcttgacaaattttaagtgcacaatacagaattgtatctgtgacttttttctggtctgccttttccattagactgtgtgctacatgagggcagggacgatgtctgtcttacaatgtcaccaattgtaattctggtgcatggcatggacctggcatacagaaggactcaatcaatatttattgaatgaagccataaaggaacaagctagcaccctggcatttcacatacattatctcatttaatcttcacagcctccctatggcaatattattattattttttcctttctatagttggatacaccaaggctcttaggttaagagacttacatctgagtcagaatgaatcttgggcccatgctattcccactgtacagggctgccaccctgatgcacaagtaactcatctctttatgcagtgccatgctcatttcttgggggtgacacaggaacagttagccccttcttccttctaccaagagatcactacctcacacccctggggatatgaaaatgtaaagatgagaaccttgattaataggcctatacataacctttaattaattggtcaacattcaaggattatacccttgaactttgggaaaaattaacagaagagttcctaaaaattaattaataggaatcaacacactgacaaaagtctctgtgcctccctcaaagaagtgaacacaggaatttctatgtcccggttcttgtgttagagccacaaggtcagagaaggttggacagacggagaccttgcccattttgtctccataagcccatggctttcaggttctgaaaatcctgaaaatcttggtcaaaaccagccacgtgtagtcttcccatttcttcaattatttagttgtttatttccctataatttgctatgtctatagaatcatcaaattttaaagccagaagtatcctaaagatcacgttttgtttctttaatgtgtgacctcattaattcagatgacattaatttaaaattcatgataattacataaacatagagcgagcagtactatgatgccttgcagatgaaatatgcatattctgtgtactgatacgttgtctcttcttaagaaagatgtgaggtgactgcctgattaatgtattgaggttctctgagggaggaagtaaaaaaaatgacacagagttgtcagacgactcataactctaagtttcagaaaaaacttggggttgaattttagctctcttgctttacagttttgtggcctcggacaaatgacttaacagggccctagctctctcatctgtaaagtgagaaataataacagcatctttattttagagtcattgtgaagaataaaaatgattactgcatgggaagtgcctgatgtagtatcagcacaaagtaagtgttcagtaaaattacccgaactactacctgtaatataagctatcatagtgaaagcagctaatgtgtaccaggtattttacaaacacgacctcagtcatttctcacttcaacctttgagacaagttttacatatgaggaaaataagtctgaggctgagttagtaatttgctcgaggttgtgcagttaggaggtgcaggaatagatattggaacccaggtctatgtaactccaccaacaggctgctttcaccaaatcctacctcctcttagaccagaagtgggtcaagtggtgccatcctctgtctgcctacgatgtgcacaaaatgactgaagggatgagtgggtgcatcacccaggaaacagagtttcaattagtggagaagcaacatgggtgaaggagaaaagaaacggatcctgtgtccttccagaggacaaacaactgtggactcatgctaagaaagaatccctaacaaatgaagttcctgagttagacagggcgctgaattggatgacctcgcagtttctcccgcctctaggattctgtaataggattctgtaataggcaccgttctcagttgtaccttttagccaagtgtccttagttgtctgtgtgtaagtgtgtgtgtcgtgtacaggaccacgggggtgggatttagcaaatataggactctggcctaaaggcaggaaacatccggaggaggcgaatgtgcatgtctgtggagttagaactgggctcgaatttatgcaccttgtttataaataacctagatcatgaaatgtgcagtacactttcagatttggcaggtgacactaagtttttttagtataaaattgggaggttgatgggaaggaatcttaagatcctacaagactatgtgaatgggcagagaaaggtagaaaagtagaggatagttctgcaacttaaaagattcagagagctgagttctcaattaaaactcagggaattcatctgggagtctttcccagactggaccccaggggattccagttaatatgtttcagtggccaaaaatgttggaaagaaaaaaaagggaaaatacaaaccaatgagatgatccagctttgactgtggcatataatagtgtagtcacccttggctaaggctgaatgtggctctgatcccatgggcacaggtgacgggcgggagaagagcagtttaaacaatcaaaggagcattgaggctggactaaagttagtgggattctctagtccataggcaagagcatgaagggtggtatgaccgatgtcaacaaaatcatgcatgtaagaataaagaggaagctggagaagctgaagctagcagtacattctggagagtgagtagaaacatactctcgttaaatgaacaaaagtcccatgaaatctattattcccaagagatagaactggctgaaagaatgaacagttcagttcaacaaataccactaggcaagtgttagggctagaagtgctagttcttttgttaaactttttatcttgaggcaagtgtagactcacatgcagttgtgagaaatagcagagtgatcctgtggtgtccgttttactcagtttctgccaatggtaacatcttcgtaactttagtgcaatagcataaccaggatactgacattgatacaatccaacaaccttattcagattcccctagttttacttgcattggtgtgtatgtgtgtgtgcatgtgtgtgtgtgtgtatgcatgtggtatgcttagttctatgcaattttatcacacgcattagtttctgtatccatcaccacagtcaggattcagaacagttccgtcaccacaagaatccctcctgttgcccctgtataaccacacctaccttcttcctgccttaatccctaacacccagtaaccactaatctccacttctataatcttgtcattttaataatgttacataaatggaaccgtaggcactctaacattatatgaataatagcacataattaagcatgaggaacatcccttagggtgataactgagacacaaaagtggaaccacccccctctcgcacagcatctcctatgctctgacaggaggttacatggacaaaaggtctgaggccgggtgcggtggctcatgtctataatcccagcactttgggaggtcaaatcaagaggatcatctgaggtcaggagttcaagaccagactgaccaacgtggcgaaactccgtctctactaaaaatacaaaaaaaaaaaaaaattagccgctcgtggtggcgcacacctgtagtcccagctatgccagaggctgaggcaggagacttgcttgaacccagaaggtggaggatgcagtgagccaagattgcctcactgcactccagcctgggcgacagagcaagactccatctcaaaaacaaaaacaaggtcaggtgctgtggttcatgcctgtaatcccagcactttgggaggctgaggcgggcagatcacctgaggtcaggaattcgagaccagcctggccaacatggtgaaacctggtatctactaaaaatacaaaaattagccaggcacacgtgcctgtagtcccagctactcaggaggctgaggcaggagaattgcttgaaccgaggaggtggaggttgcagtgagccaggattacatcactgcactccagcctgagcaacagagcaagactctgtctcaaaaaacaaacaaacaaacaaacaaaaacaaaagttctgacccagttgatcttccagacattctcaggaaacggccactttgatttaacaacttgagtgggtggggcaggataaaatacgaggggctggggctaggaattggatttgtcccactggaagggttatgtactggggataggaaccctctctaggtgacactagtggcaagaagttgctgtgtctgcaaggtaaggctcaggcagcagttgttcagcaggaggtcaggtctgggatgggagtcaggccaggcatgaaagagaggcttacagctgaagctgtcctccgctctcccttgaagccagactcaggcacaagtggcacgtgtaaagaaaactatgggatgccaaaactgctgagaacaaaccatgctcaagaactttcaaaactacttagacttcacccatatgtattaaatattcaacagacagttccaaaaaatggagggatcaggggaggcaatgagaagtatagtgagtgggccacggcaaaaccgcaggtggaagaagaaaacctgagtgaaggtaatggcagagaaagggggtcgcttgtgaaaaaaaataaatagaaaaaatcaggagtgattggaattggaggggaaagagggaaaacatcacacatgtgtcatagatttccagcctgcgtgaacaggaaacccagaggaaggatgtcaggggaggagaagacggtttggtcacatagggactgagttactggaaagacttcttctaggaggaaatgaccaaagcaaagttgagagatgtgctatgaggctcggaagatgtgaaaatttgacatattgattgacaatcatgttcctggttgaagtcatagtagatttataagggaaagggtgttagtagagccttggggttcccaaaggatgggagaaaggagtcagcaaagaatacagacatggacaaaaggaaagggaggaaggttgaaacaagaatcagaacagcagtggcccatgagagggaaggggagaatttcaagagggtagggttaagcaacattgagtgcttccaaataagacacacaaagacctacatggctagggccttaaaatgttccccttggaagctgtggtctgaggcttatcccaggggaagaaattcttaacgatggaacttctggtagtatcacaggtatgggattattggtttgtttgtttaagaaagggcaatttttgtggtacctctcaaatcctaccatatggcaactgcctacgttagctcttgttaggaagtctcttgctcaactatgaggatgggtaatgtcctgaggtcctgtagctaactaaggattagttaaggaaagggagaaaaaaaaaaaaaaacagaaaagaaattaggaaaacaaaaacaagataccaatagcaattatcaagatttcttggattacacaggcagaaaatcaataaggaaacactggacacaaactaagactttagaccaaatggatctaacagacatacacagaatattccacctaacagcagcagaatacacattcttctcaagtgcacacaaaacattctccaggatagatcatatgctatgccacaaaacaagtcttaacaaacttaagaagactgaaatcacatcaagtatcttttttgaccacaatggtatgaaactagagatcaataataggagagatttcagaaaactcataaatatgcacaacatgctcctgaacaaccaatgagtcaaagagaaatcaaaagggaaatttaaaaatatcttgagacaaaatttaaaacacaacataccaaaacttatgagatgcagcaaaggcgattataaaaggtaagtttatagcaatacatatctacattaaaaaagaagaaagtaatttgggaggccaaggcaggtggattgcttgagcccaggagttcgagaccaacctgggcaacatagtaagaccctatctctacaaaaaaataaaaaaagtggttgggtatggtggcatgtgcctgtagtcccagctactcagggggctgcggtgggatgatcactcgagcccacgaggtcaaggctgcagtgagttgtaattgtaccattgcactccagcctgagcgacagcacaagaccttgcctcaaaaagaaggaggagggtaaggagaaggaggaagcactcaaataaactaacatcagatctcaaggagctaaaaatagaagaacaaactaagcccgaagttagcagaaggaagaaaataacaaatatcagaacagaaataaatgaaacagatacttgaaaaacaatagaaaagatcaatgaaactaagagttggtattttaaaaaggtaaacagaatcaacagatctttactatgaaaaaagagaagactcaaataaaataaaaaatgaaagaggagaattacaattaataccacagaaatacaaaagatcataacagattactatcaacaatcatacagcaacaaattgaataatctaggaaaaatggataaattcctagaaatatacaacataccaagactgaatgataaagaaattgaaaatcttaacagattaataatgagtaaaaagattgaatcagtaatcaaaaatctcccatcaaagaaaagcccaggagttgagggtttcatggttgaattctaccaagcatttaaagaagagcttatactaatccttttcaaactcttccaaataaattgaagaggaaggaatacttccaaactcactttatgaggcaaaattaccctgatactgaagccagacaaggatactacaagaaaagaaaattgcaagccaatatccttgaacacagatgcaaaaatcctcaacaaaatactagcaaaatgaattcaatggcatattaaaagatcattcaccacgatcaagtgggattaatccctcggatgcaaggatggctcaaaatacacaaatcaatcaatatgatacaccacattaaaagaataaaggacaaaaatcatacgattatatcaataaatgcaaaatccacaactgacaaaattcaacatcctttaatgataaaaatcctcagcaaattatagaaggaatgtacctcaacacaataaaagctatttataacaagcccatagccaatatcatactcaatggtgaaaagttgaacgtttttcctttaagatcaggaacaagacaagatgcctactctgaccatttctattcaatgtagtactggaagtcctagccagagcatttaggcaaaaacagaaaggcaagggaagtgaaagaaagggaagggaaagggtctgaacaggaaaaaaataagttaaattgacactgttgcagatgacatcatctgacatatgaaaaccctaaagattccaccaacgaactgttagaaataataaacaaattcaataaagtttcatcatatgaaatcatcatacaaaattcaggagcatttctatatactaataatgaactatctgaaaaagtccctattatgatagcattaaaaaacctacaaataaatttaaccaaaaatgtgaaagatctgaacactgaaaattataaaacattgatgaaagaaattaaataaaacacaaataaattttaaaatatcctgtattcatggattagaagaatgtcttcttaaaatgtctgtactacccaaagtgatctacagattcaatgcaacccctatcaaaattccaatgacattttttcacagacatagagaaagcaatcctaaaattcatatagaaccagaaaagacccagaatagccaaagcaatcttgagaaaaaaaaaaactgggggcatcacactacctgattttaaaatgcactactaagctttagtaatcaaaacatcatactggcacaaaaacagatgtatagagcaatggaacagcaagagagcccagaaataaatccacacatttccagttaattgatctttgacaaaggtaccaagaacatacaatgaggaaaaggatagtctgtctaagaaagagcattgggaaaactgggtatccatacgcagaagaataaattggatctttatctcgccccatatacaaaaatcaacttgaaatggattaatgacttaaatgtaagacctgaaactgtaaaaccacaagaagaaaacatagaggaaaagctttttgacattcatttgggcaatgttttcttggatataacttccaaagcatgggcaacaaaagcaaaaacagacaaaagagatggcatcaaataaaaagttaagctgcttctacacagtgaaagaaacaatcaacacagtgaagagacagcctgtggattgagagaaaatacttgcaaaccatacatgtataaagtggttaatgtccaaaacgtataaagtactcaaacaacttaatagtaagaaaatgacccaatttaaaaatgagcaaatgacctgaaaaggtatttctcaaaagaagatatacaaatggccaataagaatatttttttttaaatgctcacatccactaaccgtcagggaaacacaaactaaaaccacaatgagatatcaccccatgcctgtttgaatggctattatcaaaaaataaataaataaataacaagtgttgctgaggatgtgaaggaaaggaaacccttacactgttggtaagaatatagattagtacagccatttatggaaattagtatgggggttcctcaaaaatataaaaatagatctaccatatgatccagcaatcctactactgggcatttactcaagggaaacgaaatcagtacgtcaaagagatatctgcactcccatgttgattgcagtattattaaccttcccctactctttcataagtcagacctgcattgaggtctgaaggctttcccacattttctggcttctcctcttttatccctcaagacatttctcccaacagcctgtcgtgcatctaatcctatcttgacacctgcttctcagaggatttggactaacataatgctttatcttatttcataattatgataacccaaaatataagtactattgtccccatttttcagactagaaaactgaggcacagagtggttacctgcttgtctgagatcatccagctagtacctgggcagagctgggattcaatccagaactgtctgactccagggtctgtgctcttgtccctggctacgtacacatacccctccctttacttgtcacagggcagtcacagcagtctattccctgtcttgaacacagccagtttatcctgcctcgggtctttgcccaaaccacttctcatgtctgaaatactcttcttttgaatggtcagcttcctcctctcttttgagtcttggcagagcagtactcctggccttcctaagtaggccctttctctttctgtcacttgcttatttcctttacagcactcaccacaacatacaatttttgcttttacttttctacttagtgtttttgtctccttctaccctttgaatgcatgttccatgataccaagaatcacatctttctcttttacaactgtgttgataaatcctaatacagtgtctggcacatagtcaacaaacatttgtcaaataaacaaatgatgggtaagttaatgtatttgcatagtatttcttcatacatattgtctcatgtaatcatggggaaagagaagacaaaggaaagaaaagagaagagttaaatctattgaatgggagaaaaagatcactccacacatgcccaaaagaacctccagtcccagggtgcctctaatgatgggagagtctgcagtctgcaaagacacatcccatgtttggagaactgggagtgtttttcctagaccagacatgtatagaactagcagttagacatgcaagtcacattgtgatgacaaacgcctcccaccctctcccctgaagggcactggagatcaagcagggctgatatccatcagaggtgtcagagatgtcagccaagacctctcagccactttctggcctgatgctactgagttcaatgggcttttgctcctatcagcctaaagcagaactctgctgccaacagttaaattagcagagcttatggttggggtgttctggttcaacaaagtcttcccaacattgccatgatcttcttgccacgtcaggtgacctgctctgggcatgtgtcctccatgggactgctattgtgcaacttccccacttttcacaaaagaaatgtgtttaggatttttatcacagtgactagaaacctaattcctactagctccagctaaggaggaaagattttgctaggacataggctgtcccacagagcccaagaacaggcaaggagctgggtccccagagcacactgaagcctgagcctgaggagccctcaggaccctgagcccttcttttgtcttcaccattctgccaatcagctttatttgtttctcctatgtggattggcttcttttgcctttcagctgctcctgagttttatatgtaacaatctgcacatccagacactcatggatacacattctccttctctctctcccaacacaactcagtcctgcccccaaagtctagggtgaagaactattggtccatctttgctcagaaatccattcttagatcagtggaccatgtccacaggggtatgcggttggggattgtgttggaggaagagctaggctgacaaagtctgtttagtacaaggaaactgaaagttgaaaagataagtttactcaaataggtaatgtgggaagtcacctaacattctgcctgacacatagttagcactccaaaacagaagtacttattattgttattgatatggcttttattgtccaaaatcatattgccagtaagacaggagtcaggacttgaaaccaggtctccagatgcccaaggtctctctcccagacaccaagggtcgctgggagcaagggtctctggggataggggcagtatgttatcttcagcatctagcccatgcttgaagggagttgattcttcagtgttttttgtttttgtttttaactaacctaacagttgtccccactgttcctagaacaacagcaacatcagtgtctttctctacaggggagagaaagacaagggcatgggagaaagcaaggaaaatctgcagactgaccccaaccagcccagaggctgcagatggggcacttcctgactctcagtaggtgaaatgaggccacttcatccctcaagagataggtacttcttctgccacatcctttctcatctctagcacatctcaggaactgaactcactcccactgaatttattaactgaattgaaaggaagggcagtcagcccatccatgtttgcacagcagcatggtgcaactcgacacgcaatgctcagagaagagggagctggtagcatctgatgcccttcagagcatggttccagctcagcatggggcaagcacaaagcctctacagcccactaagagctggcgggtttagcggaccctgtctaagaacccaaactacacgtgaatggaagagttttttaatttctatggtaataaggagcctaaactccagttccatttacaggctatacttaggagctatatcagccccaggctgatctctgtgatatgcagatttaccagagactggcagtgactgatgagaacatacataaggaagaattaaagttaaagatgaaaagaacttcgtaattaaaggggttgagagatactgaaacagagaagagtctgaaagaaaattcttaaaggcctattgaaaatgagccacatggagcacaagtcacctgttggaaactccacaattctgcatcagccttgtgggcaaggctcctgggcctctcggttccctccctataatctgtggttcacagacagtggtgtgcaccagaatcagaactgtgtgttatggctggtccttttcgccacttacaaacaagccagttttaaccttttggctgaaatacatacactggttcaataattgaagggcataatttattatctagctggccctggatgccaacttctggggtgggtggaaggattaatatatttacataaagaaagcctccagcccctccagattctgcaagacactccacggcacaacagtagaatgttagatttaaaagaaaccttctagaaaacagtccccattttatcaaggcccagagctcaagtgagcatgtcaaagatggcaaaataaagttatttttgtctcctcatgtccctttaaggaagtttagtccttacaaaaacaaaaaacaaaaaacattaagagattgtctaaatgttctccagggcgaaggtagcgagagtagaagaaccataaccaaaatagtcatttgctcagtatgttgcttctgtattaaaaatagtcaaaatggtatttctgggaggcaatttgatcaaacgacaaggttcacttgtcccaaaaggatattcagccattttattgctgtgttcatggtattcaacagattcgtgagttgcaacaagaccgttttgtctctgacaatttaagatcttacaactgcctcataacttgggatgtgttttaaattcctttatgaggaaatggaagcccaaagatactgagaaggggcccagagccacaaggtaatgcagccaccactttcagaaggggactgtgacatttcaatggagattcatggattccaagcttgagcacccttgttccagcagccattctttatgacctcagcaagctgactatgtggttcttcagtttcctcatctgcaaatgggatcccctatatttgaccttcatgcttctcagggttgttctgaggatcaagtctccttgctttgcttgagtgaggggtgtgctgcagcaagatgactacagacacagttggggatgggaggagtgggcagctgctcagacagcagtgacctcatttccattggaaggttacatacagaagacatggaccctgcataatcgggtggagagcaaggtggcaggaacaggtgtgtgtaatctgggaagctcaaagccttgagatcatgccctactttggctacagcagagcaaaggctggccacgaaagaggtagtgatgagcagaaaggctgtagagttggagctggaaggcaaggaggtaggaaaaggaaaaggaaggagagaagatggtctggttttctctctggccttccaaaggcacctcaagatgggaggtggccaagagaaggagtggaataaggggctcctgcccttcattcagtcatttatttgttcaattattttgagcacctactatgtattagtcacattgtaggcacttgggagacatccatgaacagaacagacaaagattctgcacttgtgaagataatattctacaggggaaagacaggcagtaaataatatcataataaactggacaactatattgcatgtgagatgataagtgtaattgaagaaaaaaacaaagcaaggaagagcaataaagagtttcagagtgtgtgtaaggtcaaatttaaatagagtggtcggtcaggagagacctcactgagaaggtggttagtgaggcagtgagctatatagatatctaggggaggggaagagaacatcaagcaggacaaatagtctaagccttatgctctaatccagcttgccaaatttcctcactctaacaaatcataccttcctccaaagacggctacaaaaatgtctcccatcccacacgttttccttgtaatgggactttgacattccttccatcaggaggtggggttgatgttcccttatcttaaatctggacagacttgtgaccgtggcagagttattctacatagctactgaggtaacatataaagggtagtaaaccttctacctggttctcctggcacccttactcttggaatcctgccaccatgttgtgatgaagcccaagaagccacatgcagagacctcatacaggtattctggctgacagccccagctgaggtcccagctgatagctactgctgaccaggagacagagtttgaaacgtctttcacccatcccccagccattaagtcacccccagctactgagtcttcctcagactctgtggaacagaaacaagacattttcactgtacccttttcaaattccagacccatataatccatgggcataataaaatggctgatttatacctctaagttcaagtggtttgctatgcaaccatataacaagagataactggaacagccacataaaatatagagccctaccttaactaaataataaaatttaccttgatttgcatgtcccttgaatatataccttccttaggcatcttgtgaggaaagaagatagttaggctaaggtaagatcaatgtgtttttatatcccttgacctaataactatctaattgtctcaatattacccctaacagagatcagcagaaaagaataaatagcccagaagcaaaccttaatagaagttaaaggaagcatcacaaatcagtaaggaaggaacgaattattttaaaatcaacactggaacaattggttaactatatggaagaaaatcaatttagatcctacacttaaatctacttgctataaatcaaaaaactttatattaaaaaatcaaataatgaggaagaagaaagtatggataaaggcatattttacttcttgcagggaaaggctttccaaatataaaagcaaaggaattacaaaggaaaatattaatggattgaattgcatgccaaaaaattatatgcaatattaaaagaaaataaactaaaaactgtatctgccacaaagattataagcaaagaacaaataccaaaaacaaacaaatatgcaaaacaaaaacattaagatcctaattgattaatgtgcaaatgacacaaacagaacaattctaaatgagaaaatacaaatggtaaatatccaacctgatggttatcaagaatttcaaattaaaataataatgaggtaataatgatcttcatctatgatagcaaaatgataataatggtgtattgtgagctgagtagtctcatacattgctggtagaagtatacatttttttaaaagttggtgagttaatttgacaacacacatcataatgaataaaacaaaagaaaaatacttgaaacaatttagggtaaattatccctgtataattctgttctcacactgctataaagacatacctgagactgggtaatttataaagaaaagaggtttaataagctcatagttttgcaggctgtacaggctaatgcttctgaggaggcctcaggaaacttacaatagtggcagaaagtgaagtggaagcaggcaaaaattcacatggctggcaggagacaaagtgtgaacgggagagtgttacatacttttaaaaaaccagatctcataagaactcacacactatcatgagaacagcaagggggaagtcagctccatgatccagtcacctcccactaggcccctcctccaacatataggattgcaattcaatgtgagattggggtggggacatagagccaaaccatatcaaccaccattaaagaaatagttaagcaaattatgatttatctattttagaaaatattatttatttattaaaatcatgcttacaaagactttttaatgatgtggaacatgtaatacaattttgaataaataaaaatatgaaaaatacatctgcttctacaaataaaaaagtctaagaagatgtaccttaaactaatggtgttggttatcttagggattacctgtgaattttcttatctacttcatacatttttgttttggtcatttttttaggcaataagaaaaagaaatcagggcaaaactgatgaagatttagatctcagttttccagtaggaacaattaagtgttttaggtctttgataaagagcattgcccacaggaaccacaaggtcatgcaggatcacagggcagcttagctaacctcttttggaggaaagtgaggaatccaggactgttttacgcatcagccctcagtttgtgcatgagtgtgttttatgttcctttttcaatcctgtggggacagaaatgtctggctggtcaacacgcatgaaccttggtataaaacccattggctttaggaaagttgacagatgccaagcgttaagggttaggatgcctgactgcagaggagagatccctggtgacattaagcctacagccaaccaccagtgaaggcatcctttcacctagaggaagtttgtgtctaaactaatccaggctctcccgggttatctccaagggcaactattatctaggccataatagagccatgcaatcatcctgcactgacccctggaatcctactggacggaatgtcctggaaaggcttcattggattgacaactacactccctgtatagttcttcccactattgcccactcatcattcatagatgggagtccaaggctggtccttcacttagcagtggggagcttagggccattaggcacaagcagcatggaaaaggaaaaatcaaatcagagcatgcccagcatctaagagcaacagaacctctgattctagaatccactctcaaccaatggctctaattctactcctgaccataagaaacctgccttgactacatatgtgcttaaaaagagctttggacactctacagtggttgctactaatatcacatgagtcccctcccccacaaaaatacattagacatcagcagctctatttattttacataggagaaaaactgaagtccagagagaggaagtgactcatccaaggtcacacagatggttcacagcatatcctagaccaattctgataaaagcctggcattagctttgaagaagcaatcacaaattgagggcaattatattacctgcccgatcaggtgagagagacaccactcatatctgatagaggtgcgggtcttctaacatgccttcctggccaaagaaaccaggcagcccattgtcctccaagccctagactgggtatcagtaagtacgtggctgacatagatctcatggcatgctggacacactgacccacagatccaagcttcaggaaacctcacactctccacttgcttctccttttgattaagctcagaggctttcagagaggagaccccagaatatttgaacaatgacagggagttgactgaactggtatctgaaacattcttaattcagaagaattgaaggtgttgggagtcaaggaatttaagtacagagcaggggaggggatgcagctgaactgcagagagcatgatattaaggacatcctgaaatccttccaagcctcaatttcctcacttggtgagcagacaaaacaggtagttaaactagatacagacgttcctcagcttacagtggggttatgtcctgataaacccagagtaattgaaaatattgtaagtcaaaagtgcatttaatacaacatcataggttagcctaggctaccttaaatgtgctcagaacacttacattagcccacagttggggaaaatcacctggcaggacagtataccatagactgttgtttatcctcatggttgtgtggctgactggaagcctttgttcgctgctgctgcccagcattgcaaaagggtatcatactgcatatcattggcccaggaaaatttcaaaattcaaattttgaagtacagtttctactgactacgtatcacttttgcattattataaagtcgaaaaatcataagtcaacctactgtaagtcagtgaccctctataatcactaaggtctcttataactatgtttctttaaatttcaattttctaatctctgccatagatctgcccaaaagtagctctcttcactttcaagttgggcaaaggaatgtacagacaaatcctctgtcccactgcccaaagatgtgtgcattcagaagaacttgttggactgcaacatttgcaagtcaaaaagcaagtggtttaagagacacacaacatctctcctcggaagagttccagggaattcccaaaggcttctttgaaagtgtcttagacagtgtgagctcctcagctgactgtatctccagccacactccctccaggagtcaggggcactggtggtatccaccctgggctgtggctccaaccactgacagatgttttatcaaagtgacagctcagtgctatgggctcccatctcaaacaggcaagagatccaagtgtcatttctcatgattaatgataaaaagtctagaatttggtggcttgatttcagatgcctcttctcctcaatactcccaaataccatatccagagccagaatgacatttgtagggggtggaggaagcggctgcagaaaagatgtgtgctgggacccagagagcttctgaagccaggtcagcacatgccactggagcaacagaagctggggcagaaccagagtgctggcatttgtcaggtgcaggcactgagaatgggaaacctggaatggtgatgggggacagtgatgaggactgtgctcaagggtttgttccaagtcagagatgggaagtataagggacaactaaaatcagtggagcaaaccaagatgctagaaatatgcccagagacagaatccagaaggtgcctaaagccaaattctaggaagagaattgagcatctggagtcaaagtcagtcttaaacgaagccagacaggaagaagcagatgcctcatcgtggcctcttcctgggcaaagcaggggcccatggagctgaactcacccttcctgagttcctctgatatgaaaatgccaccaagacaagcagaacatcattacccaggatagcagtgataatgactgggtagcaataaccgcctgataatcacctccactctgggcatcaaaatcgcttttaatgtccccaacaaagcagtagcctctggacaataaagcagattccatgggaacctggtttgtactggaagcactttctttcagcagaacccaaatttagcagtggaagaaataccggttccataaaggatcctccttacaatgacctccccaaccctaagcaggaattgctccaccatcaaagcacccattaactactgaccaaatatagcaatgcactggaatgtatggacaaattctcttgtaccattgctcaaggatttatgcatacagaagcacttgttggtatgactgttcttgtgacttcaaaaaatggtgagattattcccttctctatggctttcttctctggtccccaccccacccccgccacccaggaccaagcaatgtttgatgactgtcaactcaagcccagtacgaaaagtgctgtgttcgtgtgacaaaggctgacatagttgaaataaaccttggcaatgacaagctaaacccaaagacactcagtgaaatatcagataagccagatcagatgttttcctctctcttgagaagaactcagacaacatgaaaatttggacaatttaagtcagggctagtgctggaacccttacctaaagcagttactatgccttggacaggacctcccggcccacatgcacctagatgaaatactactgatgttgttcaagctctttggggattttgtctccaaattaccaatgtcatttctcaatatgccaggaagagagaaggaaagcaagcatgagacaagtttgcatagaaatatacatgggaaaatcattttcagaaaatcccacaagaaagcaacaggggagacaagagtggattcttgattcaaagggtagtaattcccatatcagaggggcctttgtaaatgacattggaggcacagatacaaacaccttggacttcacaccaagatacgtctttattcctagtgcccaccttccccctgctcatcaagtgaacttccttatcagtccctacctgtactcagctcttctggcctgactgcacattagaatcacctaaagagctttagaaaacattcctgtatttggcaggtcctcaggaagttaaatatagaattagcatgtgatccggcaattccactcctaggtacacactcaaaagaattgaaagcaaaggctcagatacctataaaccaatgttcatagaattattcacaatagtcaaaaggtagaaataacccaaatgaccatcaatagatgaaagaacaaacaaaatgtggtatatttatacaatggaatatcattcaagcctcagaaaagaatgaaattctgatacatgcaaataaatagagacagaaagtagactagaggttactagggtgggggaatggggagtcattgcttaatgagtacagagtttctattaaagatgatgaacaagttctagaaatggataatggtgagggtggcacaacattgtaaatggacttaatgtcactcaattgtacacttaccacaataaaatatttctttttttaccattactatttttttacattttactttaagttctgggatacatgtgctgaatgtgcaggtttgttatataggtatacctgtgccacggtggtttgctgcacctatcaacccatcatctaggttttaagccctgcatgcattaggtatttctcctaatgctctccctctccttgtcccctacccccgacaggccccggcgtgtgatgttcctcccactgtgtccatgtgttctcgttgttcaattcccacttatgagtgagaacatgtggtgtttggttttctgttgctgtgttagcttgctgagaatgatggttcccagctttatccatgtccctgcaaaagacatgaactcatttttttatggctgcatagtattccatggtgtgtatgtgccacattttctttatccagtctatcattgatgggcatttttattggttccaagtctttgctattgtaaatagtgctgcaagaaacatacatgtacatgtgcttttagagtagaatgatttataatcctttgggtatctacccagtaatgggattgctgagtcaaatggtgtttctggtttccctggccctccccacccttgtctgtttttctctgcttcatcctcactctggactacgggcactgcctagcaatatgtgtgtgtgttgagattatattctgttatctaccctgcctttgccagttctatggccatgggcagcttactttatgtttctgattctcagttttctcatacataaaatggggataatactctcaactgcatactattgttgtcaggattaaaggaaataatacaaaagatgcttagtccaatgtctggcacatgataaactcattaaatgttagcagtgatggtaatgatgacagtggtgatgacagtggtggtgatggtgatggtggtggtggtggtgatggtgatggtagtggtaatggtggtgatggtggtgatagtgataatgatgatggtgatgatggtggtgatggtgatgtggtgtggtgatggtgatggtagtggtgaggatgatggtgatggcaattgtgatgatggtggtgatggtgatggtagtggtaatggtggtaatggtaatgatgatggtgatggtgatggtagtggtaatggtggtgatggtaatgatgatgctgatggtggtggtgatggtggtaatggtaatggtgatggcaataatgctgatggtggtgatggcggtgatggtgatgatggtgacggcgatggtggtgatgatggtaacgatggtgatatggtgatggtagtgatggtgatggtggtgatggtgatgatgatggtggtgatggtaatgatgatggtggtgatggtgatgatgatggtgatgatggtggtgataatgatgatggtggtgttggggatgataatgaaggtgaagatgacaataatgatcctttctccctttagaatgctctgtgtttgtagatcccacctttgcattgaaccagctctcaggccctgtcccaccagttttttcttgtccatccttccatctttcttagcttccttggtcctgacttctccctgaaatatctaacctcccaggactcatagtaaaaatcagaccctccaaactggaagagagcttagagctaatccaatccaacatatttacattatcagaggttcaacgaagtaattttcttaaggatcagtgtctcctttgactcttgtggtatcacatttgcatatcaaaaataaacataaatatataacttctttttgcctgtttataagttaagttggaggctgatgtgagccaaaatacactcacacctcagactttttgtacttgctgtttcctctgccttaagtgctcttcctccagatatcctcatggctctgtctctcatgccattcccattcttggtctaacaccagcttgtcatagaggccttccctgtccatcctatgtaaatgagcaccactgtcctatcactgtctgtcccttcccaggcttcattttctccctgacccttaccagcatgtattttttggcttattgtctgttctctcctctggaatataaacaccatgacagcagaaacttttttctgtttggttcactgctgtatccctagcgcctagaccatgcctatcacatagtaggtattaagtaatcattcattcattcattcattcagtgggtaagtcagttcattgtttaactgaatgaattcatgaggcctcagtccaccaactatctcattggctcagaatttcacagacgtagcagcatatcatgggtgacgaccccactcccacacccctcccacacgctggctctgctctgcctacctgtactttcggagtcaggtcttcaaggcaaaagcgctgctccttgtggttgcctcctggctcctaggggagaatccaggaggctgcttttccccatggaatgactggctgccatatggttcccagtaaagcaaaggcaggaaacctcctattccctctgcccaaccctaggattctggcttccttcccagacccagaagagagacatgactaccagattatagggtagtgggcccacctgtttaccataatctgtagagggcattatcccatccaccccaacttgggagaaaagctgagtagaacattgtttgataagaatggcttttcatccattgtacaagataaaaagctacctccttcattttgttggattgcaggatcaatcaagtacacagctttttgtttagcaagaagccacctgtttaccatttgtaaagggatttgattgcctccaagaaatattagtgtggagctgcagtattctacccaccgaggaagggcaagaggcacagaaatcgagagaaaaagttataagcctttgggaaattaggtctctaggaggttgattgaaaataacgaaaactattataagccaagcctgtattaagtacactgttcactgcctctattactctcacaacattcctgcagtcatttgtattttatagattgagaaactgaggctcacatgacttgcctgagatctaacaactggtaaattgtaaggtccatatttaatcccaagcctaagttttgttcttttagccatcattcctaggcaaatatgctgaaaggtcctgttgaggcattttaaaacaacttcccctagctcagacctggatgttactagtaggtcgaggtcactattggggcttagaaatttccagtcttccttggaggataaacaagttgccaattactatgataaaggaactgtcatctcatgagattatggagcaaggaggactctaaggaatggaggttcagccagtgcagtgacagtagacacagcagagagctgggtggggagctggaaagcattgtagttgacagatatgtgggatacagggttactaggtctaagaggaaagtaaaatcaggggacagtgctggccaggaatccagagttgagaaggtgaggctggtagatggagtagggagagaatccagggcaaaatgctgcagagaaacatagtagtctagttggctaaagtcgaagcagaaaacccacacagtatgcaggcaagaaacaggactgatgccagggagtgtcagtcagcagaagtcaattctacccagcattctttgactccaaagacacaagatcctttgaactcagtgaaccaggatatatgacccacccctgcgtggtactaaagggctactgtccacacatagcctatgcctgcatggcagcccaggacacacgatcctgacccagagaatgagaatccctcccccaagcagttttcttggattctaaaagaatttggcttggaaaacttccaaactttagacaaaacagcttacaaggaaatactcttattttaaaccaaagtgcttgtggttgatcaggtaagcagtgtgcaactatgcatgcagcaacacactgcttcctccatcaaaaaggtcttgcaaggaaaaaaagtgtcaactgaactaacttgtaaacttagtgatgaaggtgatttacatccttgtgcaagctccttatctcatcaatgactgtctatggcaacctgttttaaactattctgctccagctctttaggcatcagacacctcccaaacaaatcccactgtccactcatgtcctaggagactgacagcatgggaaagtagggtctgaaggactcacgtttaagataatggttcattcagcttgactcaaacaatggggtacttattctatccttttctccccaaagtgacagagtgattgttcctaagaaacaaagaggacgtgcccacttatgaaagggaagagaaaggatgaatgctaggtcattcatcccaaaagaatgcttttcttttagggaaaaacttctcttccctttggtaagaagcagtcagtaggtttcctgtaaatctgataactaacaaggccgaaacttcatggacctgaatctgtcaaagaaaagaaaggccgcctgaattatttcaaagggacaaattattacttcacagtcatctgatgctaatccaactctttatcacctgagatgattttctccaactgccaatgtcccatggcagatttaaagcagatccaagaagctccatactacagatttcctcttcatctgttagaggctgctgtcttgtcagaaaggggatttgggaaatgccatcttttctgcagacccatccttggagagatgtctgcctcattaatgacaaggccactttatcatctctcagagaaaatcttcccctggctgccttgggaggcagtctcctctccatcctgctccatacctttgttgcctatcagcttctatcttgattgggtcctggtcatatcagaattagctgtgaagtaggaaaaaccagctggccaggcagatgtaccccagggcaggaatggggtgatggtctgacctcagaaggaagcaggaagtcggggtgtatcagagcccttggctgagttgctgagtaacctcagggcagtggttttaaatgttggggggtcacagatcctgctgaaaagctgatgaaagctatggactccccactttggaccaaattaaaagccattgacttagtggctgtcacccacccccacttaagctcctactttataagtccccagggatctatggctaggtatatttggattttcagtgctgaaagaatagcccaagtgggatatcataaacacacacgcctcggaggaaaggggagatctgggttttaattctcacaatatctatgtgcttggttatgggaaagccacatttcttctagtacccatgccataaaagtgagcctgaaaaattgcttctttaaggaatcctaagtgtttcatggagcaaccatggggctatagccattggcaagatggaggctggaagcaaggttttgtggccactttctcattcttcctcttcagttagagctgcttttctggcctttaaaattttgaagctctctggattaaagggtctctaaatttccttccagagttaactttttagtagtctagatctggccccggacagagaaaggagccaagggtggacagttcaactaaggggcctcactgtaatatgcatttctgagctcttgcctctactccaacagaacgtaggtccgtcttcaactgtgtagtctcacggacaaccagctcatgctagatgcacctgcaaattgtatggaacagagaaaggtagaaatctcttcctggagaaagaggaatgcaggctgctttgccctcatttccaatccctccatttccaaagagctgagccttgcaaagttccagggccactaagtgaacgctgaaggaagcagcaggctgctcccgacccactcagtgtagagctgttttactggtattgttctgctaacttgctaaatagctataattaaaaccaggctattatcattaattatgatcttccctcttctgattggcaggttggtgcttttatcaaatttcagagaggagcatttctgtgtcttccaggatgcaagaaagatagatggggcttaattgttctgactttggagcaaagggcatggtggcattgtcaggcatggcaaacttttgtacttgtggggcgggccctcctgccagcttgtccagacacaacaggctgctggctgtctccccgcctcctgcgtgggctttaaactctttacaaagtaatgaggtagaactgggagaggaaaggaaatttcacaggcaagaatggggcaaaagttctacccagctgttttaaggctcagctgaaatgcctcttcctccatgaaacttttcccaatcccccaccctcttcatcttttccaagtcaaaatgatcctcttcaccttttccaagtgaaaatgaattattttctcattattactttcattacctgtactcccccattttccctcattttaaacctcaaattttctgtagtttctactcccagcagattggagggagaaacaactagagcttcctcagttcagaaggccaaaggagcctgcagaatggggtgtgacttttttggctctgcccttctgatctgaccctcagcccttcagcagctcagtgaagacccacacacacacatcacagtccccccacccaattcctccatctgcaaacagggactccgtctgaggttgcctcaataaacttaatcatttctaagctggccatgaaaaggttgtgaaggactgtaggtgtgagagcatcgatgtcccctcaaaacaaatctcgagggatttgaagcagaacaacttctagaactcgactgtcagaccggaaagtttaaaatcaagagaataaagccagacaagaagaaaccaagccacaaattgcaaacaagtcatttttctaaaaaatggaaataataaaaactatgaagcaaaacataatgtctcaatataaaccattacagtgagttaaattgaaacttaatttgtttataaaaactagataataccaggctgggcgcagtggctcatgcctgtaatcccagcactttcggaggctgaggcaggtgcatcacaaggtcaagagatcaagaccagcctggccaacatggtgaaaccccgtctctaataaaaatacaaaaattagctgggtgtggtggtgcgcacctgtagtcccagttactcaggaggctgaggcaggagaatcacttgaacctgggaggcggaggttgcagggagccgagattgcgccactgcactccagcctggcgacagacaggcaacaacaacgacaacgaactagataataccaaggaggcatcacttcacctggcttgagaagtcaaaagggctgtttatgtttacctaatgctaaagttgccagataaaatccaggacacccagttaaattttgactttcagataaacaacaaatacaacttttagtgatgtgtatcccaaatattgtaaacatcagatgtgattatctgaagttcaaacttaactgatcatcatgtatttttatttgctaaagctggtcactctacctattactctaatgtttttccttggtcataaacggaagtgcaaataagcttaatgtttatattgatagagaattttttcatgaaggaaggaaggaagggagcagagggtgagagagagagacgacagagagaggaagggagagaggaaggaggaaggaagaaaggaagggaagggaaggtaaaagaaaaaaagaaaaagaaaaagaaaagaggaaaggaaaggaaaagaaaagaaaagaagtacagcattaaagaatcccttacttccctgttaggcaggtcaaaacaatggttatccagcaaccaagcctgtgctaactccagctactgaggtctgccagccattccccaacctggtcttttccttattctaggtttttcctttaagtatcctactgccttaatgctgttaagctcatttattttcagtgaattccttcaaggcccaggtttaggccatcttcaccagaaaaccttcccagactctccatcctctggcctctgccctgtgatattccttggtgcatgatgatgaatttctgaggatgggtgctgtgacttgtctaccactgtatctccccaactgtgtctagcataacaccaggctcacaggggccctcagtaaagaatgctgaattgaaacatgttcttttcccaagagatgaatacagagaagccaactaactcagattcagtggggtaaaaactaggctcagacctgctcactccttgaagagtaagatggaattttctcatatgccaattaaatatggataacctttgaacaacaggagtttggaccgcacgggtccacttacatgtgaatttttttcaataaatatattggaaaattttttggagatttgtgacagtttgagaaaactcacagatatagtacatagcctggaaatatcaaaaaataagaaaaagttatgtatgttatgaatcataaaatatatgtagatactagtctattttatcatttactaccataaaacatacacaaatctataagttaaaatgtattaaaacttattgtgcacacaaacacagactgtacatggcattgttcataattgagagaaatgtgaacaaatgtaaagatgcagcattaaatcataactatgaaattaattttagttaatactgtactactgtaatagtttcataaccacctgttactattgcaagaggtcaagtgttgaatctgtttaaaatcttcatgttaaaaaaaacatgagtagttttctctccagtaaatttcatatcatagtaaaatgtgatctctcatagttctcacatattattcatcatgtttagtgcaatactgtaaacctttaataacaccatgggacccatacaaagtgacagtagtgatgctggaactgctcccaagaagcagagaaaagtcatgacgttacaagaaaaagatgaattgcttgatatgtgccatagattgaggtctgcagctgccagccatttcaagataaatgaatccagcataaagaccattgtaaaaaaaaaaatgtgaagccattgctgtggctacacctgcaggcataaaaaccttgcactttggggtaaatacgtttttatgtcagattgaaaataaagcttttatatgaatgcaggattgttataagaaagccatacctatagagtctaatgtgatttgagaaaaagccaagttattatgtaacaacttagagcaaaaggaaggtgaaggatctaaaactggagaaggtaatgtcagcaaaggatggtttgataattttaagaaaaagtttgggttataaaaatgtcaagataacagggaagcagcttctgctgaccaagagacaacagaagagttttagatgccatgaagaaaattatctaggagaaaggatatctgcctgaatagatttttaatgcagattaaagtaccctactcagaaaagaaatggccacaaagcacatttatgagtaacgaacagaagtgagcaccatgattcaagggaggaagggataggctaactctaccattttgtgcaaatgcagatgggtttatgatcaggacttatcaatacagctgctaactcctaaaccttgaagagaaaagcgacaggtttggagttatacaagaaggcctagatgctgagaccctttttctggattggtgtccttaatgctttgtctctaaaatcaggaagtaccttgctagtaagggactaccctttaaagttattttgatattggataatgccccttgttgcccagaaacctgtaagttcaacaatgaaggcactgaagtattctacttgcctccaaacacaatgtctgtagttcagcctctagatcagggggtcacaaggacctttaaggctcattacacatgatactctatggaaaggattgtcaatgctgtggaagagaaccccaacaaacagaacatcacgaaagtctgaaaggattacaccattgaatatgccactgttgttatagaaaacgttgtgaaagtcatcaagcccaaaacaatcaattcctgcttgagaaaaccatgcccaggttttgtatatgactttgcaggatttatgacaatcaaggaaatcatgaaagagattatggatatggcaaaaaaaaaaaaagggtggagaatgaatgctttcaagatatgggtgttggagaagttcaagagctaatagaaaccacaccaaaggaattaacagaaaatgacttgatggagatgagtgcctccaaaccagtgccagatgatgaggaggaagacacagaagaagcagttccagaaaacaaattgacagtagacaatccagaaaaagggttctaattactcaaaactactttttacttcttttgcaacatgtatccttctatgagggtgctgaaactaaagtacatggtggaagaagaattgatattgtatagaaacatttttagagaaatgagaaagcaaaaaagtcagacagaaattactaggtatttccataaagttacaccatatatgcctgcctctcctgccttctcttccacctcctccacctcttctgctcctgccacctctgagatagcaagaccaacccacccttttcctcctcctcctcagcctactcaacttgaagataatgaagacctttgtaatgatccacttccacttaataaatagtaaacgtattttctcttttttatagttgtgttaataacatttcctttcctctggcttattttattgtaagaacacagtataaaatacacataatatgcaaagtatgtgttaactgactgtttatgttatcagtaagactttcagtcaacagtatgctattagtggttaatcataatagtagttatgtttttgggaagtcaaatgttctacttggatttttgactgtgtaaagggtcaactgtgcaggggttgttgaaaagtcaagtgtacatttcagccagttaactaagaataatccatcatgcatgtgtagtaccctggccctatacctatctatttgcctgtaccttcatctttgttagcccttttataagagactaaacagaaaaagagatgtaactcaaaactcaggcctatggccccagccatgtccacttcctcccacaagggaagagaaagaaggaagattgcccttagctaacactaccttgtcaggactgtggtcaagtgcatctcagtctcatgccatcaaaacccgggtgaaagagacactcaagtaagacagacctatatttaacttccagaagttcactttgcacaagttatatcaccccttttggcctcagttccatcatttacaacatgggaatcattatacctagctcaaaaggtttttatgaagattagctgatataacacagcacagcgcttagctcaacacctggcaaattggatatttattaaatgccaattttcaaattcttatcagaaggtttcccatggtttacacagtaaagaagggaagagaaagactgaatgaggaacattctcacttgaaatcaggaatattttaacccacccaagcattttgactactctgtggacttttctcaatgcctccctgaatgattgattattgctgttttgtccagtgctttcacattttactgggcctacagttagcttgctgcctaacaaactatccccaaaatttagtggtttaaagcaacaaccattgtattatatctcataaatgccatagttacaaaattcaggcatggttttaactagttgattcttctgttccatgtggcatgagctggagtcacttgttggtattcagctggcagatagctggtcttgagggcacagggtggcttcattcatatgcctgacaatctagcaagaatagcaggaagtctgggcttagctggggctgttggccacagtgtcttcatgggtatctcagagcacttggaagtcttaaatggcggctggcttctcccaaagttagcatctcaagagaatcaggagaaagctgcacgaccttttctgtcctatgctcagaagtcatcctgggtcatttctgccacacactattagtcaaacagtcacaagcctgcctagattcaaggggagggacatagagcccatcacctctcaatgagagaggatcaaggactttgggcctatatttttaaactgccatcctgggaatcttgtcaaagtgcagattctggttgggtaggcctgagggttgggccttggattctacatttttaacagattcccaagtgatgccagtatggacattttaaaagtcacactgtgggtaggaaaggcttgacaagcccattatgttgtatcttccattgcaccaaaattctgttactgttcctgttgtctcattcctggttagcttcatttaatttaaaactcagacagccaatcttttcttgtgcttactggaaggactgctatgttaagagacctttacttcaaaagaaagaaacatccctgtgtttagatttcacaagagaacctaaaagggctaccaggaaaacctttggcagagaatgtcaggtcaggtaatcataaagccctctgggtaccttttctctaccatccactttgaggagagagtaagtccaaaaagctaactgtgagaggaggactcactggtggtttatcacctcttagaggctcgtgggatagctgtgactcagctagttgctaactagtaaatattgatgtcttggtttctggcaatataagtcaattatccaattaccatggctgttcctagctgtggaggattgggcctgtagacattgagcacatggtccaataaattgtttttttttttttttaaaaaaagggaaactatgtattaagctaatgatcaatgatcacaattttatttactaacatttacttgcttacttaaggaatgatacaattcaaagcaggattagaagaaatataaacatcaagataaaatatggtgatgtctagattaattatcagctgttataaattatcattcccataggaccaactttctttaaagggacttttccctttttcccatcgaaacaagtgcagattttgccctgtgtagaatttccactggggtgggctgttccagctaccgaaccagcttccgaactcagaggcacatggcaccagtggcattgaaatgcacgctccagcttacctgaaaggaattgttaatatttctgttcagtatacctaattagctctggagtactgaaatttcacagaagtaaaatttgatatatgtccatgaattcctattaatttcccaaaaaggagtccctcttactatatccaaaatttttgcatcttttacattttcattgaaaaaccactttaaaaaaaagttacatgccaatttctaagatgtttcctcacaatcagaaaaatgttgttaccgtaacatccaatacaccatttccttctgactcctggggaactcgctgttggtgtaaaagtggaattttcaagctgtttagttgaaatagaacattttgttaagtgaagtcctaaggggaatcccaatgtataaaaccaacaagagtgagtagctgtgactgaatcaactgtgggagcatctctgtctccaaacacagtttgaaaaccactgagtagaagttaatttgaaccaaaaagtgactttgaatataaatctagtctggctagatttatattaagctttcttcttaaaaagttctgtctttttacttagttgcattttaaagcacatttaaatagaaataaatgtttccagggatatacaatggtttctctgcagtggaaagaaaggaaaaatatatatacacatatatatatatacacatatatatcatatactctctatatatatcacatataagctaatgagcaatgttaacacaattttatttactaatgtttacttgcttatttaaggaatgataccattcaaagcaggattacaggaaatgtaaacctcttgataaaatatggcaatgtctagattatcaggtgttataaattatcattcccacaggatctattttctttaaaatgactttttcctttaaataatagatggatggatggatagatagatagatagatagatagtagtggggaggctgtggagagaaagtgacagccgagagaaagtgacagcagagagacagcaggggaaaacacccacttcctgggtctggccatgcacagacccccagtactgttgtggaatatctatctatctgtatctatatagatagatagacagagagagagagagagagagagagagagagagagagagagagagagagagagagagagagagagaaaccaggagggcaggcaggtgaggtgcataaaggccctgtgatggacacagactccagtactgctagtcctggatgactgtgtagtcatttcatctctttatgacccaagttattgaaggataagaacaaccaccagctgttgctggaccctcttgtgaaagcaagctgaaaaaccaagacagcaagatgctttacaaagacattgtagagaaatgcttcaaaacgtgtacatccagaggtttccagtcccctaagcaaggatttccaggccatttgcactctcagctgaacatagagcatctgcaagtaggagagagacaagctctgctgggtctttaaccaggcatttatcttgacaattgactctatgccctctgccccttagcactttggttttgctgttttatgtcagtgtgccttttcccacctcaagcagaccatgtgccactagaatgaagggggctatgtcttatgtttggtaaccccttttagtaccatacctaacctaagtattagtactgtttcagaatgaaacagtggaagtttccagagtcaaacaggcctgggcctgaatccaccaatgcctttggtagaaatctggatttctatgccctgagttttctaaaagtgagtctgaaattctctgttgtactctctactacaaaaaggttataggcgtgatattctttgccgtgtcctagaaccctcaaaacaaacattttaggggacaggattgccttttcaggcagaacctctgttgagggaaaatggcagttaggtttgttcccatttccttctaaagagaaccaacaacattgtcatctatttgaatgatgttaaacagtttacaaagaatttttacgtatattctctctccacggcccctctgaatctctgagcgggtggcagggtagctgccatcagtcctgcttcacatatacgactcatcttaagccagtgacttaatcagctgtgtccccccatctaagaaccaaggtctcctggtagctaaccgttcccttgcctcaattctgtgttattggagacttgcctcaggccacacaggccagaagacttctcaagtcttggaaggaagcccccaactcatagctcagcacacatcttctcaaaacataataaaagaggaactgaatagaatggaaatttcagtgaagaagacctaagtttgaatctcacacctgctgttcctggctgtatgactgggtaagttaacttctctggaactcggtgttctctatctataaaaatggggatagtaatattttcttcaagggggttttgtgaggattaaaagagacaacataaatgaaagcacatagcttggggggaaacctaatggatgctttataagtatttatcaaattggaatagaggaaaaagaggggccttcctgccctaaaatgtcttcctccatacacctgtaacatcacagtattagaaaggccttcctttgggggtaaaggctcatcttcttcaagagtgttaacaatgattaggcatgcacagtttaaggatgtcttgcagcagatttttaaaaagaggtgagagtaggagaaactccagggtacaggagacctagagaggatgccgggtgacaatctctacttacagtaatgtgggtaacactatgcatcttaaataagcacaatgttgacataacacttatctgcattagcatgtttcagatcaagcacttcagatgccttctctacacttgtaaaatcatcatggtcatagaccataggaactgcaaatggccttagagatcactctatcccatctcatttaaaaatgacaaatctgaggcccataaagtagaacattttatagttctggggagaaccataagaactataagaaaatgctgaattctgatgctgcctgggaaacaagtgttaatattcacatccaactgcttagagagagaatgactcaccatcagttcacacttccctgggaccacatgctacccaagcctaggagctgaaggggctgataaggaaggtcagtgccatgtcacaggtggaagcttagatgcagcaggactgcaaggaagggcacagtcttcctgacatccagcttctctctgtacaatgctagcatcaagagaaagattcagcaaaagctcattctctgaccacatgtcttttgctttagtaaatggtggcttgactgagttcaaccaatctctccctaacccagtcaaccggctttctatgtacaaccatggtcctaaccatgccctttgaggcacaccctattactctcttgcaaatattcagtcttacctactacctgcacccccaccatggaaggatgtggtttcctgtccactgatgttggccttggcttcaagatttcctttgctgattggaatgtgtgcagaaggggcaatgtggcagtttcaagaggctctcagagctctcttgcactagtttcctccaatctgagaatattcagctcacataggagatgccctttcatcttgaatcacaggatgggaagatgcatggagcagatctgaatctactgacagcctgaagaagagcagcagccatcccactgcaccaacaagcaacatcaataataaagttgttggaaagtatcaagaatttgaggttattcacgcagcataaccaagtgaaaactgtccactatactcttcatctgttggactgtgatttctgaatgaagggtagttccactgtcccctctaataattgcttctaatcacttatctgcactaaaccctgtgctaagcactttacaatcaatcagcccattggaccctcacaatgagcaattattaaggtattactgtccctgttctatagagaaaatctgaaggctgagagctgaagggattggtcacatgattcgtaagtggcagacctaagacttgacaccatgaccacccacgctagagcccagactgtccccacactccagactgactctacgcacattaatgcaatgagaatgcatcttcttccctgctcccacacacatacttcccaactgtgtataatacttcttccttttaagtaagcttgtggtagaggggggagaatgacttgtggatactcagaatgatctaagcacccactagtccatttttttaaaacatgctgaattttgagcctttccaaggttgacttggtcaattccattgtgcccagagcctggccaacccagctttataaagtcctccagcccattccccattagggcacagtactgccttgcgctggccataatgtttccctccttgatttatggggccatctattctgggccactcctgatgtgctgttgtcgcccctgctgcctgacagctttagggattcttctcaggccataattcttgaatatttccacccctccccttccctggccctgggatttcagccactttccattcagaaaaagattgctccatttattctcagcttcatggtcctttttacatttatctactgctcagctgccttcctgatcaggtatttaaagataagcccatctgcttctgatgagtgaccctgctcctttttctcattgctctgactttctgccatgcagcctcaatatcattttatatgttcaccagctcccaattcattccattattcttttcttcttatcaaataagaaaatggatgtggaagggccagggaaactataaagaggtgtataaatattagttctttgtgttattgttattgttgttataactaacaacctcccgaatttgattctaagtggcaaaatgttaactttcactgtggggaatgttccaggattctttctcagcttggcaaccaaacaccaaggtttaggtcctgttcaggtctgaattccctggtatacaatcctgcctctaataagcagactgcagcacaggcttccagatgactcagttacgtagattactgtttccataatatctgtaataatagaaattagcttgtttaaatgaatggaacttactgaatttcaagaacagtggctcaagaagtttcttctatggggaaaagcatggagctgacagagctgggttcaaatcccagttctgacatttacaagcagaatgaccttgagcaaggtaaactctgaacctccatttcctcatttaaagtctcttatggactgatatgaggacaaaattcagtagttctacaaaaacccttagcagagtgcttggcacatgacagtcacccaatataagcatgtaactggtgatacgaatgaagaaatggaaaactagaagtcactgcaaataatttaagtgctcataaactttcaagttgaaaggggtgtcaaggacccaaacccttttcttataatagaaaatgatcaagaaacccagagagaacttggctgtcctcatctgcaaactctgagggcaggggccatgtctgtttccttcacagtgcctggctcatggtagcccccagtgaatatttgttgctgttgtggatggtggtgttaaacccaggggaggcaacatagcatgggggctaagggcaggtgtttggggatccaggagtcctgagctcctgctccacaactgaacagtgagatacttgggcaagggacaacctctctaagcctctgtgaaatgggaaaagcaatactatcccccacgtggcattgctgggagggctacatgagaaatggaggttaagcctgacttttgcaggggagaaaacattcaacaaagtgttagctctcacaactaccaataacctggggagggggagcagggaaaaaaactatcaataacttatctaagataacttagtaaattagtggggaccagcaaaaccccaagcagaatgacttcaagtccaggataatttcttctagtacagaaaaattaaattttaaaaatcagggtgatatcattctattaatgtttcattcttacttctaaagcacctttttgaatgcagtattctgtgattctggactcccttttaattctcaactattttgcttttctaggaggatgacgggaacatactagtatctgtgagaatgtgatgcttcaaacacacacacacacacacaaacacacacacacacacacacacaccccgacatactcctcttaaatgcacttggtggtcaatatctcctatagagagatgtagcatttgtttaacaatcaatgggaaccataaaaagccccatgtttccatcagtggtaaaacctccatatgtcaagtcatgtgctccatatgtcaagtcatgtgcttcctttctgaagacttaatatcaaggtgtcatcattatccataatgtgtttttgaatcaggtcttaaaacttaatgtagcttttatgcctggagataaggcaggatttggatttggcaagttacacacaagggccgctggttgatcctaattctctagaatgatgtaaaaccttaattagctctgaaagttgttacttgggatgacctcctccccagcactctgcactgtggaggggtgacaacttgggaaggcagaccacactgcagtgcactgggattccattagaaagtcttttttcattccgaaagacattgagagtgaacaaaggttaaaacacagagcttttctttaaaggagaatgggcaatgagctgaaagtttaagactgaaaggcttggcagagagacaagaattgaggctggaagcaggaagctgcagctccagggatccctggtctgtggctgtgagcctggctatactatggtccagcaccagaatgccttaacaacaccaatgccttcagaaacccacagaaaggaaacaatgcagaaaggaattcatggtcttttaaatgagtgttgcatgattggccatagtttattattttattccttctagatgatatgtgccttttagtagtccttccagtggcttagttcaggagatccctagccatctcaattcaacagttcattgtgagcctccatctgcttaattaccatcttattggccagtttatctgctctcctaggtcatttcttttggccgatgtgtttttgaaaagaggaccacaggagtgagatactggctgtccagtattctcagtggcttggggtgaagaaagagggtaggctacaggttatgggtctgtgtttttccctggtcttccctacattccccacaacctgtgtttgatgccagaacattctgacacagctctctccatcctgaagtaagggaaacttactgaatgtgtccctaggatccatgaactgtttcctgcaatgggagagtaggtatggtagtgtgggtgcagggagacaaactgccacagaagctgcaggacaaaaagagctcctacaaggcaggggtcacaagctcttggggagcacaaagcccttgtgtggaagcagggagccgggctgcagaggaaatgggtcttagaggagttgacatttgagtggagacttaaggtacgaagaacatttgccaagatgaagaagaatacaaagggtacctccgacccccaagagggaatgtcttgacaaaagcacagagctgggagggcagattttgtgctgttacgggctgagtcacgttcattcatctgttgaagccctaatccccaatgtgactgcatttggagatccagcctttaaataggtaattaaggttaaatgaggtcaataagggtggggctctaatctaacaggattcacatccttataagaagaggaagagacaaagagaaaaggctctgcaaggacaaggagagaagacagccacctgcaaatcaaggagagaggtctcaggagaaacccacctgtggcaccttaaccttggacttctagcctcaagaactgtgagaaaataaatttctgctgcttaagcttcccattctgtaggattttctgatggcagctctagcaagctaagacaagtgtggagcacctccacatgatcccattggacaataaaagttcattgtaagaagaataaaatctccatcacgcacctccacatgatcccattggacagtaaaagttcattgtaagaagatgctcagcttgggtttttcattacctcacacaggcaggtttctgtattgtgtaaatacatggaaatattgggaagaatacacaccaagctattaacacaggttacctctagtgaaggagaaagagcctaggttgatgttttgagcaaagcagagcttagatatagatagacatagatgtaaatagagatctacaatccacctttaaaaagttagcagaggccaggcgcggtggctcatgcctgtaatcccaacactttgggaggctgaggtgggtggaacacttgaggtcaagagttcaagaccagcctggccaacatggtgaaaccccgtctctactaaaaatacaaaaattagctgggcatgttgataggtgcctgtaatcccagctactcggaaggctgaggcaggagaaccacctgaggttgcaagtggttctgcagctactcggaggcagaggtttcagtgagctgaaatcgtaccactgtactccagcctggacagagtgagactccatctcaaaaaaaaaattaattaataaataaataacaataaaaagaaggaaaaagtaaagaaaaaggagagtacattcacatgtcactttcataaataatacttcagtttaaaaacaattgtaaagaggaagggaagggtgcatttgttctgttaccagggacatcagagtgggaggtggtggggtgggggccccagggaggattctcttgggaggcttttcagcaggatttccctgatggctcctccctccaccagtcagcagtgtggcactgtgagacagggtgctaaagcctcaagacctcctctctcattcagttaccctgggatttggtgattaaatctctcctccttctacctaggactttttataattgtgtaactcaatcctattcccttcagccttccctttctctcaaggaagagcccttacccttctcaggctttcctcaaatgtccatgcccctcctgtaccctgcccttctccctgggtacggtgagagtccttcttgtggcccatgttatatttcctcagtagcaggagccaaacagcctccccctagttctagcccagtgtgcaggcttgtgctatagagagaggtggaaaggggaaagagaagatgaaagaaaagcagtcatatccaaaggcaaaattatgagcttgaagtcagacagaagtgaaaatgaagttggaggatggaaggagtaaaggcaagactagaagaagagaaaagggaaagggaagaataaaagaaagagggagggtgaagagaaaggacagcaggtgacacagttccatggcctcagggcctctctttcctgccaccttccccagccccaggcagcctagagctgtccatagcaggcctgtctgattttttcggtgaacccattctgaattcttcttccaagttttaggtttgaaaatacggggaaaggccacattcctaaacaaaaatagaagaaagggtttgtttgaaactgatcaaatgcgattaagggagagtacccaactcacatccctttgattaacctttatctggagagaagtgattggtgattaagaattagatgaggtgactaattatatcaggaatctgccttcgaagaaatctcagcaccagagaaaaagctgataaaaaacaatcatggctgtaatggtgccttttaaggataataattaacctgtaataacaattttggcctcaacttaagccctgtaaaataatcctttttcattaacttcaagttcaattaacatcaataatgagtgctcatttagaagtaaccgccacatcaagctccctgatggctgagctcgggcagctcagcttccactgaaagaccagcagcccttgccacaggactgaatgtccccaacatggtaagctttgggtgtacccattacaaaacaaggaagaatgtgatgttcagaaagagagaagcttcagatggcaccgaagtttacagtgaggaagaagaggaggaacagaagaaaagggtggggaggagagaagccaccaccaccacctctggtggtctactaatctcagtgtttgatatccatctgtaactccaaaaattaaagatgatgtgactacctggcaggcacttcctccttccttcttgctcacagagcctctgctttttttcagatttggggcttctaggtacttcaggggcctgggagatgattgctgaatagttcaaatcaatgcatttcaatgtgtggccccaggaccggcaggttttgttagaactgcaaattctcaggccctacccccgacctactgaatgagaaactctggggatggggcccagcaatgcctgtgttaacaaaccctccagtgactctgatgtgcactcgagcttgagactatgaattgtgttcttttctctagtgattgactttggcatcgtgtgaggcagccccagcaaatgggacaaagaaggaaatccagtgagggccttcgggaaagatttttgttctccaaagacccttgccccttttttgccccctgcaagcagctgtgtgtgaaggtgccaagggcttctgcagccacccatcaccctgggggcggctactcaccctgaggaaggcagagtagaaagacagagagcctgggctcttgagcttgtaatgttgcagctgaattaacctaccctggagtcacatgtgctctcaagctctcacatgaaataccacacccctagggctgggcacagtggatcatgcctgtaatcccagcactttgggaggctgaggcaggcggatcacaaggtcaggagatcaaaaccatcctggctaacacggtgaaaccccgtctctactaaaaatacaaaaaattagttgggtatggtggcatgcacctgtagtcccagctactcaggaggctgaggcagaagaattgcttgaacccgggaggcaaaggttgcagtgagctgagataacaccactgcactccagcctgggcgacagagtgagaccccatctcaaaaaaaaaaaagaaaaaaaagaaagaaagagaaaaaaagaaataccacacccttgattgttgagctactctgaacgggtctctgttacttgcagccaaatgtattctaactagaaggttcaggatgcacttaccatgggccaagcactgcagtggctgcttcgtgggcttcatcatcatgggcatcacagctggtctcgcctcttcattgacctaaaatcctcactattagccactcttctctgaaaggctgacctgacctgagagcattttaaggggctctggcccacgccaatttccctgtcttgcccagatgaatgggctttggaaagcacacacagatctatcctgagagtaggccagttcatgcattctttcatttatcattaaatagatctcaggggaagagaaaagagagtagagaatctgcatggggtaccacctgagcagtgtcaatggagatgggccacctaacagggagccctggacactcaagggttttagaccaggcagtgaccatatagtggaccagggcaggttgccaaggctgcatatcaagctgtcactttgtataccagggaactccttggcttcttaagcagggtcgctgcctcctcttctggcttcctcactcctttctccttagcccctatttcctaaataggcaaaacgtaagcacactcatttttattttaaggaaatttcaatttagccacttcaaaataattttttctggcacccactgtggtgccttgcacagagtgggtacttcactcaatgtctatccgcagtcaaaatgacagtcagaagcagtaaccagcaaacatgggccatctacacgcccttgactgggcttcacagaaaggcaatgaaacgtgcacaggacactgtgagagatgaaggacttgacgctctgctgcttcatcactctcctcatcctttaacccctccacctcaagagagagacatgtaagaagaaaggagcacatcccactatgagaggtagagaacaagagaaaagaaatcaagaaggagtgagggacaagggaagtgagtgacagacgaggagtagatagatatgagagccactcgattttcatcctactccacaggcttccagaaaatcacagctgaatgtcttaagaaagaaagaaagagagagagagagagagcaagcaagcaagcaagcaagcaagcaagcaagcaagcttttcctcatagcaggggtgagaagaaagcacagatttggaacgaggaggggatcctcaggcttagaaacctaagatcaaatcccagttcagccacttatgagtcatttgacctaggcaagtcacttaaccccacagagcctcatttgtgaaacagagataaaactatctgtctcttgcagctgtgaagattagatgagaatgtctgtaaagtgcctggcatgtaatagatgttcaataaacttcagtgccacatttctcttctctccaatcccccttctcatcattgccttatctgaggtcatgtctgatattctctctggcaggtaattcttgagcatgtctcagcaaattgcttgcaaatttttccctttgaagaggaggacaaagaggattaaactaaagaaaattcagcttctgagtgttgcacccgctgtttatgctaactcagttcaaactacaaaggcaagcttggtgccagggaaggagtcccagcttcaagcccacccaccaggtctgaaaaccctactttatctgattgcattattggccaagccgctcatctctcattgagaatcagtgctttacttaagaaaagctgcaaatcaaacaacagggctgtccagggaactgagaatttagctccttaaacatttcctcctataaatataaattgttgctttcctctaaagaaagcctctctccctgtgatctatgaaggattggagagggggtcaggaagatcgccgtatcttctggtgaacattctcgatcaccttaatcccttcactgacagtcttctgatctgaaagaaatagtttattgtgttcctcagtttacaaagaattaggggtagggggtgtggatcaacaggaagaacagaacacaaaattcatcagggaagcagaggggagggggaaagagagaattactttgaatacagttgcataatccataattcagcaagcttttcatttctcttatcttccaaaaagacatgaaattaagttctaagcaaagcacataatttatgagaagtctctgtgctgatgactcccaaatccccatgcccagccctgacttcttacatgagttctagtgccatgtttccagctagcaggacacagctgcttggagttgggctatcatctcggctccccaggtgcaaattgaactcaactcttcctccccaatgttttttcttcccaaattcttttctatcaaatgacccattattattctaatcttgctggcaaaaagtgctagaaagcttgaatttctctttttcggccccttgtgccaaggcctgtgaagtttttctgaagccatcctcttctccatcatcctgctgaatctgcatctttccaaatcttccctctcctccaccccagattcctgaccccagtccctacatgctaatccagaccacacaccattgccagtttcatcttcctaaaatgctatttacatcaggcctttgatggctgcctgtttcctgctgcaagaaagtcaaacaccctctgcttgctctccaaggtcctggccccatcctgcccatccaactgtacttaccgacataaaatctcttctccaaactgagagggcccagtagagcatgaggctcattttaggcactacaggaagacaaactggactgaccttgtgctccatactctgtggtccccacctggaatgctattcctctttcatcctgactattccaaaccctactcctccaaaacccatcaagcttcagctccatcaggaagcctgtactcaccaatcctactcactgttctttgcccgaagacatttagctcttaagctcacaccatctagtattattttaaagtatgtagtataatgctcacagtgcttttgattttacagtgcactaacctatgcatataatcttatctgatcccctcaacctggtggggttggtatcatccctgcacttaactaggacccagagagtttaaatgaagatcatgaaactaactgatgatggtgtcaagtcttgaatccccaaatgctgactcaaaatcctatattttttgtttacctcattagactttaagtctttaaagtcagggactacatcttgtaattattgcctgttaccctatagaaccgtacaaagtcctgaacgcatggaaagtctcagggactatttgtagaatgaagaattggaattaaggaaaaagtcagtgaaccattaagaattgggcaagtgaatgtataaacacaagctgtattcactgggacatgggctatgaaagatagaaagaacttgctcagatagtccttttaatataccacatttatatccctcattcattccttttttcttccttcactgattcagcaaatatttactgagcgcctactacgtccctcatctgagacagatgagtcaaacactcccttgtccctcagtcccaaccctaacataaaccctacccaaataaggaagagaaaatagtttttatgtatgtatgtaagtaggtagatatttatttatcagttggtctatcaatcaattgattgattgcctctgttcacacaattggctataatgattggaacagaaaaccataacaaagcagctctggtgagtttactatatatccagaaaagcatcaaaataatttgggttttcctttggggtagaaagaaaaataaatgttcttaatctagtcatggtctttaaagcatattagaggtaagcagctcttatcataatttaccaattacataagaatcagagaaggtgatgatttcttattactgctttatgaaattctaacggaccctgcaactgtttatagaaataacaccttcccagtcatgcttcagcatcagcccaggaaataggttagaatcataggattttaatatgaaaaggacagagattagaactcacttatttgatattacagaaacaaagactcaggaagtttaggtgatttgcccagattaaaaaagaataacttggtatattctaaaatgaaaacctaatctcacaactcctggtcgagaactctcttccctctttccactgcttcaactcacattacagtttttaaattttcctagttagttattgaaatagggtttttttctgctgtgaaattaaaagatcttacaatgaatatcctgactttggaaatattatttatgatttaattaaaatccttcaacatgaataaataaataaacaaaagattcgctggttcaatatggaatccttaggcaatgcataatgggacaggattggttttctggtaactttcactcttagagcaaaacagctgctccagtgctcaatatctaaagaattatattgtgaccctcatttatttagttatattttccacaagataaactctaactgtgagaatagttagatctcagcaaaaatgagatagaaaggaagccacaaaaaataatgaggggaaacccctttattaataacaacatcaataataataaaacagaagataatggataatatcttcagtgctctaaccatgtcacagatgctacactaaactcttcttaaaatttacctcatttactcctcaaaagaaccctataaagcaagtactataattttacagataaggatgctaagaccagaaaaactattttcatattagcttaagaatgtctggagctgggtgtcaaacctagaactaattccagattctgcttccttaacacaatgtaatatcctctcctttcagaagtacaggggttaacgaatgttcagagttctttaaacaaaacaaaacaagaaacccacctttctgagcctgttcctgatgataattgagtgtgaggttgagtagagaattacactctgtctgggggattacacttctatcaggatttacagagctgaagcaagataattctccctccttctgttttaacagtaaatgtcttcagtaaaatgggaataaatgatacacatacacatgcacatataaaatactttgcatctgataaaggagaggacatgtgggttgtgggtccttctccagatgccaccacaccactcagatatgaaaaatgcaaacacaattttgtgctgcaaagtaatttcttgatgttatcaaacattctcattacttatcaagggtcatttaccacttctactctattctgatttttcacattttctgttttctgaaatgcaaacaccactgcttgtgatggatcccttaaagtgcttctgattcacataggtcagcatgttcatgtaaattagacttaagtctaaactatgtttcttgcctaaatatttaagcacataaataatctctggttatccaggctgtcattttaagctatttgacatttattgttctgaagagaagaaaggtcagatatatcaaatctgcatttgtgcttcatgacatttttctccaatcagattcttccaaattatggtgtcaagattaatactatgaaagaaagaaggtaagagggaaggaagagaaggagggaaagggaaaaggaaagggaaagggaagggaaggggcaaggaaagaaggaaggaaagaaggaagggaggaaggaaggaaggaagggagggagagagggagggaaggagggagacagagaaggaatcccttttcctacctagccagccacagtgaagcattctatttagtaaattttgtgctttcccccttggctgcatttgtcaagcagatgtgtgggtccaagggggctggagcatgaagggaaaggcaggatgcgaggaatggaaggggatgcatggctttgtgatctgtttagcacaacctttgctcatacttcacagaacagattgagaccgctgtctggccccactcctgggctctctgcctttcatctctgcatggccttggatacatttgtcttctcatctcagagaaggaggttgttttccttctctattgtacccctgcctgcagttctgcccatgcctaccgctaaactgcaacaacacaggtttcccagttcaagggcctcgctatagagggtcagatcacaggagcagaatgttgtcctcatctggggccatgctttaagaggagagggcgtgtggggcaggggggaagaagcaggctcagtgagcactgtgaaacctgtggtgaatgaggaaaagtgacaagggggctagagacgtttgtttccttcccagcatgtatcatcatttctcattatatatttatttgttcatttgcacatttaatattcttccctcaccattctataaatcccatgcgggcaaagcccatgtctgttttgttcattgctgtctgtgcagcatctagtacagtgtctaacatactgaagctgcccaataattatttgttgaattaatgattttttaaagaaaagggataggagagaaagaggaggagaatgaaaagaaggaggagacaaagaaaaatatataggatatgtgggataactgacttcaaatgtttgaaggaccctcatgttggggagaagttaatacttgtcagccaaactacagtcacaagtaaaagacataagacagagagatcatagatgtggagttaaacaggctgaaattcaaataccagatccttcacttactggctgtgcaacctggatcgtgttatctgacctctctgagcatcagtttctttatttgcaaaaacgaaaagagtactaaaatcataaaactaccacattatagtgaggactaaataaagcagtctatgtcaaactgttcaatggtagctgttatcattaaattacagaggaatagaatttgaccactattaaatattttcccaacagacttgtccaacaggtaacagggaagccttggaaaatagtgatccccacatccccagaaatatacatatacatttaaggttttttttttttttttttttttttttttttgagacagaatcttgctctgtcgcccatgctggagtgcagtggcgcaatctcagctcactgcaagctccgcctcccaggttcacgccattctcctgcctcagcctcccgagtagcagaaatatttttttaaataagattgaatgaactctattttaagaggaaactccagaagcagacagggccctagatataacggcatctaagtcctgtataagagtctgcacctagattgaatggttttgctatacaattatcctctctctttcagatacctgaaatcttttctctttagctttttccctcctgattttcaacattaagaggtttgctatcataaaacatgtttcctccatgctgctgaaccctctgacatcactgatatttcattctctttctcttctttctttcaaagacttcttaaatgactacttaaacacgttttgcttctatttcttcagcactctctctaaacttccttctgcctgttcctgctctgtacaagacactccgtgaattgctcttggtccaacacaatggtctctccactccatctgccttgctgagcttctataacaccacatgatccacagaggcctctgttccttcttgtaagaaaattctttctggtgatgtcattgactccattctactgtctaattatgaactttcctaaatctaagctgtgaccttccttctttcctctctctacgtcctctggaaaactcatctctttttttcaaggattaaattaccacgtgcatgtaaatagctcccacatcgatatcttcagccttgacctcttccccattcctgcttcaggcccatgctttcatgtgcatcccagataccctcatctttggatggatgccacactagaattattgtcatgccaaccacttgcccctcaaaccagatcctcttcccaactgtcttctttatcagtaaaccataagtcttcaaggttccaaaaccttagacttttgactccttctcatttgttcctcttatatctgggcatctattggcccagctctgactctttcattgcttatttggtgtaatagcttcacggggctccaacactagccctctctacatccaggcctgagacccacactaaaatacatttcctgaataatctgcagtcaacacgcagtcaaaatgcatctcccctactcaagacctaaataggttcagatttctctagcatcaaatcaaaattccagacacaaaaagccaggctaacctctagttcagaatatctgacctagcaccttagagctctctgctctggctggttctactctccagagcacacacacacacacacacacacacacacattgtctatctgcctttctgtctctctgtctctcctttctcttctctttcctctctccctttctctagccaattgttcttcatctgggcattattttggctcttgccccaactcagaagatcctttgtccttctcttttgaagtaaaaagctgcactctctccaagaccctattctcaaattacctccttctggaagtgtttttattttttactcacttctatctcagtctcaaaaggaaaccatcattctcagcagatatcctttgacctgactccctgccaaaaggcaataagcttattgtttctaaaattccagagctatagtttcctgtctcagagaaactttacctctcccataatgcactgaaaactactgctcatctgcctttaagggaatgcttttgagatttggaggtacagcatgaaactctccttaatcaccccagcaggaattgacctctccaaccctctatccaactactataaccagctgcaccatttgtttagcattcaagtgctgccttttattggagttatttattagcatactttgtctgccttttctcctccaactagtttgtgaactcctgggaggaagagactgtacttcattcaacttggcaagtgctcaatttaaaagaaaaaaaaactaaaccaataaataagcatttcctcaggcaaaaattcaaacttatagatctccattaaaaggattcccttgtctaatttctctttggtgcgcacctcccatggagatctatatggtatctcaggagacaagctagtatgacctagatcccaaagcttatcatataggctcctggccatgatacaagaactagcactgcatgatccttcctaccatgaataactgtaaaactgacaaaatatttgaaagaaactgtggaataatcagcaacacaggactataatccttgaaagagtgagaatgtatgtggtgggccctagcactgttctgattttttgcctagaggcatttaccagactctgacacaggaaagagaaggccaaaaagagcatagtggcctcagtgacttgaggtcatagagattggtgtctagaaaggctgaagcagctcgaatttccagggagcaaaccagagaaggcacaactagacacacatacacacacagagagagacagacagacagagagagagagagagagagagagagagagagagagagaatgctccacaaaactgcctagaagtcctcttgagtctttggctaaatattaagttgtgcattcatacagtgagattccacaagactaagcaaagagcagctaccaagtaaagaatagctatcagggaactgtaagccaaacaatttctacagctcatacatggaattgggaaatgttttttaagtgtgtaagaaccagagaggagagacctcattgaatacctttgaatacccgaggcatgtgatggagactccagaaaggccaaaccttaagaggaggcttaaactaaccatagaataaagacttctctaaactccctcaaacaaagcttgacaataatccttgaaagtataaaattgatggacaagtcaattaactgtcaaagaaaattcaaaagtctttcaatgaagacaaaaatgtccacacattcagcaatggaatattcataatgcaccacaccaaaaaaaaaaaaaaaaacaactgcaaggtatgcaaagaagcaggaaaatgtgacctatttccaagagaaaaactgatcaatataagtagacatagaaatgatagaaatactataattagtggaaaggaactttaaaatagctgttatacgtgttcaaggacttagagaaagacataaacataatgaagatagaaataaaaatggaagcagaaattctagagctgaaaatcaatacagtatctaaagtgaaaacttattacatgggctggtttattagcacattagacactatagaagaaaagagggtgaacttcaaaatatgcaataaaaactatgcagactgaaatacagagagaaaaggggctgagaaaaaaaatgaacagacccttaataaagtacgggaaccataaaagtatagcacaattgtaattgaattcttagaaaggaggagcagaaaacaatttttttaaaaatttccaaatgtgatgaaaaatataaagagaaccaagagtctatcaacaaattgctaggaggaaaaacacaaagcaaattacataagggcacatcattaatcaaatttctaaaatcctatgataaaaagaaaatcctaaggaaggcagaaggtgggaaagacataacaggaaacaggtaaagagcatctctgactcaggaaattctctgactcactggaaataatgcaaaccatgtaacaatggagcaacagcattaaagtgctatccacctgaaagtatacccagtgaaaatctttttctgaaatgaaagcaaaataaagtcactttcagcaaacaaaagctgagataatttaaatacagaatagcacaacattaaatattaaaggctaaaggaaaaaattacagatggaaactctgattcaacatagaaatgagaaactccaagtgcagccaagatgaaataagcccacaaagtcctgttcatcctgttctttacaaccgaaatactctggacgaaacaacaacaacaacaacaacaagaaaaacaaaaaatgactactggggactctgaaaagtaaaatcaggaacattgaggaagagagtcaaaacctgaaaaaagcaattcatatgaaggcaagtcttctgtttttacctcttttgtctgtgaactgaatgcaggcacccagaaaatctgtggtggtagcaccatggacagctaaggggcccaaagcaatcttttctttctcacccaaaggacagggaaaggaactttatgattcagtgagtgcagaggaaaatctacatttacttgttttttccttcttatctcatgatggtgacccttcagtagagccagcatagctgctgatagaaaccctcaaatagaaaccctggtagaaaccacaactttcaggataaaggactgggaaaggggtcccttcagtccaaagggtatggagggaatccccattttgtttctctttatcatctctctactttcatctgctttatcatctctctgctgtcatctctcaagggcaaccctaaatgcaggatctgtgcagcaataatacaggtaggtaaaactctaagtttaaggagaatcctaaagagagctggagaaggaaatatgctaattcgctgacggaactggccaagggcctcagctcacctgagtggcagaggtgtggacagactcaaagcagaataacaaaggctttgagaacaaagcaaaggttcaaaccacacccaactcagaccaaacaatgtaatgtacaaaatttgcaggatacaatctcaaattactcaacataaaagaaaaaaaatgactaattcttaagaggaaagatatcatatgccaataataagatcatccagatgttggaattatcaaagacgtgaaagaagctgttatgaccatgtcccataaggtgaaagtaaacactctggaaaatgaatggaaaggtagttctcatcaagaaacagaagtcattgtcaaatatgaaacatttaaactggaaactaaaatatctaaagtaaataattatatcagaatggagataacagaggaaagagtcaatcaacttgaggataggtcaatagaaattgttcaatctacagaacaaagagaaaaatttcaaaaaaagaaattagcagcgtctcaagagcatgggagatctaacaggtgtgtaatcagagtctcaggagaggaatatattggtgcaggaaaaaaaggagaaaataataattgaaaaatcccatttgatgaaagacataaacttatagactcaagagtctcaaaaaactacaaacaggataaagtcaaataaaaccatgcagagatacatcataatcaaattctgaaaaccaaaagccaagaaaaaaatattgaaagcaattacaaaaaggaacaacaatgtaatggcagattgctcatcacaaactatgaaggacacaggaacaaaatagttaaagtgtggaaagaaaggaactgtcaatgcataattctgaacctagtaaaaatatccttcaggaactaagagaatttatcgtcaatagtcttattctaatggaaatgcaaaaaaagacctctttaggctgaagggaaataataaaataggaaatattgaaacttgaggaaaagggaagagcaaaagaaatggtatatatctggatagctataaaggactatttttctatttaaaagttatttaaaacacgcatgactggcatatatatatattttatttataatacatatataaatatacaggcttagcaagtttaagagagttgtagaagattgcaaagctaacaaaagataaagaacatcatagaattcatgtcttcgagctcctaatctagtgttctcctcaccacagaacacttactttacttatctgggcttaaaagagtcctttccatgctcaccctcatgaactcacattccaatgaaaactaaataaaagataagtaggggtcaaagaaaaatataaccaatggttcaatctatcctcatttcctttggctagtttcctgatttctttaagcctgcctagatttcccttgtcctctaacttcatacctttttcataccttcctttagctttattcttactctaaggatttctgactgcctaccactgcatgcacctgttgttagtcagaaaggtaaggtgcaagaaaaaaaaaagactcttaaataaccaagggattgggtgtatcttccccaagggagatcttctctgcccactttctggaatatgtacaccacaacacaaagcgaatctgatagaatttccctgggaaaggacccaagctcagaacagccagctgaaaaattcatcacaaaatttactgaagaaaaataagctattctgaaaaatacaattaatcaaaaagcatactgaagaatgcctccaacctcctccactacctcaccaccaggccaacactccctgcttacatcttgacctgtgtgaaagagccctggtcatcacaaggttaagaaacattggccacaccctagaccacagagcaacacaatggctgtaaagaagaaggactccttgatagctttattctcagctctctccacatgatcctagacctacaaccatcctcacccacacgccttattttttatctactcccaagtagaaatgatgttcatgtgcatcttttggaggcaatggctcagctatggttcatagaaaccaccatgtacaaaatgttctgtggttcttagcctctttttttagattgagggatcttcctgaggcagcctcccactcaagtccctgggttatacgtctccagggagtctcaaagtttaactgctcttaatgtgctcaggtccattaaccagttggtaatttacatttctctccatattctccacttggcaatgaagggtgatgctgaaaatacagaaagaacacatcttcagctaattaaaataaaagagttaccagaggccagtagcccagtgcctctagacctggacagagcactctcagttaagaaacgtctgccatctgaaaatgattccgctgtaacatctctatcttgttcttcctccatcttaactttcatattttcataaagttaagccttggtttccttctgtaggaaaaaagaactggattgcgaatatgctggtggactctttgaactgaatccaaagtcaaaaggcttacgagaggacattaattcatggggaggaagtaaataccacacttcaatcctcctttccatgcatatttctgagaaagtcgccttccatggtgaaatggtagaaactactacacttataactctcttcatttcccatacatcccacctttcatctcttaggggtaagaagctagttgaatggagaacaacagcatcacaactgctgctgccaagattgccacacatggccacacatagagattacaactccagatggcaccattcagacagactaaaatgtatatggaacccctagagttgcagagtgcacagcctgcatgaccagatgctggagtgcagctgttgctattatataaaaaaacaatagtggttcatattgatgaagcactttattttgcatcaggcattgggttaaggatttgcacacatcatctaatttaatcctcatgacaacaccttgaactattactatccccatttaggaacatttaagaactattatatccctatttttctaatgataaagctgggcctcaatgatttcaaggaatttttccaagccctggctattgcccaccaaatatttgttgcatggtcttctagcaaggatactggaaattttttcacctattgacatgtcttgctctttgtaatctgcacttggagatgattcccttagtggaaagaactctgacttgaaggaaaggggaactgtggttctagtcagtatgaaagtttccaggtgtataccattttgtgctatatgacctggaaaaatatggtctggattccagttacttcatttacaaaataaagcaaacatttgtcctgcctaccataggattaataagtaataataaatgtgaacatgctttataaattgtaaagttccaaataaccataacaggacactaataatgattataaagaaaggcaaaatttcctttacaggtcagactggaaaaatttccatgttgtgaggttgccaggcagtgatcctgagtggcagggcactgagacttctgctgatcaactctcattcttttcttctcccaccttcaggccagttcctcctgattttcagcagaccaacttccttatagatattcctttctcactctgttgcccaggctgaagtgaggtggcacaatctcagctcactgaaacctccaactcccaggttcaagcaactctcctgagtagctggaactaaggcgcatgccacaatgcctggctaatttttttatttttagtagagacagggtttcaccatgttggccaggctgatctcgaactcctgacctcaagtgatctgccctcctcggcctcccaaaatgctgggattacaggcatgagccactgcggccagcctagatacccatttttattaataatcacactctcctcccatgccttacacaaaaacccctcatggaccttctttctcttttaaaaatttttgaaatgttaaattggatgtggatgaacttcatctttcaaatggcaatatagattctcaacatttaaagggatttttaagtagccagtaggagtccaccaaatctagaactgatggcatcttctcaagacacaggtcaccttttgccctgctcagtgatgctttgtcatataccctcacccatagatgtatcttagatacacaattctctggtgattgtgcctcccaaacccctggatatacagatcgcaccccagagaaataatctatgtttaattggagggcagggaagaataaattcagtaatttcaaaatatttgtcattaacaatttcttaagtgcttctcaccaacttcaaagatgtatatgcaattcttttcttttcctctaaaaacaccaatgcccaaaggctccagggtttggatcataaaaaggttctgattccttctgccattctgcatcccagctctctgtcctgttgtagcttctcaatatgtgaaaatatagaactgattaattaggaatgctgggacttgtctgacccacatctcacctgactccccactccattggaattccattccatagtcagaggaatatcaatgtcagaaaacaaggtttccctgatatccaacccgaagtttgcttctacaagtatgatccaattacttccatgggccacgctaaataactcctctccttcactgccactctctctcttcagagatttgtagattgttaccatggctttcccttcatcgccatttagcccagccatatatatttaattcttttcatctttcattgtaaatcagtcccttcaactgttaaatcagctctctgctcttctctggactagttccaattctcccaattcacctccaataactgatatcccttctgggagctccaatttcctctccatcctcctttgctctctctgcccactccagaaatgaaatgggaagggactgacagatatgggagttcaaaggtcagatatattgcattgcatacatctctaaattgctcaggcctctccatagtacatgtaaaatccaaagtcatgtatccactttcctgggtggggagggagtgcttacagggaaataggcctcctatcccatgagtcatcatcccctagccctctgcctgggtgacagcagaaacagatctcaaaacacctgtaagccaggatacaaactggagctgtgggcaacatgccagccttgcagacagacatcttttctatgatttgggctgtcctgggagaggccagaaccattaatacagtcccagaaactgcctcttcacctcttctccatgaatgggtgaatttgggatctgcctcagacttgaaatgccgatcctatttctgaattcacagtaacccacaaggaaaaaccattagcatttcatgcattataaggcctctcagacatctttctgtcctctcagacagcccaaatcacaagcaatgcaacggttttgctttctcctaactggtgctttttcatttttactattttagtcatggtcctgctcaggtttaggaagctatctttggtctgagccaaatgggctgctccaggcccctcaccacaaaacatggaagaacaatcagctcttccctcccccacaaatagccccatcagcatcattgtgtacctccagacaagacacttgggcagacacaggaagaaaataagctgagctgtgcctactttccttctgtataattgaagagcccacatcatagaagagttaaatgccttttctataaatcagagcctatataaaaataataaacccatttctccaaacatgataaatagcaaaatcaatcccagtgtcagaacctaaccttgaattttcatagggaaaatgaacggaaccataatgatacatgttgtctgaaacacagaacatggtatagcaaggtgtatctactccatggggatgtctgcaatggagactgtatctgaatgaggctggggaggcaatgataatgtgagagaggctagtcctgcatggccagctgcctaactgcagacagcatatgtcctcagagaaaggagagaccaggctgttccaagtatgatcaccacaaggcccgaagtgcttttcaataggctggctgtctctctggaggtcatggggagctcatccagttacacttagtgtcttatttgatcctatcaataatcatttgattccaatcctgctgaaaaatgcttggccaaattttcttgccttttaatggcagaatcctggctcctactgaaatcagcattgctagatgtgtcaaatgatgcataagggcttggtccagctgccaaatgtactgggccactgagggagggcttgggatgcccacaatgcttccctacagccaatagcagagaagcccttggagcacagcctttctacataaacctccccactcagcagctccaacaccttatttaagacttgagtggagtatattctttaaatgaattaagcatgtgactcttcagagacacccactgatagcttcatgcaacctacctgtttacagttggcaggttcggggctgtagaaatgagcccttttgcctgtcaccaacatctgacaacagctgatacagactgctggattctatggtcatttgataaaaggtgatggggaagctccacagatgctcagaggcatgaaactagaagataatctgcatttccagagaagtcatttttatatccattactaaaacactgggcactaaaacagaatgttgcatgtataaaccacacaaaccacaatgacattaaagcccagctgttctttacaaaaacatcttgggtggaacaacagtatcagtcttccatctcagttcactgaaggcactatcaaactcatcagtgcctcttaggatggtctatataaattccagcactaaatgaaaagggctcactttaggtgccagtgtcactaacactaatgttgaaatgtgcatccgcactctgtttttcttgggggtcacatactagtatgtattctgtgcaatgactagggaacctcagcttctgaatatccctcctgcatgagagtactcgtgtgtgtgtgtatgtgtgtgcacaagcatgcaagatacttgtagctctacaatgggcccttttcaatggtttccatccaattaatattagacattagtagccagtggagcataagaacttcatttatttctgatgatgagaatgatagaaaagaagctgggtttgcttgatggaatttgtgtaggctttttaaaagcctgatttcttttctgtgcctttcttattcatttacattgtatattttattcacaagtcttccccagttgtcttacaagaagaacatcgattcaaaaccacctggttttccagtcaaaggatactctggaaagagttagaagtaagtgcctgcacacacacacacccccaactcagtgaatatggcaagaaatgagggagtaaatgaaacagaaaaatctcattttaggagtctccagcagggagatctgcagtgaaacaagctgccagagactatcatcaagagctgctgctgcagacgttcaagctaagaatcagaggggaaaggaggagtggggaaaggtaagaaaagcaggaaaaccaacgatggtttctccctggcttcatagtgactccccaaaggaagacaatcttgacaactttccttccttcctccacacctccctcctgtcctctgttccttagtttctctggggctttcccaacaacatgtaagagaaaggatgagtcgagagtgcatagcagactgggtgggggtgggagggggagaataaataaataaagaagagacaatccctggcaatacctgcccaagccaacgtttggaatggggacagttgggtgagattcaataatatgaagagaaattctatattccctgagaaggtaccatatttcccaaatctgtgctggccaggaacaagagggagagaagggcaatagttttgacatctactactaagcttggaacctggaagtaatcggggcatttcaactgtcccggggcccaggaagaggggcgcccaattttgtctcggacagcgtataagtccagagaagaaggcgctctgccaagagtatgaaacttttcccccaacttggttgctaaagaggaaggaagacccctgaactgcgttcagggagaaaacaagaaactacggtctgattcgggaaggaggtttgcgggaggaaggagggcgatgaagcagagctgaggttttagaaagtggggtggaagtgaagattatttaatggttgcatatcaatgtgactaaaaacactaaatcccggcacactcaggcgggagctgctcaccagtcccgaagatctggaagagaaggcggggctgggaggcgcgaattgccgcggacagccttccctctctgcccacttccgacgccttcttctcgggcatcaggcggatcctcagtcgcccttcgccttggcgaatccaccaactgaacagctcgctgagattgaactggagcagccccacagccgcctccccggggggcccgacgcaaccctccaagatcgcctcctcgcccagctccagcaccaactgcttggcacgccggagcttgcgcacggagccgcccttcagcaccctggacagcgtccgggcctctgccggggctggtgaaccggcggtccaggagacccccggcgccggccccagcaacctgagcagcggggcgcagtccagagctagcgagccgcgggcctcgggcctgccagccttcagctccgaggaggatggtggcagcagtaggtcccgggcgtagacacggaagagcgagggcaccacgaagtcaactgccagactcttcctctgcaggcgcgagtagctgagtggctcccggggctgcagcggcggccccgcagctggggagcccgcgcgctggccggtccccatcccggagcccacagctgccgtggaaagcagcagcggcaggagccacaggagcccgatggctcccatcccgccggaggaggccgtttacactgctctccgggcccagcctcacccttcgctctccccgagatgggaagaggctctgaacagtccttggtacccagcggctccttccacctgatctccagaggactgtgcgtgcgcgcaagtctcttgctttcccccaactgcacggaggcgagcaggagtctaaatgaaacagacctggaagctcaggggcgagtccagagacactcaagcacactgggctcactggctgggaccttgagcctcccgctctccgcgccgagtgccgcgcccccgtctgtagctcgctgcgctcggtacagaggaactactatggttgaagggaggtggcagttgggtaccgtcctctcctgccccccgcagtcggagctggggtctgtcccctctcggggcagcctccaatctctgcaacttttaaggctgagaacggcggctcccagctgctgcacgctgtcctggccgccttttgcgttccttttggctcctccaagctcttctgcccggtctgggcgggaaccgagggcggaggctgccgtcttgcgcaccctcaagctatctctccgctgcgggaaggcttcggactgtctgcctgctgaacttctgggcgtgaatcccagcccccgcgctgcgcaagtttgcagcgtccttgctctcaccggcgcctcggctcctcagagttcgcaggcactggagcggccccggcggcagcagctgagggcgttcagggcaggggcgcccgaaatcttgccgccccctcctcacccatcatcagcgcccgcggctttgggtggccgaccagagggcggccggaaagcacctcggtgccccgcgaccctccgaacagaggcggcgggaggtaccagctgctaccaccgctgccgcccccagagccgctggatcgcatctgcctgggcgcccgccacttgcagctggctgagccgcgcgagcgcgcgcagggagggggcggggcccggagggggcggggctcacaagccaactccgcgctgctgcccgacccacgcagtccggcctcgccccgccccacccgcaccctccaaccaatggcgtggctcgatcggctcctatgcaaatctgcagaggcctcggcattcattgagaaaaggagtgagcccgccccaccctccctctgttccctctccagtctcttgttcttcccctcctctagattccctgccctatttctctgcagtgtgaaagggagcaaatgtgagaactggaagaggcctttgcaatcaagcactctccctaattatacatttaagagattaaacgggtccgacttcggaaaaacaggttccagaataaaactggaggagaggggaagggaggggggagtgggaagggaggaggaagtggggagagggtggcagcgcgacactggcaaatctgagaacagcttgtattaaggccctgagacagaatattttctgacccatctattatttgaatgcattcctgggagcttaggagtcctgccgtccacacaggagaatttgggaataggggggcagagagggatggatggtcttggtctggcagagttgttctgcagctacaacaaatacctttcagacccctgtcagtc

SEQ ID NO: 4 - DNA, 76857 bp, Homo sapiens
cgcccagttttctcatctgcaaagtgggaatgataacatttcctcttttatggagttgttgggggattagatattgcgttattcagactccatcactgagaaagcatgcaataaaaatagctgttattattttctgtcctcctgtaacatttaccatgtggtatcaggcatctttcctgataagactctgtctcccctcaagactgtgagcttgttagcaagaaagcctctatcttgttcatggttgtccttcagcatccagcacattgttgccatttgtcaaatgccttggctgggtggcaaataaataacttagtcagttactcacataggattgcatagaatttttttaagtatgacatttttgtgtatatttttagggaggagtaaaagacatatagctgtagcaagaattagaaaaaagaagatgccaacaacttttctttttaagcatcaaatccttctcattactgcccagaaaaactggcataagctgttgttaaatctgtgccccttctcctcggttgactggagtacgagttttaacattttgccattttgactttcctttctgggtcccctgggtcctctcctcccaccccctccctgggtactaagttttcatcactgtcaccacggcaacagcaaggatgcctcattcctcacagttctgcacagctaaactctggtcgcctttgtccactgagctagctgaattctttttaaatacaccactaaatcaactatctgctgtacagaacttcatccattattcaacctttaaaaaaaaacaaaaacaaaaacaaacaaaaaaacaaaagaaaaaaactgatgtatactaatttcttctcctgggaatggcctttttccagacctgccaatactcttgaatacaccatacatttttggtccctaggaacaaatataaaaattgccagtgtacgtgcgtccaatgtaagtgtggtgcaattttaaagcacgcaacagagcattcataatgggtttcccttttaaaagcacagtagaccaaaaataaacctgacaaagggcagctgtagagttttaacacgtggaaaactccacaagcagcagttatgtaacttgaaagaaacatgataaatatttcacaccattagatgaacttccaactctgacactgaaaaaaaagcaaagaacaagaacgcgagacaaatgcacctcaaatctccaaggagcaaaaagcttaaactgagaagggaccaaggctgtactaaaatctgagacctgacttccagcacgagtcttgattgcttttttttttctcgagttcgaggcggagcccgcgaaccccatctcctcagagcgccaccccctcagcttcgcccgttgggcagaattttccaaatatctccacccctaggctgaaaagccagaaagaagttttgagccaacgaggggaagaaaggagttggggcaaaacaggaggcgtttccctacccgcatacatccccgtccccgagacacccaatccccccacccccagcctgcccgcgcctcccgcccccagctcctcgccctggggacagctggcagccccgcgcggaccagacacaaagccgatcaatcccggaggcgtgggggcggagggacgacccgccggggctttcccgggcgctgctctcctcctgctgccccctcgctaggacccggcggacgcctcgtctggttttcacgccctctagcccctacccccacacccccaaaacagaacagacccccatccctgggctggaggacccgcctcttggcagccagctgagaaggcgccccggggagggggaaactgacatcccatctagagccgtccctcctcttcctcccctcccgactctctgctcctttcccgccccagaagttcaagggcccccggcctcctgcgctcctgccgccgggaccctcgacctcctcagagcagccggctgccgccccgggaagatggcgaggaggagccgccaccgcctcctcctgctgctgctgcgctacctggtggtcgccctgggctgtaagttgctcgggttcctctacccttcctgcctggaccagcctgcccccaccctccagccccccacggggcgctggctgacagtgtctgggcggctctgggccgaggtcgccgcggggcgtctgaccttgcgcccaggcgagcgggaaacccagggtgcccgcgagcggacgctgggagcaagggagcgcgaggtcgtgggtttcttgtgaattgcgtctgattttgtcagttctagatacagaaaattaagggttcccactagcaggttctcatctgtttgcaaagttggggtaagttttcagacagagggacgtgattcgaatgcaaaactcactacccactggtaagatgctaagaccccaagaaagatggcatcactgggaggcgggcgccggccacactttgagtccccggggagggggcagcgtccgcgtggtctgggctctgtagcgtcccagctgagccggcgatatgcagcgcacttgtggggcggaggtggagggaattcgtggctgctgagccagaattacttttatcctctccacctgcacatctacattcacttagagaagtctggtctggggactctagccagctgctctgtcctcaggggacatccaacgggacgattgttagaaagattcagaagccacatgatccagtagctggggagacgtcccaaagccaatttcaccggatgattttaaacaggattttcacggattctggactcatgagatttgaaatcctgggaacgttgccgttattttgttttcttcgcgttaactttttaggaaaatggaggaaattacaatagactaagcaatgcagttctacttttgctttttcttttttctctcaccttttttgttttgcttttttcccttccttccttcctcccttcctttctctttcttctttctttctctctctctttctttctgtctctctttctttcttttgtaaaatgagttattgttgctattcacgttctggtaaagtaacacttataatacttaacctgcgggacgagtgtctaataccacaatacaatgatattttctcacgccctcgctgcccaagtgatcatcgcacagctcaagtgatgtgagccacgtccctttgtggaggaggaaggtgcacattgtctcaggcaagggacatgtactgaccaatattatataaagtcaaaccagaaagccaaagtttcacaatgaaacccttgtgcaattctgaaatatcaattggtatcatatggaacacacagaagaaaaaaaatgcactcatgctaaaaggcaacagagaggtaggctggagaaatcgttaacagaacaactgagaaagttatgtattctgctgaaattctaaatttcaaatagaaaagagtgtgccttttagtgtagaattgtcactaattaaaaacagaaaatcgttctgctgtgctattcctattgaatcaccaacatagaaacaatacaccccaagtctgaaattgtagtggagaaacaaccaagaggcgaacaaaagcataaatgaatggggctgagtgacctcttcaagctttaggtaaatataacacattgtctctgctaaacttgattcctataggggatgtatttggaagtgttgtggggacttttctatattgttcctgggatactaaaagatctggcattgcaagagtgttttctttgtatgtgggtgtttttttttttatgtttaaaacaattttagaacagtttggatttaaataaaaattccaacgctagtatagagagttctcatatactccacacccagtttcccacattgttaatatcttacattagtatggtacactttattcaaatttccttcattcttacctaatgccttttctattccaggatgccatccaggctaccatattacatttagttgtcctgattccttaggttcttcttggttgtaacagtttcttaggcttcccttgctttctcttactataatgggtttgaggagttctggtcaagtatctggtagaatgactgcgaattgctgtttctctgatatttttctcataactagactggggttataggttttttggaggaagatcagaaagtggtaaggggcctaggtaaagtgacattttcatcacattatctccagggaacataccgtacacatgacttattgctgttgatgtgaacctaggtcacctgtaatcatactcctaatgtagtgcataccagttttctccacagattacctacccttttttcttcatttccatactagatttttttggaaggaagtcactacatgcaacccacacttcttcaggaaggagagttatgctccatctccttgaaggcggagtatcttcataaattatttggagctcttctgcatgggagatgggtctctcccttcccttcatttatttatttaatcatttatttttctatcagtatgggctcataaatatttgttttatactttgggttataatccaatactattttatttattaaagacttagtggatttcttatgctgttattacatattcatctttttaatattcttcccagatgtaactgtgccattcttttggccactcctatcatttataatatcatgcttactcccttctttcctttttatcctgctgtttatcagcattctttatatctttcttagtagtctggaggattgcttttttgttgttgttcttgttatttaaacgatgatgtcagtatccctgttgatatatggatatttttgtgtgtgtttagttgaattacatttttctttcccactccattaggaaaggaatttcttgatgtttgctcaccactatatgtccagtgctgagcaaagttcctggttaatagtaggtataaatatatgcctgttgattctatggtgccttagtccattcaggctgctgtaacaaaataccataaacggagtagcttataaacaacgtttatttctcacagctctggaggctgagaagttcacaatcaagataccagcaaattcagtgtcaggcaagggcccacttcctggttcatagatggagccttctcagggtgacctcccatggcggaagaagcaaggcagctctgaggtctctttgtaagcgcactgttgtcatgaccagatcacggtccaaagccttcaactcctaataccatcacattggtgattagatttcaacatatgaatgtggggggacataaaccacagcagatggaatggggatgaggtagggtaggtaaaagaagtgtatagattgaactgattgcaatataaatcatgaagctctaacttcatgttaagtaggtggagtgttagatttctctgaggcatcatttaagctgatatgtcaaaaaataataggaatgagtattccgtgtttggtggggtgttgtcatgccttttggggtctctcagagccaaggagctgatcatgaatcagttcctgattccacctaaccagtagcagctggtcctcagatctggactggaacctgatccaggcgcttagcctgagtctaatctctcatcaactgataaagattgtggtaggggagagaggtctgaatcttttgtaaaatcacaaggttctgcctttttgccagaactgacccaaaacagcactccagggaaccggtactaggaaaattctgccctctgtatctattgttaagaagcaactgccataatcaatttgctggagagaagtggttccgtgctggcacagtctcaattatctgatgaacagaaacgctaaaatgggcttgtaggtggatttaacaaccatttcaagactatgaaagaaattatattagaaagaatgaagtcaaaaacaaaaacttcagcctgagcacagtgagttccctatgactgaaaacactcatttatcctcccacatgagcagtttaatgagaggagcccacaggagcttacggatgttcaccacccatggtttccattgcattggtttcctcctgtgggccttcctcatagagaagatgtattggaatatagaggtaagagctgctagctttattgaagtcagaccaccaggaagctataaaggccattcttaaaataatattttttcatcccatagcaatatagtagtaacactgctgagtcaatactccagtatacccctcttgctagactgatgttttgaggaagatggtggtgaagatggaaaaggggaatcagaacctgggtcaggtgcctcctttggcaaaagcagcaaaataaaacttaaaaccagggattgttttcttggacggtgttactgttaacaaggctagaactcagaaaaaataacccaactgtattacttttctatttctgtgaaacacatgaccaaaaacaaaacaatacaaattgattgtcttaaacttctagaggtcagaagtctgaaacaggtctcactggcctaaaatcaaggtatcagcatgaagcattccttctggaggttctagggcagaatctgtttccatggcttttccagcttctggaggcgccccactcacggccctgtcctgccaggctgccacctgtccccactcacggccctgcgacaccaggctgccacctctcttgttctctctcttctgcttccttcttccactcatcaggacccttgtcattaccttgggcttacctgagtaactctggataatttatccatttcaaagtcagctggttagcaactttcatccatctacaactgcaattcctatttaccatgtaaagtaagatatttataggttctggggagtaggatgtggacatctttgtggggctattattctgtttctcacagcagccaaaatgaggttatgcacagcgacagtgttttcagtgctgtagccaagaatattctagattccatgaagccaccataacttttacctttaaagtataactcatagtgatataaagctggttggttttttggttttgtttgtttgtttgtttgtttgttttatttgagatggaatcttgctctgtcacccaagctggaatgcagtggcgcaatctcagctcaccacaacctccacctcctggtttcaagcaattctcctgcctcagcctcctgagtagctgggattataggctcccaccaccacgcccacctaacttttgtatttttagtagagactgggtttcgtcatgttggccaggctggtcttgatctcctgacctcagatgatctgcctgccttggcttcccaaagtgctgggattacaggcgtgagccaccgcgcctggcctaaagctatattttttattagttgtatttcaaattgcatagtatggtggtaaagaacatgcactccaatgcagcactctgtgctcttaccagctgtgtgatcttatacaggttaacacctgtattatgtcagtttactcatcagtgttggtgataatcccaataagagtgcttacctcatagaggtttagggagaattacatgtataacacacttagtaaactgaagaagccattgaagccttttgacattgaatatcagtttgatttgcattttaaagagaatgcattggatggagtatggtgaatggaaggattggggtggggggagtcaaactggggagaccagttagaagttattggagtagtccaggcaattgcttgtgtaagtacttattttatatagtttattgataaatatactcacataattacacatacacatataaccactgacaattgctttttacagttgtcacctaatgatgcgatgtgttctgagaaatgtgtcgttaggtgattttgttattgtgtgatcatagagtgtacttacagaaacctagatggtagagcctgctgcacaccaaggctatatggtgtagcctattgctcctaggctacaaacctatacagcatgttactgtactggatactgtaggcaacggtaaacagttgtaagtatttgtgtacctaaacatatctaaacatggaaaaggtacagtaaaaacagcacaaaagataaatggtacacctgtgtagaaacatatcatgagtggagcttgcaggactagaagttgctctgagtgagtcagtgagtgagtggtgagtgaatgtgaaggcctgggacattactgtatactactgtagactttatcaacactgtacacttaggctacactaaatttataaaacaataaagttcttgtgttacagcagtacgggcgttatagcatcactagatgataagaatttttcagctccattataatctgtgggaccactgatatggttcattgttgaccaaaatgtcattatgcagtgcatgactgcatttgaaatgtagttaattaaatctgatcaggaatttaagaaaaatggctctttggtttttaaggaaaaaattttttaatcatgtgtgctgtgttttcaactttctgttcagttcccaacctataaacatgaaacagtagctcttttggttactatgtataccttctttcaatgttattctctctcccacacgtaagtttattttcagtatttgtttccagtgtttccagagtttccctgagttgtcacccttagaatggtcattttacttgatttgatattcagaagagtggccttctaagttccaaagtgtgtgagtgtatgcatgcatcgggtgtggggggaaagagagagagagagaaggagagagagagagagagggaggatggatggatgtgtgctcagataaatgcctgctgacagcaacacaaaaccctactctatgaatcttcaggccagtgaatgggtaggaaatgctctccagtttgaattgttcctacattttatgagcagagaagcaaatcctgtgaaagtatttcaagagctgccctcttagctgtccattgtcttggctcagaaagtcctaaggaagaatccttgtaaacttaacagacaggaattttggtttttactggagagctctgcttttctttatcgcatgtcatcagcatcaaatttttatttgttttgttgggttttctgttttgttgtagttgtcaaaattttctactgggataatttaggacgggcttgtctttatatttgtaaggagtaaaaatgcataacctggtctgtcttctttatgctaggtttgtccaatttgcttgctttcattttgtcaatgcagtcacctgctgtttttactcttcgctttcttcacattgtgaaacttcctaaatacatactatggacaaaaccaaagataaaaatgaatgaattgttaaacacattttcttatatgtctaactaaaaataatatatgcttagggtaaattcaaacagagcagtaagtttacaaaacaagaaataagtctcctttccagccttcctgactcctttgcttctcagatagaccatccttaagtttcctgcaaatggtttcaggaaattagaaaagaaatagttccagtatatataagcatactcttataatttctttagaaataaagatcacaatttattatgcttactgctgtataccttccagaaaatcaaatcatattatatatagtgttgtgcaccttgctccaaaaagttatttatgttagtaattaaggtacaacctaaagctcagtctacaagcaggacagaagataacatcttatagaggcctttaaaattgttgcaccaaaatgcagtgggagctattttctaactagaaccaccaaaaataatggaacaaaatgattagtaaaacaaagggaaataaacttccaaaccagtaaccaaatatggaaagggaaaaattccaagcaagatccagttaaaaagtccaaaggagaacgtgtgtgcacccagagaggacagagacactagcaccagctaagattcacagacaagtgcaaaggggtgctatttttaaaggagaccaaagaggaaataatgaccacaaataaaaagggaacatgtcaaacttctgggcaagtgctaaatttgaaaagagagaatggtgtttatgttttttaaaaaatgcactagagggctgggcgctgtgactcacgcctgtaatcccagcactttgggaggccaagacgggtggatcacctgaggtcaggagtttgaaaccagcctagccaacgtggtgaaaccctgtatctactaaaagtacaaaaagtagctgggcatggtggcatgcacctgtagtcccagctactcaggaggctgaggcatgagaatcacttgaacgtgggaggcggaggttgcaatgagctgagattgtgccactgcactccagcctgggcaacacagcaagattctgtctcaaaaaaaaaaattcactagatgcattttcaaataggaatggattttgatcagaagcagaactgacacaatggaataaacaataactcaagtatgcatttgtccaataactgaaacatgcagccatctatgtcataaaacattaaaattgtacctaagcatattggagacatgagattattgtactgtccatatagtgcttttggatccagaacaagtcaggttcttttgtgccgtgtgtttgtgtgtgtgtgtgtgtgtgtgtgtgtaaacgagtgaacatctatgccattttatctagatacagtacttcttcccaacctccattcatctctgttgttgttgctattgttcctcatatggccaaatgcaatttctccctgaaggtctaactccaaaattccttgcgccttctcttaattctttccaactcatcaattcctcaaagctgatgtctactgtatattatactctggtgcttttggtatattctttattctcttatggcacttactgagctgtactgttacaatttttccatgtatatctctctgtattgtgagcttgctggaggcagagacaacacatctttaggtcgttggtacctagagtactgcctggcacatttaatacttgattaagtagaattacataagctggaatttaatgtttatttgttttgtagcttcataaaattatataactttttagcaataaaaacctcaagacatatgtaaaattaatagtctcaaatgaatgcataatattactgctcctaaaactccctcctcctctttttaacagtggcctccctaagatataaggaaatataaagactggtctgccttataggattttaagaaattttccagatttcctgatgcctccttatatcctaaaagcacataagttcctcttgaattagtaagcattgattaaaaactcagatgagtcaaacaatacacccctcaaaagttgcttaatctagactagaacaaagcacgtattagtgtgttctcacgctgctgtaaaggactgcccaagactgggtaatttacaaaggaaagaggtttaattgactctcagtttcgcatggctggggaggcctcaggaaacttacaatcatggcagaaggggaagcaaacacattcttctttacttgatggccggaagcagaagtgccgagcaaaagcggggaaagccctttataaaatcatcagatctcataagagctcattcactatcatgagaaaagaaagcatggaggtaaccacttccatgattcaattacctgccaccgtgtctctcccacaacatgtggggattatgggaactacaattcaagatgagatttgggtggcgacacaaccaaaccgtattagcatgttagttgtaaaagttctactctctggagcagggaatctccagactttcccctcatggcctaatctctttgttactcaattgatataatagcaatctatatcccataatgagcaaaagtttattaagagagatgagacaatagagactgttttagtctatttctgttgctgtaacagaacacctgagactgggtaatttataaacaaaagaggtttacttggctcccagttctggagcctgggaagttcaacattgggcagctacctctggcaaggccctcatgctacattaaagcatagtgaatggcatcacatgtggaaacacctgcaggagcagcaagcaagtatgtgcaaaagagacaaaacacaagtgatggcctcattttttaacaacctgctcttgcagttactaatctagtcccatgagaacaagaactcatttgcttctgtgagaattaacccagtcctatgagaatgggactaatatcttcgtgagggtggcagagtcttcatgacccaaacacctcttaaaggtcctaccacctctcaacaccattatactgggaactcaatttcctatacatgaattctgaggaacacatttaaaccattgtagagcctgataaagtgatcttcatttccaaatcaaagatgattttcctaggtgttcttgtccagtatttttataggttggtgcaaaagtaactgcagttttagccgttacttttaatgattttgtgggatcttgacacttgctcattagcacttaaaaaattacccctggatccaggtgagtcattgtctctgccaagaatctcattcagcattaggcaaatgccaaaatcagatacatgtaagaatctcagctccattgtgctactgccacccaggacagctatctaaagatgctggcatgttcaaaaaacactgaatcagtgatcttcaaacttttttatattacatatcctacttcatttcttaaaagaggatatgtcctgacgtgtgttttaataaattgtaatatgtatttctgtatcaacatattaatcataaaacatataatacatagaataaatatcaaatgaatgagacaatggagaattaataatacactaacggggcagaaatgaagtggttatagccctatattatagtgttctataaagcctctataagtaaaataatgtgagattggtacatgaatagacagacaagccaatggaagagtatataaagtccggaaattatgccaacttcatttagaaatcacgtgtatgtgtgtatgtgtgtgtaaaatggtagcatttgaaaccatggagaatgcttaatcaatattgttacaactgggaaccatttgagggaaaaatggatcagaacctgatattctccatgagaattaatttcaaatggatcagagatctaaatgtaaataggtaaataaataaataaaaccatacctccccccgccaaaaaaaaaaaaaaaaaaaaaacaaagtatggatctgttcttctgtaaactggactataaatcaaatgagtgtctgcatggaaaaaataaaacaccctaaacaaatccaaagataaatgactaattgggaaaggatatttgtaagttacatctctgacagagtattatcactgatataaaaggaacccctaaaaattaaaatacaaatatcaaaattttataaatggcacacaaaaaacccagagttcccagaagaaaaatttaaatggttcttcaaatatgaagcttttctcagtataacttaaaatgcaaattagattgtcccaaagatagcacttcttcccttagcaaaatcacataaactcatccacatactctgttattgaagttgtatggaaataggcattctacatactgctgatggagctgtgagatgatacaactgctatggagcagcaatatgtagaaaaattctacatctagcctttgacccatcatattcagcaatatgtagaaaaattctatatttgccctttgacccatcaaccccgttactgggaacctgtgttaaagctgtagttgcaaaaacaggacatgctttatgcatggtgttatttcttttttatgcattgtattatttatttcacaactattataaaaatgattgaaaacaaatgcccatttataggggattggctaaataaataacacaatggtaggcactgtagcgatataaaggaatgatggtgatctctctgtactgtcatctccaaaatatagtaagtgaaaaaagtaagatgcagaacaatctagtgcaacatgctacattttgtgtatgacagaaacactggcaggttaaactgttaactaatgaaactattaacaataggtagaacaggaatggaacagacttctcttactatgtatagcttattacatagatttcattttgaaattttaaatgttttatttcaaaagataaaattcactaaaatagccttccctaaaaatggaaaacaaatggaaataaatgaacttactgagctgggcatggtggtttacacttgtaatccccatactttgggaggcccaggcaggaagattgcttaagaccaggagttcaagaccagcctaggccatataggaaggccacgcctctacaaaaaagaaaaataaataaaaattagctgggcatggtggcatgcctgtagtctcagctactcacgaggctgaggtgggaggtttgcttggtcctgggagatcgaggctgtggtgagctgtgattgtgctactgcactctagcgtgggtgacagagaaagatgctgtctctaaaagaaaaaaaaagaaataaggaaatgaacctactgtatatcaaattagtgatataaccacataaaggaaataattatttcaatctgaacctaaaaacataatattccaccaaacagtagaatatatcttaaggacaaaaatagctacaaatatgttttaaactttagtactttaaaataatgattttgttattttgacactatgttatattataggaaatacaaatcagtaattatactaatgtaaatagaaattaagatttttagtgtagaaaaaagagatatatgtataaagtttttaaaaattaagtacaggtcctataatgttctatctgatttggaaatgttctatttgaattgagtttgaactcacaatgctttcctcttttcaaagctgcttttcctatctgtctactaaaaaggcccagaagacatcacagcctgtatcaatcagctttgaagaagtaacagataaccttaaaaacctcagtagtttgccaccatatgcattatatatttggcttgtattccattttggtggctccagatcagctgctgagtcttttctctacaatcttctttttccaggactcaagctgaagcaattgaccctgtttggaacagactgtccttgtggcctagggaaaagcaaaggacaaagcttagctctgtccttaacagctctaaaagcttctacttaacatgatatgtgcccattggtcaaagcacatcacgtggccaaacgtggaactgggatggagaattgtgttctgcctgctgggaggccctagaaatcatacaataataaatgagaagggagttaggagttgaggataataatataaactattctacaaccccttgaaaatgagcatacttagcatatagactataatccctaaataccattccacactaacaatgactaggaaactttggagggacacctgactccagttttaaggttaggcaatttaagatgagcctgggacggtttgttgccctggtgtattagtctgttttcacactgctataaggaactgccagaaactgggtaatttatgaagaaaagaggtttaattgactcacagttcagtgtggctggggaggcctcagaaaacttaaaatcatggtagaaggcaaaggggaagcaaggcaccttcttcacaaagtggtggcaagaaggacaatgccaagtgaagggggaagagctctttataaaaccatcagatcttgtgagaactcactatcatgagaacagcatgagagaaactgccaccatgattgttacctctatctcgtctctccctttacacgtggggatgatggggattatggggattacaattcaagatgagatttgggtagggacacaaagcctaaccatatcacttagaaagcaaggtagctatcaaagactaatgagattgtgcccaaaggacaaaggaattaacctaaaaagtctttctttagccaaactggaggcaagatgagagtcaaaagagaaaacatatactgaatgcaattgatttaaatgtgttgaatttatttcaaaatgcattaattataaagatacaaaaaagaaaatcaataaaatgtttaaaagtcatcacactttggtcaccattagaattaactaggtcagttactccttaccctgatatttggcaatcaaaataaatacttatctttattctgctttcttttaggcatgtatgtgtaaccacatagccttaacttagaaggaaaagttcttctttatagaattcaagctaatgaatgtcaaagaaaatagataatgaaaaaataatagaatctaatcatcatttgcagcatgtaattgacttagggtatgattattaatggctaaaatcattagacaaaatgttgattggagctttacaatggaaggatcagtctgttatcacctgaaacactgattaatcttagcatcattgaaagtaggacaaccagggcaggtgctgtggctcacgcctgtaatcccagcactttgggaggctgagatgggtggattacttgaggtcaggagttgagaccagcctggccaacatggtgaaaccccctctctactaaaaatacaaaaattcgccaggtgtggtggctcgtgcctgtaatctcaactacttgggaggctgagacacaagaatcgcttgaacctgggaggcagaggttgcagtgagccaagactgtaccactgcactctagcctgggcaacagagtgagactttctctcaaaaaaaaaaaaaaaaaaaaaattggaagcacatagcactccctgtgtaatattcttgcccatccctccaaaaaaagaaaatgaccttcacttgaatgaagcctctcagcaagcgaactttcattacagaaggatagatgcacaaattaaatgacaccacaaggtagcacgtgcatgaactcagaaagtgggtttttctgcagaataactgaccaggtttctgcaacaagtcagtggcatgaaaggtaaaaacaaagggggagagaggaaagagcaggtcggtgctagatgaaacacatgcatctaaaggcctaagaagcaaatgtgatgctgacatgtagtgtgtatccagattcaaataagacatcagggaaatgtggctagatattaaattataacaaggaattatttttgttagttgttcaaatggtgttatagttatatgtctttaatctttagtggtgcttgctaaagtaataaagacaattatttgatatatatgatttgctttaatattcttcaataaagtaaatgtagtaaacatgataaaatctttataactttaatctggatgatgactatatggtgtttattgtttattgtctctatttttgtatatatttgaaaattttcttaataaaaaactatttaaatccataaaatagaaaaaagatagtaacatgataaatatactgaaattctatttttttttttttttttttttgtccttgaagccctctggtcttttttgtatgctccacttttcaccctataggtttaaagagaaaataaatagaacaaagtgaatttacttgaaatatttgaaacatcagctctttttttttttttttgagacggagtctcactctgtcacacaggctggagtgcagtggcgccatctcagctcagtgcaatctctgcttcccgggctcaagcgattctcctccctcagcctcccgagtagctgggattctaggcgtctgccactacgcccagctaattttttttttttttttttttttttttttagtagagacggggtttcaccctgttggccaggctggtctcgaactcttgacctcaggtgatccgcctgccttggcctcccaaattgctgggattacaggtgtgagccaccgtgcccagtcgaaacaccagctctcttaaatcctgtgccttaaccagggtagtcagtataagaaatgcaaattatgtttgaatagtcccttttaaaaagctatttatttagtctatttcccactaatagttttttttttttaatgccttttaaaaaaagagaaaagaaaaccaattcaaccctgtcatcagctagaactgcaagatcctgggttatacagcaaagtctgttagtaaatccactgcataggagctacattttttttttaatgatgtagcgtggacctttcagtgaatttcttttgaaagggactttaatattttattccctaaaatgttaaaatactcatcagatgaatgcatgccacattcatagactgatggcaagaaaaagtgaatataaaaaaagagttgattaaattcctaaaaatttaaaatgtttgtcttgcatttgtttagtggagactggttccatcaaggtcctcttgtccacccccaggctccttctaaacaagtaaagagaatacctgcagatatcttacatttgacacatcaactcaagcacatttcaaaattggccgtagtttctaaaatattcatttaatgttaaagttcttgtcattaataacttagtatcaagcttcctgtgagttcttcatatgatttaatttctcatagttcctttagccttgaagaccccaaatctataaggattctctagagaagatgccggttatgggaaaagaatggaagaagtagaggcatttagcagccacaatagaatagcctggggcctgtgtcagcagcatatgcacactgtcattgtagccatttgtgtcagaagctatttctgtgctggacaacactttctccaaatacactatgaatttatgagcaagggaatgtagatgttaatggaggaagaagtttcacttcacctcccactcctttgcgtcttaattttagagtggaagcaagattgcatcacagccctccatgggatatatattcagagtcctaataatttgaacaatcacatattatttgcttgtacaattatatatatgttcaactatttatatttggccacaagttaccaaaatttgctgagtaatgatgagaccaatcaagaccagcctttttcattatgtgggctagaatgtttaaggagatttatttctaattattagaaaatgaaaggacaaaacattttgggagtgggctattgcaacacttcttttatagagcagttatcccacttatatgaatattgaatacaaatgtttcttttcagagaacaatggacttagatctattttttttttcttttttgggatgggatctctctctgtcacccaggctagcgtgcagtggtgcaataatagcctgtgctaatttatttatttttttgtagagatgagttctcactatgttgtccaggttggtcttgaactcctgggctcaagtgatgcttctgcctccaactcccaaagtgctgggattacaggcgtaagccactgcaaccaacctgactttcatcttttacctaaaagagtattagtcacatcttctcttacaaggtgactcatggcaggttcaaaaggacagggttggtggacagaatcaccttcactttttaaactcattaattttatgaattatatttgtaatatgtatttgccagtggtacattattgaattcataagttaaatatccatgtgaaatgtctctactagatgttcaaaggacctccttatatctaaccacaaacgtcaaattttgttcacaaagaagcaaaaagtataatataaataaaatggaactagagttccaatgggctagattgagtcagttctgcccttagtaatcatatggttttagaaaagctaccttattgtatgagtcttttttccctcatttgttaaatgaaagggtttgatttaatgattatttgtattgtttataattgaacattttatgtttttaaatgggaaaatgtaccatattttagcctgttataataaaattatgttatatgtagctaagaacatgttttaaaattctaaactgcctcctttagaattctcattggttagaacagagcctgttttggaaggaagcaagaaaataggctccaaaaatgctggatattcataaagttgactgtatagcatgttataaactttttgtttgatgcagtaggcaacaggaagttgttgaaggttttgaagagtggaataatatatcaaaaaataatattggagataaacaataattttgccccttacatatagactagacttgggaagaaagggtaactgtaaggcaggccttaggtaatgagatccaggattaaactggaggctgtcaaaatcgtttaggaaaagtagaatccagaagacattgaaaatagaaattgataaaatgcagtgattgattaaatataggggacatcaaagaaatcaaaacagtaactccaaggttgtaaacttgtagaaccagagaaatcatggtatttaattgagaaggaattatttatatatatatatttcaggaagcaataaaatagccaactaaatgtgtctctaaagaccattggagagtggatgatcatgatctgtacctatcccctgtatttaagtggtaaaatggaaagagaaatgtataaccactctgggaaaaacatggagaagattagtaggaggcaaaaaactgaactctggaaaacatacttgtgaaagaatataaaagagcagagacaatgacaaaacaagtgcccagagtaataatggacaaccaacagaaccagtgtcatggaagctggggaggaattttgcaatgtcaattgttatctagaggtcaggaagaatgaagggaaaagatcagggtgaattgttgggtaacctgaggggattaaaaagtaaagaaaaaacaaaattagcatttgaatggaactttacaattgacaaaacactttcagaggaattattttacttaattctcatgttaacattactgtgagacccacaggactatttttattcacagtgtcataaatgagaaacacgggagcttagagtacttttaggacttattccaaggcaggacttagagttacttactcaaaatcccacattctttgctatctggaagacaaggataaaaagaacatgctggaaagtaccaaccaatagtatattttcagtgtccctgtctctcaccacatataaatgccttccatattcacaactcaaatcaaattcaaagcaatattaacctgaagggtaagccataagcctgtaataaatatttcatgttctgaaaatattatttaactaaatgggagaaatatccaaaaatgaacacattccatattggaaggggtttattatccaatttagtcatcctaacaacatcacagcagatcatttaaaatgaaaatagaaaacatcctcataattttctagcctttttttttttttgctgtaagttcatattaaaagaataacattaatattgtcttaagcaaagataagtattattatacgtcatgcatttcctaaatttcaattatgtgttatttttaaaattgctatgtgtgtctgatgataggacacaaggctgtgtttttccttccttttaaaataaataaataactcttttagctgatttctttggtgccattttgtaatttcttttgtctttcactacttcccaactttagtttccataggaacaggatcaatcggaaagcatttgggattctttcaaaatgttgagtccaagatttctaattagggttcaggcacttatagtttaattaatatgagactttttctgtgttttatttttgaaggtggaaaaaactgggttatgatttcataatatgtttgccttttcaaagatttttattagagatttggatcaaagagctttaagatcatttaaaaatgtgttaatacatgcctgaaaaaattaaatatattatgcatactattcttgacagataagaagacttaaaacaataattatcccagttaaatgcatcaaaattagttgaattatccttagctgaaaattgattctttgaaatataacataaacctagtgtcttctcctatacctcttttatagtttgttgttgttgtttttctgagatggaatctcactctgtcacccagagtgcagtggtgcggatctcggctcactgcaacctctgcgtcctgggttcaagcaactctcctgcctcagccttctgagtagctgggactacaggccacccccgaccatgctcagctaatttttttgtatttttagtagagacggggtttcactatgttggccaggctggtctcaaactcctgacctcaagtgatccgcccacctcagcctcccaaagcctgggattacaggcctgagccactgcacccagcccctcttatagttttattgtgagaacaagtatggtcaatggaaaataatgtagatgatagattttacttttaaaaaattaccattatggtcacattacgttagctgtataagacaaaaacatcctcagtttataaaaaaagcattcaactttctattaacagagagtgtgctcaaggaattaaatcaggaattatcaacaggaaggggattacttcccccagggggtactgtgaaattttatgggacctattccattgtcacaatgatgagtggttgctatatatttgctgagcagggaccaggcctcttaaacagcttgctgtgtgccagacagtcctgcaaaataaagaattttcctgagtccctcatttttcataactctccaaagtcctgctgcatgttcatataagtgaaaacttcataattatctgagcttatactgtaacttacactgttttacctataaacacaaatattcttttggacagtcttatcatataactaaatatacaaatttgtattctaatgctcacaataaccatatatatatatatatatatatattttttttttttttttttttttttttttttgagacagagtctcaccctgttgcccaggctggagtgtgatggcacagtctcagctcactgcaacctccacctcctgggttcaagtgattctcctgcctcagcctcctgagtagctgggattatagaaacttgccaccacgcccagctaatttttgtacttttagtagagacaggagtttcaccatgttggccagcctggaacccctgaccttaggtgatccgcccacctcggcctcccagaatgctgggattacaggcgtgagccactgcgtctggccaataaccctattcttatattcctgtactatttggaatggtttctgattttacttaaatcccatttaacattataagtgtacaccaggcatggtggctaatgcctgtaataccagcactttgggaggtggagacagaggatctcttgaggccaagagtttgagactagctggactgggcaacatggcaagattccatctctatgagagtaaacatttaagaaaatttgctaggcatggtggtgcatgcctatagtcctagctacttggaaggctgaagcaggaggatcccttgagcccagaggttcagtgttacagtgagctataatcatgccaccgcacaccagcctgggtgacagagcaagacattatctctaaaaaaagaaaaataaataaaaataagtgtagacttcattgtgtcttctagtgtactcacgtataagcatttatgaattaaaatatgtatttttttatttctctttaacattaaagggacattacattatttcccaaattttacatatatataaattttatgtatataaattatatgtttgtatatgtaatgtttattatctataaatttcatttcaggataataaaggaggcatcaaaatttattataaaatgagggtctgatagtgttaagaaccaataaattaaaataaatgaatgcaaattacatgtatttcatcactgcactaaattcttaggtttgtggtggttgaaaacaaaattatatactctatttttagggaaacagtttttccctttccaagattcatttttagctaacatgagcaaaaaatttaaatgggagaaaaatgttaaaaaataattgcagaacatgctgcagaataaccgtggatatgtatagatgtgggtgtgtttcattaaaatctatttaagtattttttttcctttatatgtagttaaggtaaggatagtttttgagttattcggtgtcaaaattacttttggatttttgtgcaaacaggctataaacctgtaacattatcaaaaatgtcaacatatagataaaacttaatacttttttttattttatttatatattttgagaagatgtctcactcctgtcaccccagctggagtgcagtgatacaataaaattcactgcagcctcaacctccttggctcaagccatccctcccacctcagcctcccgagtagctgagactataggctcatgccaccatgcctggctagtttttgtttttgttgtgtagagacagggtcttgctatgttgcccaagccactcttgaagccctgggctcaaacagtcctccagcctcagcctcccagagtgctaggattacaggcgtgagcactgtgaccggccttatttttatattttatttttttgagacatggtcccactctgtcacccaggctagagtgcagtgacgtgatcatagctcactgtagcctcaacctcctgggcttaagtgatcctcctgtctcagcctcttgagtatctgggataggaggtgtgagccaccgcacctggctatacttagtttttaatttaactggtattgtctgttggtctcatagcctaagtattgcaatacattaaacaatagacagttaatactatatttaagtatattttatattatatgtaaatatagcttatactattcttaaaatacagtacaagaagtttatacatttgatttgaagacaaaatatgtccacttttgtttataacagacatttaattacttcctattgtgggttaagtatgatgtagacacaatcttgtatcaaatagttccaacatcatgctcctaacactatccaatgggaggatcagacatgtaaaacatcctaattttttaaaagtcttataaaaagtactatgtcagatagagaaggtttgactctgtatgggaggacagaaggggccagcgaaagctttacttttcttgacagttaagtcaggtgttaaataacatagaagttcatcattcggcaggggagtgttggagagaggggattccaggcagagggcttggagaatgcagagagccagagtgtctgggaactccaccatgggtgccttgaacatagggtttgtaaggggcagtagtcaaaggaaggctggaaagatgggagcctgttccgaaaggccatttgaaggaacctggaattcatcttgaaggtaacaggaggcctctgaaggaagctaaatatcagatagtattttaaggctctaacccatgtaagagtaaggaggatgaactgcaaacttgtccacatctatattcatccttgtcaatttccctcctgaatcaaaggaagagggttgctatggtttgaatatttgttcccttcaagactcatgttgaaacataatccctaatgtagcagtattaagaggtagggcctttaagaagtgatcgattcatgaggactctgccttcatgaatggattaacccattcatagattaacaatttaaggaattaatgagttatcataggagcgggactggtggctttataaggaaaggaagagagaactgagctagcactcttgcacactgagcccgctcaccctgtgatgccctgtaccacctagggactcttcagagagtccccaccagcaagaagaccctcatcagatgtgacccctctaccttggacttctcagccttcataactgtaagaaataaattccttttctttataaattaccccatttcaggtattccattatcagcaacagaaaacagatgaagataaggggtctctcctacccaaagctaatttcacacctgtgtgcatgatcctatttttccagtctcttgtattctttgttgcagcaattaatctcctctctctgtcatgtatcttcaacttatcttcattactagttctcttaccacaggctataaatatgctcaaatctctacaacttaatgtaggaaagaaccccactatgattctccaaggaaacttcttgaaacagtgacatatatttattatgtcaattttcttactgaccattcagctcactgcacattgcctgtttcccatgccattgaaattactatcattgtatcgccaataatttactagttcctaagtccatggcttgctttatttatttattttttattttacttatttattttttttttgagacagagtctttctctgtttcccaggcgggagtgcagtggcgtgatctcggctcaccacaacctccacttcctgagttcaagtgattgtcctgcctcagcctcccgagtagctggggctataggcgcacgccatcatgcccagctaatttttgtattttttgtagagatggggtttcactgtgttggccaggctggtctcgacctcctggccttgtgatctgcccacctcggcctcccaaagtgctgggattacaggcgtcagccactgcgcccagcccatggcttgctttttaagtcaaaaccttacttgacctttctagaacatcgaacattgttgacactccctctttgaaagtctgccattccgtgatttccatgacatcattctgtcctagtttctcttatttctccaattgcctcttctcaatctcttacatggtttcctcttggactttttctctcttattctactccagtgtttcctgctctaaattatattcctccctagagagtcacagtgctccttagcatgttagaggctccaataagtccttttatacaatggagaactttgtttaacttgttaacccagtctttctcaacccagtgtttctttatcaccatggaatctgtatccctttgtgaaacactaaatgtcaatggccagtctgagggagaagatgcaggaaaagaacgtgaaagaagagaatagtgtcacaatagccacaaaatgtgacaaatcataaaatgctacttaatttcatcaacatagattgaagagaaaagttctatgggttgtctagagtgttgcctagggctttaacaggaaaacttcctagaggtggtgagacttaagaggggtcttgagggttggagaaaattgtaatagggaggagacagcactcccacccatgcctgtacctcctctctgagtgagggctgtacaagggataagaaaggctacatgaacatctcctttgtccttgacatgcctctgaagatggtattaaggtttaaaggcaagtgcttgattatgtaaggttgttttagatcagcattctcagaacaaaatagactatggaacactttttaaaagactgtattgccagacctccaaaggaactcctaaggtacaatgctcactagttttaagtaggcactcaaattaatttaccactataattcattatgatgcttgtattagggttgtccagacaagtagaaccaacaagacatgtgtgtatgtgtgtgcatgtatgtacatatatgtatataaagagacttgttttaaggaattggttcatgtgattatggaggcaagcaagctacagacccaggaattgccaaggctgcagttcaagtccaaaggctatctgctggcagaattccctcctgcttgagagaagtcagtcttttgttcaatttaggccttcaattgaccggatgagacccaccaacattacggagggcaacatgctttaccgatttaaatgttaatctcacgccacacacagtggctcacgtctgtaatcccagcactttgggaggccgaggcgggtggattacttgaggtcaggagttcgagagcagcttggcaaacatggcaaaatcccatctctactaaaatgcaaaaatgagccaggcgtggtggtgcatgcctgtggttccagctactcgggaggctgaggcaggagaatcgcttgaacccaggaggctgaggttgcagtttgctgagattgcgccattgcactccagcccgggtgatagagtgagacaccatctcaaaaataataataataataaaatgttaatctcatccaacaacaccctcacagaaacatccagaatgtttgaccacatatctgagcatcattgcctagccaagttgacaggtaaaattaactatcacaatgctattttcaattgtatatcaacattttaaaaaagcaaataattttaaaaaattgctcaccttgtgttattaaatttagaatgctttattaagcttattttgattttatagtaatagagatttttaaaaattacattgttacggcttttattattattattattattattatttgagaaggagtcttgctcagtcacccatgctggagtgcaatggcgcgatctctgctcactgcaacctctgcctcccgggttcaagctattctcctgcctcagcctcctgagtcgctgggattacaggcacccgccaccacacccggctaagttttgtatttttagtagagacagggtttcgccatgttggccaggctatttttttatttttttgagacaaggtcttgctctgtctcccaggctggaatgcagtggcgagatcacagctcactgcagccttgacctcttgggctcgagtgatcctcccacctcatcctcctgaggagctgggacaacaggagcacataccatgcccagctaacttgtttattttttgtaaagataggatctcactgtgttgcccagactggtctcaaactcctcaagtgatcctcccacctccatctctcaaatgctgggattacaggcatgagccattgcacctggtagttgtggcttttaaaatctccttttaagttactatctagaaaaatattttaggaattgactctatcattttaagcatcaaatatattcatgtaattttttgttgcagcataatgtgaaaattgtttctgcacagtaatgtcttttgtgtcagaattggctacttcaaaatcttttgttctttaatcccgggcagttatctcttaattaaaaaaattaaagtggtatattcattatatcatagtctccccttatccacagttttcctttttgcaattttacccgtggccaaccacagtcgaaaaatactaaatgaaaagttcaagaaataaacaattcacctgggatgggaatcatccctttgtctggtgtattcatgctgtagaagctacccacctgttagtcactgatattgcctgttcctgtcatccaatcagtgacatcgttgtggctgaatgattcgggatcacttgaagcagatgattctccttctgatgtattgtcagaaggtcaatagtagcctaatgctacctcacgatgcctgttacccacctcattttatctcatcacgtcggcattttatctcttacattattacaagaagggtgaatacagtagaataagatattttgagagagacgtcattcacataattcttattcagcatattgttataattgttctattattcttgttattaatcttgtactgtgcctaacttataaattaaactttatcataagtatgtttgtatagggaaaaacagagtgtatatagggtttggtactatccatggcttcagacatccactgggggtcttggaacgtatctctcatgaattaggggggactagtgtgttccattccatcttctccataattcacttcacttccattcattcagcaaatatttactgagtaccatatggcaagcattgttcttcgcccttgggattattaacaaaaattagtagccaaaataaagggccccaccttcagtacataaacacatatataatgcattagaagataataatgctattttcaattgtatatcgtttgaaaatatgaaaaaagaaaaagaaaagcaggatcaaaggaatcaggaatgtcgaaggggaaaggtgagctgaaggtgagctgaaatatttaatagagagatcagaggagattttattaaggaggtgtcctttgagcaaagacttgaagaagtgagggagttaatagacatctaaaggaagagtctttcagatggaggaaacagccagagtctggcctgattgaggatgaacaaggaagccagtgtccctggagcagagggagggaagagtcaagaaaaggaggttcgaaagcaatgggccactttgcataggaccttctatgccaatgaaagaacttccccttctactctggggaaatgaagaaccagtccaaggttttgagcagaagagtgccatgatctgacttagcattttaaagggtcactctagtggatgtgttgagattagattccagaaaggcaggacagaagcaggacagtcaggaggctattgtagcaatccaagaaagagatgttagtgctcagaccacagtagtagctatgggaggagtgagaagtggtcagattcggaatgcattttgaaggtaaagtcagtaggttttgctaatgaataggaatgggctgtgatacgtgggatcactaaagataaatgccagatttttctcaaccagagcaatggaataattgagttgccatcatctgaggtggagaaggtggaacaggtttagaaagaaagatgatatttggatgtagagtttgaaatgtctcataaactttcaggtgataggcatttggatctgaagttcagcaaagatgtccagaatggaaatatgtatttgggagtgtttagcatgtcagagtgtttaatgccaggaatctggatcacatcattaaagaaggaaatacagatagagaagtagatttgaccaaggatgggagccatgagaagaaaaactaggaaagtgtgttgtcctggacgttaagtgtagaaagcgtgttaagaagaagggtgtgatggattgtgtcaattgaggtagttatggaaggcatcatcataaattatgttttacagaggacgagacacagccaaagaggttttaactatccaaaacatatcatagcaaggacaaaaaaggaggaagaatttaaacccagggcttttccactgtaatgaaatagtcattacctttaaaaaggtaggggaggccaggtgtggtggcttacacctataatcccagcattttgggaggctgaagcaagcagatcacttgagcccacaagtttgagaccagcttgggcaacacggtgaaaccccatttctacaaaaaatagaaaaattagccagacatgttggctaacagctgtggtccagctactcggaaggctgaggtgggggatcacctgagcccggggaggttgaggctgcagtgacccatgattgcgcgcctgcactccagcctgggcaacagagtgaaaccctgtctcaaaaaaaagaaaaaaaagaaaaaaagaaaaaaaaagaagatgggggaaaagtataaccctaacaattcatttttcatagaacatcctcatacgcgattattgtagaatcatttgtgaaatgttctatctgcgtcaccacattggataaaaagcaatgtgaagtgaggggagagggatgagaagcaagtatttatagagaatctactgtgtgccaagaggtaggctaagcaattatgtacatgattttatttcatctttacaaccagctagggaaggcattactagcttcattttacttaaactgaggctgtagcttatccaaggtgacgtggctagtaattcacagcactgggtttcaaatactgggttatgacttcctaaagacagaatgattctgtttccatctataatgaagactaagacttaagttgcatttctctaatagactactcttttcttaccttgctagactctaatgttgtcttttatttaattttagatgatacttactcaaaaagccaagctgctgaaaataatagtggtagaatacaatttagttctttatcccaatgggggtaaagtcagttctgataccaccttattaagactaagtgctaagattatgtgctaaggctgactctaaataatttcaaaacttttggtagattctgtcataaatccagttctcttcatgctatgacaaacatcaaacagccatttcacttgagttatattacgacaattagacttttgcctaccatatctggacacaaatacctttgttcttctttccaatactcaatttgaaagagtttcaaaaatttgaccttggctgcgcatggtggctcatgcttataatcccagcactttgggaggccgaggtaggtaggtcccttgagcccagagtttcgagaccagcctgggcaacgtaaagagaccctgtctctacaaaaaacacaaaaattagccaggcatggtggtatgtgcccacagtcccagctactcaggattgctgaggtgcagtgatcgctggagccccgggagatcaaggctgcagtgaactatgatcacgccactgcactccagcctgggtggcagagcaagaccctgtgtcaaaatttaaaaaaaaaaaaattgacctttatccaatagcacaaaaactcatttcctgaccattctaggaagcagctccaaaggtcccactgattttaatgtgtgcagatattcactaaattatttattttattggtctagttcactgatcctaaaaaagtgcgtgttggtgttagctcacagttggatgtgtaggactagttttgaactaaaaaagtcagagaactgtttttaccaaaagaaaagggaaattgtggttcctggatttacaggacccaagaaatcagggtagctaattcttaggaatcttgcctgacaattgtgaatatgacagttaagcaatgccaaaccattgtttccatgttctgcacttcaaaataaatggttcttgttttttggcttcctgaggactaatcaaaggaagcatgaagcaacaatggctgggaagtttcccttggttttcaaatttcttctgtaagcacttgtggtaatagaatttaattaataacacttgtatgtaatgtaagggccaagattttatgagtcatcttccagcaggaaagttgaaaaataaaattcacacagctctcatattttaagaaatgaagtttgatagaaagtgtgcatgctaaatcattggccatataaaatctctagtattttaaaggctgaatatcagatcatggtccgtggagaccatttctttctcccagctttgtgggtggtaaaatcgagaaagcttagtaaactcattaataagtagaagcccaaaattatgtggagtgggatattagttccctgtgtaagaaaaataatacaaaaaaatgcttattcttgcaaattttacaaaatgtgcatgcattgctaagccttccccacccaccctcacttgggccttggtaagtactcttgtaagggttggtcccaaaacttaagccttattaaactcatggtcaacctgtatccctttatgtgcctatttattatatacaacctattttagaaaaagattatctttttctttattttttttttctttgagacagagtcttgctctgtcacccaggctggagtgcagtggcacaatctcagcccactgcaacctccacctcccaggttcaagtgagtctcctgcctcagcctcctgagttgctaggactacaggcgtgcaccaccacacctggctaattttttgtatttttttagtagagatggggtttcaccatgttggccaggctggtctcgaactcctgacctcaagcaatctgctggccttggcctctcaaagtgctgggattacaggcatgagccactgcgcccagcagaaaaggattctctttgtttgagaaatgctaagataacctcatttgcagattatacatttaacagattggtgatattagagaatccttttgatctctttttatgctaatctctgccaaacacattaaactgttagtgattgtggaaattcactcagtaaagcagagaagtaaaactacaaagatataaaggaagtttgaaacaataccaaacatctacgtagcgtgggaggtggagagagtttagtagatggtagtgatgtatcttgtcacatacattgtttaagcagctatttttctttttctttctttctttttttttttgttgaggtggggtcttgctgtgttgcccaagcttgtctcaaactcctgggctcaagcaatactcccaaatcagcctcccaagtaactgggattacaggtgcatgccaccacatccaggtggtttagtaagtaacaaatacctgtggaataattatttctctatccctgacccaaacagcccctgagaaatctgggtgtgtatcagctgttagggtgttttgtgcagagatgcacagattctcacagaatttcagaaccagagttcaaatccaggttcagagactcagttttaaccacttgcccagagctgatcaaactctggagaaatgatttacaatacctaatcttaaaaatgatttatttgacaagtaaatgagtaagtatatttctagtgagaaatagaactgccaaatgctggcagtggttctgtacttttaatctttaaaagctgtatctaggtctaggagttaggtaactacaatttcagattaaagagcaatgaataatcctaatttatatagctctcaaagtctgatgcaccatctctgctgtagaggtgcgcctatacacaacgcagaccatgtctcattagtaaggagggcacccaggcttgttgttctttctctctttgccattacgccaagtgtctgttttgatgtctgacatctttcatattcttctactatccactaatgaagtgttagggccatcgttttgttttctggtaacttactcttaaggagaagcaattagaacacagaatggccaataaccatggcttccactgagtatgtggctcttattagcatccattttggaaggggtatttccttattttgtcttgatagtctactagatttgaattgactgttgccgtctatctaaaatctatagttaatgtcacaggtaaatgaattgtgtttggctgagattgtcacttggggaaaatcaaagactacagaatcctaaaatggcttcttcatgtctgatgaggagtgcctggtgagacattcagccactgatggttttcctgtaccactggctaccattacacaattgaacatgtgcaggacaattttttttgaaatttttgggaatttattttacttcgagaagttaatttaattacttcatctctttctaatatcactgaaaaattttaatctagttgtttgtgcaatggaatgccctggaagttttcctgaacttagtaatgcatgtaacttatatgaaaataactttatcctcaattctgaatcatcagtagtccctcttatacttaagttgtcgaagaaccagaaaagggagagggcataaaacttttgtgcataaatatacacggtttattcaaattagttcattcaccataaacgtttactcattaacactgtctctgttaagatggaaatttgtagtatactctctgaataatatctttacaaccctaaaggttgaaaatggctatgaagccattacagtgtgtctggcggtcttatgtctggagctactttctcataatgccttgtactgatttgagggcagggagagaggaaaggggactgtggagcagactaagcagatggacatcttggcttccctgctttctaaaacactgtgacctccagcaacttatttaactactctcaattgtcatatctcttgatatggtttggctgtgtccccacccaaatctcatcttgaattgtagctcctgtaattcccacatgctgtgggagggacctggtgggagataagtgaatcatgagggcagtttcccccatactgttttcattgtagtgaataagtctcacgcgatctgatggttttataaggggtttccccttttgcttggctctcattctctcttgactgccgccatgtaagatgtgccttttgccttccaccataattgtgaggcctccccagccacatggaactgtgagtccattaaacctctttcctttataagttacgcagtcttggccaggtgcagtggctcacgcctataatccaagcactttgggaggcctaggtaggtggatcacctgaagtcaggagttcgagaccagcctggccaacatcatgaaaccccatctctactaaaaaatacaaacattagccaggtgtggtggcacgtgcctgtgatcccagctactcaggaggctggggcatgagaatcacttgaacctgggaggtggaggttgcagtgagctgagatcgtgctactacactctaccctcggtgacagagcgagactctgcctcaaaaaataaaataaaataaaaaataaaaaataaataaattgcccagtctcagcagtgtgagaacagactaatatatctgtcaaatgaggattttagtgcagtggagtcatttcttacttagaagttaggttcttaaggggagaatttattcatagtgaaaattatccttaaattcctaagatgatcataaactgaccaggacatcagccaccagtaactctaaagtcaagtgtgtcttttctttctccttgcattttggtgtggcttccctttctctgaaaataggataccaatgtctcattaagaggaagggccagattgtctagttcgagagactgtaaagacatgtgtctgcctctttttctttctcccctactctctaaatctagtatggttagacgataatgagatagatgaccataatatctagctccaaattagttcctacctcattgggttactttctattaatatacatatttatccataataaatactgggtggcattattttatttgtcaatgccaaccctgtgcaactttttatatttgttagtatatgtgctaatctgttctcccactgctataaataaataaatacctgaaactgtgtaatttataaagacaagaggttgaactggctcacggttctgcaggctgtacaggaagcatagtggcttctgcttctggggaggcctcaggaagcttccaatcatggaggaaggcgaagggggcacaggcgtctcacatggtgtgacaggcatctcacatggtgtgagctagagcaagagagaaagtggggaggtgctacacactttttggccaggcgcggtggcttacacctgtaatcctagcactttgagaaactgaggtgggcagatcacttgagaccagcagtttgagaccaccctggccaacatggtgaaaccccatctccactattagtacaaaaattcacaggacatggtggctcatgcttgtagtcccagctactcgggaggccgaagcacgaaaaccagttgagcccgggaagcagaggttgcagtgagccaagatggcgccattgcactctagccttggtgacagagggaaactctgtctcagaaaaagaaagagagagaggagagagagagaaagagagagagagaggaaggaggggaaggaaggaaggaaggagggaaggaaggaaggaaggaaggaaagaaggaaggaaggagggagggagggagggaaggagggaaagaagggaggaagggaggaagggctacacacttttaaacaaccagatctcaggagagctcgctcactatcatgacaacagttccaaggggattgtgttaagccattcatgagaaactgctcccatgatcccatcaccccccaccagcccgacttccagcattaggaattacaactgaacatgagatttgggtgggacacagatctaaaccatatcagtataataattgtctttcagtaactatcaaaaccacatggccataaatttttatttttatgaaacttatgatataactgatatccatactttttataatttgcttttatacatgataatgtgatactatacatttaaaacaaacaaaaaacttcaggccgggtgcagtggctcacgtctgtaatcctaccactttgagaggccaaggtgggcagatcacttgaggtcaggagtttgagaccagcctggccaacatggtgaaaccccgtctctactaaaaatacaaaaattagccaggtgtggtggcacatgcctgtagtcccagctacttgggaggctgaggcaggagaatcacttgaacccaggaggtagaggttgcagtaagccaagatcacgccactgcactccagcctgggtgacacagagagactcgtctcaaaaaaaaaaaaaaaaagaaaaagaaaaaaaaaaaacaacttatgtaacacttctccagtttttcctagtcatgttttcaattaaaagtgttaatttaaataacacctttatagtaattttaaaattgtcataatataaagtatatattcttagtcaaaccagactatcttagatgagtaatagagaatacaaaaacttttgtttttaaagttgggaggaaaagaaacacaaaaggtttcatttgactgggaattatttgacttggagttgttagcagttatgaaaataatcatctcttcaccttattttatgaacttctgccagtgcttttggaacatgttcataactgttaaagatgttctgaggctaactttaagacaattgttgacctcaaccagcaggcctacatgaccattttcttttgtttattttcctatttaatttgttctggaaaagtgaagaaaaaataaaaatcacttcaagaatgcagccaacaggggctatacctaacatctgctagtgatatgctgatataaaatccaacattttgtttttataaaaagagttattaggtacaagttttgtaaaaaggaactctaagactagaaaggctaaaacaaggtagaaatcttataaatttttttaatttaaagattcagagctttctgttcaaataagttccacataagtgaccatacattttaaatatttttacttaatttgttggtaaaccctgaagtaaatagaattagaggaagaaaggtagctagaaggagaagatacttaaaatcacaaaaataggtacaatgtatgtttggatgacggctacactaaaagcccagacttcaccactacacaatatacccatgtaacaaaattgcacttgtgccccttaaatttatacacacaaaaagaaaaaaaaaaggaaataaatattcagctactaagaaatactaccgataattaatttattaaagctaattccctttataattttttgcctacataattttgccaattcaactaatcctcttttttaacatctgtgatacatcgtttttctgttcaaatattaatatacacataaaaaatgtacaagggaattaacaaaattcctgaagctaacagctgttatttttcacagaaattttatagtaatttttgacaatttaagaaatgtttcttaaaggaaattttaacaagtagaaaactgtaattgagaaagagaaaatgattttctttctcaatgattcctgaaacccagttcctaaatcttataatctcagagtgtactaaagtttgcctgaaatgaaggaaggccagaacctactgaagaaaataaacattctcagtaggcagtgtgatgtttgaaaagttcaaaggtatgatgatacagagggaacaaagattatctttccctattttgccccgaggttttcctcgactggttttcagggaatttgagtcttcattgttttctctaaaaagtgtaataaaatatttcagaaatcacaagaattgtcagtcataagtagagtttctccgagggcattaattcacacagtgttaaaggagacaaacagactttttcaaagtatactttgaaagtttcacagaacaatggtttggcattggaatcactggcaaaaatgttcagagattttgtcatcaaaaataggagtaggccaggcgcggtggcactttggcaggccgaggcaggtggatcacttgaggtcaggagtttgagaacagccatggtgaaaccctgtctctactaaaaatacaaaaattagccgggtgtggtgacgcatgcctgtaatcccagctactcaggaggctgaggcatgagaatcatttgaactcaggaggtggaggttgcagtgagccgagattgcaccattgcactccagcctgggcaatagagcgagactcagtctcaaaaatttaaaaaataaaaaataaataaaagtaggagtaaagcaacaaggtaggtcccgtcttccctacctcactgaagaggattctggcttggtctcctgtctcattccttcctctgctctctgaagattcagactctatctttggagtctataacatgtgggaagcagaagagaagctaggaaataaaggaatgcaggagaagaaagggatatgggggaagagaaaagaaagaacagctgctatgtgatcaaagtgtgtggaaaaggatatttaaaaagattgcatggacccctttcatggttcttgaaatatacaagcaaaagagttcttttgaaatgactccctggtggacttgacacctctctaagattgagccacatgggtcactgctttctacagacatatttacagctgtcaatagaaaggatcagttcagtcctgtactcttcacatagacaccacgtttgccagtttccctattgaatatgtttgccatttagagctattgaacctgcatatcactggttttcctgttatactagaaatctagtaatttgtgtcccacagacttttgcaaattaaaaaaatatatattttgagtcactgtgttgcccagtctggagtgcagtggtgcgatcatagctcactgcagcttcaaacgcctgtgctcaagtgatcctcctgcctcagcctcccaagtagctgggactacaggcaggtgctaccacacccagataatttttaaaaattttttgtagagatgggggatgttactatgttgcccaggctggtcttaaactcctggcctcaagtgatcctccttccttggcctctcaaagtagttctgcaaattttaacttcacaattagatttgctgtccaggcttttaagggaaaaaagaaattctccagaatagcgtgtgctccttaagagtgataaaatctagcacaatggaagactaatttacatgttgatatatagagatgaataaatcaaagaagagttgtcatgtcatatgaaagatttctctctcctttccaggagtataatcaattctctttcatagttacacaattctgattttatacaaacttttcaaaatcctagaattcatggttctttgccattctttatagtctattggtttattcctgttcctggttgttcaaactggtctaagtctagagcaatggttctcaaccaggagtgatttctttacacccatctctcaggggacatttactatttagggacatttttagttgtcatcacttgggggcatggtgataccggcatctagtgggtagaagccagggatactgcaaaacatcctacagtgcacaggacagccccctacaacaaagaatgattgagtgccagatatcactagtgtcaagatgaagaaaccctcacctagacctcccctctggggttacgttggtgtcctactttcctagatcagcctcttagcttccaccttccttttgtgcttcagagccagtcttttgccttcattctaaccaccaatttctcaaactctcctgtcttcattagaccaatgaaactttccacctggaatctttgttaatctgcaatccttgctagtgttcagcttgcggggatcacggtgtgggcctagtatagcacagtaattaactatgtgggcttcaggtactgactgagtccaaagccaaatgccaccgcttacttcttctatgatcatggccatgtttcttactctctttgtgcctcagttttcccaccctcaaaaatgtgagtacaaatggtaccctgccacagagaattgtaagagtcaaatgagttaatacttgtaaagcgccaagtgcttaataaatgttagctattattatcctttctcaagggtccatcaaggtccttgtcctctaagttacttccttctctgtactctaagtctggaaagcaggtgtaatttactcatgatggtttctcttaaatgtttgcctaaattgtgaatgttttccattaatctaatggctaggacttttgatgtggaaaggcagaacataccctatttttctctctcaggtttggctgtccatatctcttccctgagcactttgtggcataaaggtgagagatgggaaagagatggaaggaaaaatacttcagaacattttcatggatgactcacaattcttagtctgcagatggaagctgatgaatgaagggatgagaggatgggtgcatcatgggcagcacctaagtttctggtgtgagtggccacatggaatgtgatgctttacatagagatgggatttgtaaaaataagacaaagtttgggggcaagctgatcagttttgcctatgagtttgtggtaattgtgggaaatggaaatacagatgtccagcagaaagctgggcttacaaatttaatttcaagagacagattggagctggagatgtggagttatgactttttagcaaataaatgctagttgggtcaatgagagtacaaaatactccataaaaaggaggtagtttagtcagaaaagcagtttctggatggatggatggatggatggatgacgatcgatggatggatggatggatgggcagaacaaggaggaggaagaagaactcacaaagcagacagaatgaagcaccaggatcagaacagaaggatgaagactaggagagaatcaagttacagaatacaagggagtcaacagagtcacatgtcatagagaggtcaggtaagatacagactgaaaagtgtccgttagatatgccaacagataggtcattttcgtcttggtgaaaacagggtcagtagaccacaggaagacagagaacagatggtagcatgagtggagaaatagcatttcaagtaaactatagaaatatatagtcgagaaataaccttctttagattttcatgataggcttaattcattcttacatcatgtataattttttgggtgaataacgaaggacagcagttggattgttttgcctaaattgtctacttgagatgaccaatgtatttgttctcactctgctaataaagacatacccgagactgggtacttcataaaggaaagaggtttaattgactcacagttcagcatggctggggaggcctcaggaaacttacaatcgtggcagaaggggaagcaaatacatcctttttcacatggcagcagcaaggagaagtgcagagtgaaggtggggaaaagccccttataaaaccatcagatctcgtgagaactcactcactgtcacgagaacagcatggttcaattacctcccaccaggttcctcccacaacacatggggattatggaaactacagttcaagatgagatttgagtggggacacagccaaaccatatcaaccaacaataatgctttgcattattctgagtttgaaacaattaataccaatccaatattgtatacttacaatactttccccaaagaattgcttgcctggccgggcacagtggctcacgcctgtaatcccagcactttgggaggctgaggtgggtggatcaggaggtcaggagatccagaccatcctggccaacatggtgaaaccctgtctgtactaaaaatacaaaaaattagccgggcgtcgtggcgggcgcctgtagtcccagctactcccaaggctgaggcaggagaatggcgtgaacccgggaggcggagctggtagtgagctgagattgtgccactgcactccagcctgggtgacagagcgagactccgtctcaaaaaaaagaaaaaaagaattgcttgccttcaggaactcttccttagtatcagtttgatccgacctcatttactggacttttctcattagtatacaataaggaatgggctcatttattcaacaaacatttattgtgtcttgctttatgccaggcactgttctgagtgtttgcgttaatttcagagactataacaggcgacagacttgcacttgtagcatttatattttagatatgtatacttataggaaagtatttaaattatttttaaacgtggtcattacactggagtatagaatgacatccataaagaaagtgatgtagatcaaagacggaattagaaagttatattgatactttctgatactttcttctttagtactaataatgcctaccacaccaggttattttgaatattgaattttacagcataaaagcaagtatgtgaaggtgaaatgggagagttccctgatccccctcgcaggacgtgcgacaggggtgtggctcacctgttctgtagccaccgctgcttgaatccctgaggggaggggcagcatgcagacagacagctgcaggagcccatgtgggtgtgtgttacaatgtgcccttttagccttgccatccacagatggcctgagtgttaaccagctaaacggaccctctgccttttcgcatgggccgagggccagtgtgacagctttctgtatcctgagctcttgcccagcatcccagaaaaatcgggtcacacacggggttgaaggatgaatgcagggttttattgagtggtggaggtagctttcagcaggatggatggggagctggaagaagggatggagtgggaagatggtcttttcctggagtttggccatccagaggccgaatacttctctgaccacccccagtcgaactcctctcggtgttcagacgtctctcctcatctatctttctttgccctgttgttccgccatttgtctgcttgtctcctcatctcctcgcctgctcatctgcttctagaacctgggatttggggtttatataggtacaggacaggggcatggtgggacaaaaggcaacttttggggcatgaaaacaggaatgcctgtcccctttgagggtcacgggtctccaggcctgagggtggggcctttgccagggaactgccttcttctacccagtacttcctgtctcctatctgtatcaaaggtgcctttttaaatgaaaatttctgtgttagtttaagggagtgataataagcaacagcagcgtcatgtaactattagatcacagtagtggtagccaccacagtcagttacttcagtctatagaccggctctcaaaaatcattgaaatgttttggggaaaaaaataaagatgttctgcttgaatttttcatcataatttcatatacagcttatatacatttattatatatatatacaaatttcatcaaaagtatgtaaaatgactcatttctatatgacatgggtattgtcaaggataaattcataaagctatttatacttttaaataagcctaaagagaattagcttttatttgtggggcaataccgtgtgacactagattgcatattaagctgaattaaggatgtaagttatttttcaatgatcgggctggcaggagtgtgttgtctggggtggggtccaaatagatgcatggattctactttggaaaatgcttaaaggccaaagctacaatctagaaaataaacatgtatagtttcatttgctttttcctattttgatcctttaaaactatgtgttatgaattgggtaaacttgtcaccaaactttaggacagttttcttgactattgcatcccattcagacatttgaaaatgaacttttgtataattttaattatcctatctgttttaatctttcagatcataaggcctatgggttttctgccccaaaagaccaacaagtagtcacagcagtagagtaccaaggtacagtatcttactgattttcacaggctgtattgtttaaataactcacgagagtgactcgtgtgatgttattttctatttgttgggattctctgccttaccttctactaattcctctgcctgaaatgctgcttcatgctgactccacctcaagaacatttactccacctcctcagtggaaattttcgatattcaataaaagaccggatgtgcaaagaaggtctcctataacttaaattatctgcacaaagcaaatctaatttgtgaaactgggagatggagagcttggaaagtttctagccagctagatatgatacatagaaatgaacacttcaaactccactctgtgtatttaaggtgatgttaatatagcttactttggggtaccatgttcttatctattttagcttcttaaaaatgtttataaggaggagttaatttaagagcataaagtttctgttttgcaagataaaatagttctggagattgttatatgcacaacaatatacttaatactactgaactatacagttaaaaatggtcaagatggtgaattttacgtttattttgccacagttaaaaaattgtcaaaagaaactagtaacctatatatgggctttttaataagctttcattgttgttgttgttgttttgttttgctttattttgtttgagataggatctccatctgtcacccacactggagtgcagtgtggcatgatctcggctcaccgcaacctctacctccggggtcaagtgatcctcccacctcagccacccaagattacaggcacaggccaccatgtctggctaattttttgtatttttttgtagaaacagggtttcaccacattgcccaagctggtcttgtactcctgggctcaagcagtctgcccaccttggcctcccaaactgctgggattacaagcatgaacaaccacacctgccctataagtttatttcaaatattgatcacctactacttttccaaaggatcctttatcttttatacaattaataatattgggcaatcagaagaattactatttcttaaatttaatacttgtttaggccagagcttattaacatttaagaaacagatcctaaatgtctgatctctcatcatcaggtatgtcttaggttcctggagctggagaaagataggtttgaaggaaagagacaaagattgaagtaaaggcctggagtggggggaattaaatgagttaatatttacatagtgctttcaatagtgcctaacacataatatgaattatgtgtgcttgttaagtaaaaatatgctgtagtaagaatcagtcctggctgggagtggtggctcatgcctgtaatctcaaactcctgaggccaggagtttgagataagcctggaaaacatgaagaccctgtttctacaaaaaaacaaacaaattagacagacatgtggtgcacacctgttgtcccagctactcaggaggctgaggcaggtggatggatcacttgagtgcaggagtttgaggctgcagtgagccatgaccatgccagtgcactccagcctggacaacaaagagagagaatgtctcaaaaaaaaaaaaaaaaaaaaaaaagttcatcattttaaaaaatgagtaatttaataacaaattacttaaaaaattattaggttaactaagttctcttaagttctaacattttatatgcttaagctatagaacactctggtatgagttagttttaaacggagagaggtgggaagaggaaattaacgattgagggaatttgggactatggagcacctccaggatggataaacagggctgggtgagatgccagaatggaagctggaaaggccacaagggtgagcacagagtgcgagaggggtaaatggaccaggatgtccctgagggaccaaggaagtgaagttcagttccacttctcactttcttggaggttcttaatgctgggtccaactgggtgcagtggatgtatatcctctcccatcatatctgagttaggacatcaaaattatattctttaaccttacattattttttaaaaaatgtatcaaggtgaatttcacataacctgagatttgtagtttttaagtgaacaattcagtggcatttgacacattcacagttttgtgcaaccaccacctctacctagttccaaaatgttttcatcactccaaaacaaaaccctgtacccatctgcattactttttaatgcatgttttatttttaatatagaaaatccttccataatgtattgcaagcaaatgttaatctcactccaaaataagtgttttctattttcttgtttcatctcacctctttttaattaagaatttcattttaattctattgtatatgtgtctccatcattccagttttggctcttcataaggcataaatacatttctgtttcttctacattttagtcttaggactagatgcagtaacttaattttgccgtaagtctataatattttatgatttgtgtatatgtgtatgtgtgtttcaccctatttgttcatttgttatgccttgtttctctgaggtcaagaaattatgaattaattccttctttccagcgctgctgtgctgtatcacttcccatgatagtgccaagagcagaaggagactgaaatcagggcagctctgccaggcttgtaaattacatgagcagccctctgcaaagggagtctaaacctgaaagctataaattagagtttaatagcaagcatttcttcacagaagtaatttctgctaagtcagagctattttggtagtatcaattctctttttgtgttatgtatgattttgatgatttttaacttgagccctgagaatgaaatcaaaggataattagcagtacagaatccaggaaaattaaaattcataatgattctatctatgcgattcctaaatgtgattattttgccacatgttgttgctaatgctttttataaacaaagaattctcttttcttgatctaaaggaaatagatattttggcaatgaaataatccccttaatagaaaagacttggcatattttcctgtttttaatatgccttaggttgagaaaatataatttatatctatattttttgctatctcctacagagataacattttatttcaaattggagtgatttataggtaaatttgtgatggtataaagtatatatttctacgtcaaggcaagcttgcaactataactaagagaaattcttcaagggtgaaaacaataatgaccatttacagagcacatactatatgtaaggtggtgccatgtgcatcacacatgtaaatatagtgtctctttaatcttagtgacaactttgtaagatgagtactgttctttttatcattttacagatgtggatataatgttcaaaaaaagtaattctcccaatatcacatacggagtatatggtagaggtctaactctgaagcctctgctataagctaccatgttatagcgcaataaccctaaagcctgatacagaaaattatgctggcataagtactgaattttggctgaagagagagaagagaattcatgagagttaggttgtaagttcatttacttccttatcctcagatattgaccccatgattccagtatttttattctctgcatttgtttcttatggctgccattacaaaatactacaaaccaggtgacttaaaacaatagaaatttattctctcatggttctggaggctagaagttcaaaatcaaggcattagtacccaagggcctaggcactggctctttccttgcttgggatcttctttctcaaagaaccatataatgaattctctccctcttttaaacctttggtcaaatatcaccttctaaataaggtgaactctggctactgtttttcaaaaattgtagccctgtccctagcacttgcaaaccccctgtactctgctctgctctcttttgtcttcataaccctcatcaactgctaacgtactaagtaattcactttattatgtttcttgtttatctgacttcccctgttaaattgtaagatcccaaagggcaaggatctttgtttcgttcactgatacagctcaagaacaatgcatggcagacagtaagtactcaacctattttggatgaattggataaaccatttctcgacattttacatggccagcgagagagaggctggagtgaagtcactggacttaggaaaattattgctatattttctagtataagtttcatagaggtttttccacagcgcaataaggacagaaattaggaagaattcaccaggaggggtgtgtgtgtgtgtgtgtgtgtgtgtgtatgtgtgtgtacacgcgcccacacgcacgcacacacacatgcgtatctaaatatgtaaaacaatgcaattatttaagtgtaaaattactcttaagacacagaagacatgaggaataggctaaaaatgagtgtgggtgtgtgtttaattgttggaaactcacaaaataccggaaggaaacctatctacaactcaagactccggaaggtcaccacccattctccttaatcaacagaaaagaactgtgtttcctcagacaggtcccttagcacacgtttgtctttgtagcataattgtaaacatgtctgtaaaatgatgtctctttgtaatgtaaaacctgctttaaaaactttagacattcttgaaaacaacttttggttcttttcttccttgcctttcttttctctgccctactttctattttccattaccttttattccatttttgtatgtccagcaatatgtgtggaatgaaaaaaattagaaactaaatattctgcattcttttttaacattcatttgcttaacattaaaatcaaaggtatgaaaaggattttaaaataatttctggtcaaagatactgtgcttttttaggtcaaaccatatgccttgtggggaaaaaagtatttcagaaacatggaattgacattctagagagcctggttaaaaaaatacttttaaaaatatttataactggaggtttccatttggcaacttgaggcagttcccagactggcactgggttttttgtttttttttttttctctcagacatctcgtttggacagtgaaaagaagggggttcctttggaggctccaagtattaatgacacaattgcagtaaatttcttgtaataaaagaacttagctacattgaggcagttacacttgatgctaagatttaatactttaataattatctggactgaggcaaggttatataggcagttgtttgggggtaaaaatcaatgatttattaggagaccatattggataggtattaatgtatttgtagagaaggttgacaaagaagggatctgagtgagaatatagcatgttgtggaaacttttctgagtttcccagcatgtccctggctggattcagtgcctttcttgggtactaagcatgaatcaccatctgcatagctggtattcagcaacactgggctgaaacgccattatcttagttgcctcttctaccagatggtagactccttcaagactgacactgggaataataagacacatagttaatcatagctgccatttgttaagtccttactatgtccaagcctgtgtgctttgcatatcttattgcatttgaagactcacaacaactctgtgaaatactagcccatttacagatgaaaactcaaacttgataaccagggaaataagcacagtgtcatacagttactatgtggaagagctagaaggcttccaattcatgggacctgttgatgtaatttatgaatgaatgaatgaataaaactataaaggagtaatttaaagttgtttacaattttgttacctagttaagtaaaatataaattcatggggacaattagaaaacaagtatttttattgttgttcctagaggctattttagcctgcaaaaccccaaagaagactgtttcctccagattagagtggaagaaactgggtcggagtgtctcctttgtctactatcaacagactcttcaaggtaagcagctgtaggcttgaagaggtgtgagcaagagaatgccaagtacaaccaggatcctttaattggcaaatgagatcggacatgactgattactgaaaatgtgtttttgtaagtgtgagatgaaagcaaccatgtctgagacataaaacacaatagccacaaaagcagagaacagagggaggtgaagcccactgaatccctggactcttctctctcaactcaggcataaagtatgcaaaatgcaattgctcttattggctcagtagattaaactccgttccttccttcctttctcttctttctttctttctctttatttctttctttctcttccttccttccttccttccctttcttgcctttctttcttttttcaagattttgttctcttgcccagtctggagcacagtggtatgatcatggctcactgcagcctccacctccagggctcaagttatcctcccatctcagtccccaagtaggtgggactacaggtgcacaccagtatgctcagctaatttaattttatttatttatttatttttttgtagagatgaggtgaggtctccctatgttgcccaggctggtcttgaactcctgggctcaacccatcctcctgcctcggtctccaaaagtactggaattacaggtgtgagccacttgcctggctatagataaactcctgagggaaaggaattaaaaaatggtgtggtttggaaatggaaggttgcttctcagtcataatgctgtcaccctatttccttaactccatttgaaaggtaggccaccactgagaagctcagggagttaagacttatgggtgggttatgacagcaaccattatcaagtgctttcttttcttttttttcttttgttatacatttctttctactacctactcttgccattgaatatgtgatgaacttataatttaaaatattgataatgatggatgaactgttataatgtccatttgcttcaaaataaaccagtggttaatgatacagatgaaacaagataaaccatgcattgattactattatagctggtcaatgatacattgaggtacaattcacttcactttctaatgttgtgtatgcttgaatctttccattataaatatttctaaagctggaaatacaattttacaagttaaaataaacatgttatgattttaaaatactatgtatttctttaatgttaaagaattaagtgaaaatgtttgaagtttatagaaaatttaaaatatctgctcaagttcttatctgtcaagataagactactagctgtaaggtgttaatagcacagctgtcttcacttgaattttttgtagttgccatttctggcatatgcagaaatgcaaaactattattttatgcaacactatttatttgagccattgtacctgcctaatttttacatttttttaaagagatgagatctggccatgttccaaggctggcctcaatcttctgtcctcaagcaatcttcccactcagccttccaattggctgggactacaggtgcaagccaccacaccgggtgcaaaacactattttaattctgaatatgttactatcaaaaaataaaataatgtttttaaccatcttttcttgtgccgcagtgttacgtgagccaccacacataaagttactgttccagtcaattaaaccagactccctggttttctgaagacatgaatatttttacaagggaactagaaagggaatgaggcaagcatttgagctcaattctttaaaatataacatggggctgggcacagtggctcatgtctgtaatcccagcactttgggaagccaaggcatgcggatcacttgaggccaggagttcgagaccagcctggccaacatggtgaaatcccgtctctactaaaaatacgaaaattagccagtgtggtggtgcatatctgtaatcccagatgcttgggaggctgaggcatgagaatggcttgcagtaagccaagatcacgccactgcactccagcctgggcaacagagcaagactgtctcaaaaaaaaaaaaaaaatttacatacataatgtggaagggcctcagtggccaggcctgctggcagctgctcctcacagggcccatgctagagctgacagcctgccagggagctgggcactcggagatggggtgggagcactggggtcagccagagatcaaacacgtcagtgaaggcccagagcagctcggaagataaaataacagtccactttataaaccaacagtgaaacattaacaaacaaaggaaaagttgatgactctttgctagatgttgtggttgaaaataatgtagatattgatgggtttgttgcatggcagggaaccttggcttgctctgtcacctcatttttgaaaagcacatatttgagaagttagacacaatcactgacaaggagattgacatgcttgatctggcatatggactgacagacaggtcagagttgtattgccaaatctgtttgacaaaatctatgggccatatgactgtctgagtacctgatggagtggccagtgccagacaatccactgatatgggcaagaccacctaagcagaataaatagcaatgctttcactaaattttacctattttataattatttcttaatataattaaataaaaacatacatgaatgaacttattattatgaccaactttactgttttaattcaccttgtataactactgaattttatagttctgaaaatacgcaatttttatatttgttacattagaaaaaggtcagttaaatattagaaaataattaatatgacaataccttacaaattttgccttacgtttgtttagcaacttttagcaaaatgttttcacatggccttatgtctgcttacctagaaagtaaattttttaaaaaagatattattatccctgttttatgtgagtgaaggcaaagacctaaaatggcttgttaagggccatccaactaattagaaaatatgtacacacctgcatcttgttactataaggtatatgttagactgaaactggagaaattatgactatcttacagcagcaattagatctgactgcatatggacaaaaacattaattgctcagtgaactgcttaactgacagttattaaccttacacataaagatttcaaaattttgattcagtgagaagtataaggttgaacataggcattacaacactgccaaaaaagttagccagtaaactaaaattagatatcaaaatgaaataaaatatgagaatataaaactatgcttttttgaatttttttttttttttgagactgagtttctctctgtcgcccaggttggagtgcagtgacacaatctcggctcactgcagcctccgcctcctgggttcaagcaattctcctgcctcagactccccagtagctgggattacaggcgcccgccaccacacccagctaattttttgtatttttagtagagacagggtttcaccatgttggccaggctggtcttgaactcctgacttagtgatctaccggcctcggcctcccaaagtgctgggattacaggcgtgagccatcatgcctggccttttgaacattttaaaaactgtcctttccaaaagaaaaattttaaataacagcatctatatacaacttttaggctttaaacttgagtttattaaaagggaaataaatgctttggttactaaatgaactgattagaggaaggtattacacagaaagctacttggattattactaacatcaatgtcttctttttctaaaaggtgattttaaaaatcgagctgagatgatagatttcaatatccggatcaaaaatgtgacaagaagtgatgcggggaaatatcgttgtgaagttagtgccccatctgagcaaggccaaaacctggaagaggatacagtcactctggaagtattaggtgatgtgcatgtatgtgtgtgactacgtctcccactccttctccaccacccagccctgggggcaagcaagcactggtccataaacatgccagcatcaactgggagcctcaaccagtcaagttacagagaccataagcatcaccttcctggcaatctcctggccatttctccccctctcctcattggctgctgaaattttagtaatgcgttatcacaaagtatctctttgttaaaggtggaggcaattcctaatgatcctacaatatacataggagtatctttcctgagagtttatttttcaatagttttcagcatatacacagtttctccaaccatttaaagtagtatcacatgagatggtggagaagcaataacacacaaaaaagtagactgaaggtaggattagaagtcatttggtaaataaaggaaattgacattgattatatacctgatatgttagcccttttcacataagtaattttacttcatcttcattaatatgatttttatagatgaccaaatggaagttaaatgatttaacaaggccatacagctagaaagtgtctggactaagatttgaatccagatggggttaactccaaaaccagtatgtttagtttctataagaatcatggatagattaggcacaggggcttatgcctctaatcccaccactttgggaggttgaagtgagaggatcccttgaggtcagggagattgagaccagcctgggcagcatagtgagtcccctatatcgctctctctaaaaaaaaataaataaaaagccatttgtgttgttatgcacctgtagtctcagctacttgggaggctgaggctggaggattacttgagcccaggagttcaaggctgcaatgagctatgattgtgccactgcattttaacctgggagacagcaggactttctcaaaaaaaaaaaaaataaaaagaatcactgatagtaacagctcaagatggtagtttgtggaggaacacgatctcttctctttcattggtggtgtataatctaccaagttacaagactaaaacagctccccttcctttttctttcttttttttttttttagtatttattgatcattcttgggtgtttctcgcagagggggatttggcagggtcataggacaatagtggagggaaggtcagcagataaacaagtgaacaagggtctttggttttcctaggcagaggaccctgcggccttccgcagtgtttgtgtccctgggtacttgagattagggagtggtgatgactcttaaggagcatgctgccttcaagcatctgtttaacaaagcacatcttgcaccgcccttaatccatttaaccctgagtggacacagcacacgtttcagagagcacggggttgggggtaatgttatagattaacagcatcccaaggcagaagaatttttcttagtacagaacaaaatggagtctcctatgtctactttctacacagacacagcaacaatctgatttctctatcttttccccacatttcccccttttctattcgacaaaaccgccatcgtcatcatggcccgttctcaatgagctgttgggtacacctcccagacggggcggccgcggggcagaggggctcctcacttcccagacagggcggccgggcagaggggccccccacctcccggacggggcggcggccgggcagaggcgcccccccacctccctcccggatggggcggcggcagggcggagatgctcctcacttcccagacggggcggggcggctgccgggcggaggggctcctcactttccagatggggcggctgccaggcggaggggctcctcacttctcagacggggtggccgggcagagacgctcctcacctcccagacggggtcgcggccgggcagaggcgctcctcacatcccagaccgggcggcggggcagaggcgcttcccacatctcagaagatgggcggccgggaagaggcgctcctcacttcccagactgggcagccaggcagaggggctcctcacatcccagacgatgggtggccaggcagagacgctcctcacttcccagacggggtggcggccaggcagaggctgcaatctcggcactttgggaggccaaggcaggcggctgggaggtggaggttgtagcgagccgagatcacgccactgcactccagcctgggcaacactgagcactgagtgaacgagactccgtctgcaatcccggcacctcgggaggccgaggctggcagatcactcgcggttaggagctggagaccagcctggccaacatagcgaaaccccgtctccaccaaaaaaatacgaaaaccagtcaggcgtggcggcgcgcgcctgcaatcccaggcgctcggcaggctgaggcaggagaatcaggcagggaggttgcagtgagccgagatggcagcagtacagtccagcttccgctcggcatcagagggagaccgtggggagacggagacagagagggagggagagggaggaggagggggagagggagagggagcccccttcctttttcatgttgttcatgctccttctgaaatactagtgatgcactagtataggagaaatttaaatcagaaaaccttgcagcagatccggccagtttattcattttctagtgttacataacaactaaatagttctgtagagcggaagtccaacaagaagactgggtatctgcccaaagtatcacaaggctgaaataaaggtgttgacaaggctgagttctcatccacaggctacgaggaaaatctgtttccaggctcattcttggtgttgccagattttggttccttgtggttgtaggaccgagaggtctctgttccatgctggctatcagttcgtgggccacactcaactcctagaggccaccacattccctgttacatggtcccttccatcttcaatgaaagaaaagcatatcaaattcttgtacttcatttttgttgttgttttgagacaaaattttgctctgtcttccagatcacggcttactacaacctcaaactccttggcttaagtgattctcccatctcagcctcccatctcagctgagacaacaggcacacacctattttttttttttttttttgtagagacatgatctcactatgtttcccaggctggtctcaaactcccgtcctcaagagatcctcctgccttggcctccaaaaatgctgggattacaggcataagccactacacctagccttctccttgtgccttgaatatctgacttttccttctgtaatcagccagagaaaactctctgcttttaaaggttcatgtgattaggtcaaacccattcatgaaatcatcctatcttagagacaatggttttggggccttagttacatttccaaaatctttctactacagtacctagattagtgtttgattgaataactggaaaaaaagtgtatttataccaaggactgcaatcttgggagaccaccttagaattctgcagtagaaatactgcaatcttgggagactaccttagaatacagccagttctgggttttgctggataataaataggtcacctaatgaagtttggtttactttccagtccctgagaccagaataacactaatacctggaccaggtattttctaacttggccagttctagacagaatgggatttatagttgagtactgggcctgaaaaaaatactcaggtttggctgggcgtggtggctcatgcctataatcccagcactgtgggaggccaaagcaggaggattgcttaagcctaggagttcaagactagcctgggcaacatagtgagaccctgtctatacaaaaacagttttaaaaattagctggtcgtggtggctcgagcctatattccagctactggggaggttgaggtggaaggatcaatgggttgagctcgggaggttgaggctacagtaaaccatgatcacgccactgtactccagcctgggttatagagtgagattctgtctcaaaaaaaaaaaatctatctgcacacacacacacacacacacacactctctctctcgctctctctcacacacacacattctctctctctctccctctctctccctctctctcattaggcttcttttaaatataagtggtaataaaccaattgaagaaaacagtagagatcgtttatctaataaagaatagctgttgtataagctaaagtaatgcttattattataacagataagcccttaactctcagtgagttgcttaatagtaagttcctttctcacttaagtaaagcctaaatagttgggacagtggtggaggagccatattactttatttcatgaaatcattagagactcaacctaatcttctgacatcttcaatatatgacgttccaaggtcaccattgttgttgacacctacttggtagttgcagggggtggaggatacgaatgaacatgtgggaggtttttaattagtctggcccagaaatgggatatatcactttttcccacattccattggccagaactcatgtatatgaccccatctggcaacaagagtgctgggaaacatggtcgactgtgtgcccatgaagaaagaagatgggtttgttggacaagtaagcagtctctatcacagggtccagtaatcacacctctttacctggctattaaaaccattgattgtagagacaaagtcaacagctttgaagaaaataaacaaccttgattagcttataaataatcaatatcatttgacttccattgttcagtggctccagcagttccatcatgtgaagtaccctcttctgctctgagtggaactgtggtagagctacgatgtcaagacaaagaagggaatccagctcctgaatacacatggtttaaggatggcatccgtttgctagaaaatcccagacttggctcccaaagcaccaacagctcatacacaatgaatacaaaaactggaactctggtaaggtcatttcaagatttgacttgataactgtcttgcatttggataaaaaaattattagaacttaagatgacgtttaatagagagctgataccattgcttgctaagtggagagaggcaggggcaccaggaaagatggcagcacttgtaccacgaagtgatggaaagagctactacaggacatgggaacagaaaacagagactgagggagctgactgtgcaaggaccagtaaaagagcaaaggggcaaaggctcctgaaacaaaggagcaaaggctgtgtgtttatcttttcagaatttaaaaagattctagaattgataatcctataaatgataccaattaagattttcgtagaccctaagctacttcctggtagtaactctggctctttaaaggaaatgtttattatttgctgctgcagtgaactcacttgtgacttaggaaagtgcattaacccttttaccagggaggccttcatttatataggtggtgtttcctaggaattagaaatacctagactactgagtactaccatgtgctataaactttaaaaattgcgcggccgggcgcagtggctcacgcctgtaatcccagcactttgggaggccgaggtgggcggatcacgaggtcaggagatcaagaccatcctggctaacacggtgaaaccccgtctctactaaaaatacaaaagacttagccgggcgtggtggcgggcgcctgtagtcccagctactcgggaggctgaggcaggagaatggcgtgaacccgggaggcggagcttgcagtgagcagagatcgcgccactgcgctccagcctgggtgacagagccaggctccgtctcaaaaaaaaaaaaaaaaaaaaaaaaaaaaaaaaatgcatgctgccttcttaagtaacagtgccccaaagcccactaagcctgattcatgatgatgaatcaggcagttatctacagctgtcttctggcctggaaaattactaagtgcagtctcaatttacaacatcaggaaaatgcatgaaaacttgcttggggataccctgaccatgtgaaaatagtaactgtagtcaatcatggtaggattcctatatcattaaatatttccatgactgtagatcaacaacagttgactctgtgactttagtatctattactttagagtccagatattctgtttcctccagtaaaatattcttattgaaagactttctaggaatactgatgacaatctataagcaagctctgtgaagctaattacatttaaaaataaaaagtattttactttttcatctttgattataggaatagaagtggaagtttaaaaaagggtcattaagcttgaagctttttaaaaaaaattcagtcaatgtaatattctatgtcagtttaaaattgtctgccttccagcaacgcagaatcactatgacagcgattatcaaaaaaaaaaacttaaaggcgtggtgataataacaattttaataatttttaaaaatgtttttgagacagagtcttgctctattgccccggctggagtgcattgacgcagtcttggctcactgcaacctctgcctcctaggttcaagtaattctcctgcctcagcctccagagtagctgggactacaggcacctgccaccatgcctagcaaatttttgtatttttagtagagacggggtttctccatgttggccaggctggtcttgaactcctgacctcaagtgatcgctcgcctgggcctccaaaagtgctgggattacagctgtgagccaccgtacccagccaattttaatgaattttgaaaggaggatataatgcttcattcctttcatctacaagtgcacagtaacatttacaaacagatcttctgataaacaagaaagcaaattgctaaagtggctgaataataaagcctattggatgcagttacttcttaagctctggcctctcagcagtcagcaggcgcagtcagcaggtctgagtgattttacactgagcaactgggcagaaaaacctgctgtcacactttgctatatttacttttcaaatttattttttctcagggcagttggtaaaagccccaaggcaagtctgaaaggatacagattcactttcctcagctaacctcaacccttgaaatagcttgtgatgtcaaaggaatgcacctggattgaactaagataggttcttatgtgagaaatgaacaacaaagactccagtgtatggaagccaatgacttccttttaattaccagctataatatgctggaagatcattttgggttttagtctaacatattatttatatgtaaccttggccatgagttcatggtgaatattctaaaagcattctggctttgaggagagtgacagatgattccatagagtggaaaaaaagaaaaacaggaaaactttctctccctccatctaggaggatctaagacaatgacccttcaaggtgaccaggattacactccctttcttccctccctccagccctttcttctttccttccttcctttctccctctctccctccctctcttccttcctttctccctccctccctccctctcttctttcttttctcctcttcttcctttttgtctgccttcattccttccaaatatcctccaaggggataaaaactactgataaaaataacgaagtctattatatcaatcttagcttttggttgctttgacagggatgggaaggagcaagggctggcttttcttttcaaatttaaaaaaattctagagttgatagaatcgacaatcctataaaccgataccaattaagattttcctaggccctaagctacttcctggtagtaactggctctttaaaggaagtgtttattgttggctgctgcagtgaactcgcttgtgacttaggaaagtgcattaacccttttaccagggaggcctgcccttcatttataaatgatgtttcctaggaattagaaatacctacactacttaatactaccatgtgttatgaactttaaaaaacactcattgccttcctaacagtactgctttcatggttaaaaaaaaaaaaaggaacttctctgtatgtattttatctttgttcttctcgtcaaattaagcaaaagtctagcttaaactccttgaagtcatggcagatttttaaattcatagtaaagacagaaagtcccaaatttttaaaaaggaaagacaaacttaatgctaaaatttgagggacagggttatttaaaaagtctacttatagatctatggcttaaaaaaatatatttttgcatccacaaatagcaatttaatactgtttccaaactggacactggagaatattcctgtgaagcccgcaattctgttggatatcgcaggtgtcctgggaaacgaatgcaagtaggtaagcatgaaatattgggaggaacaaatggtttgcaattcgactgtgaagtacagcagttgggggtacaaggagcaaggagcaggaaatgtctgagtgacttgaagaataaacaggagagaatgactaaaattaacttgatatgatgtgttgcaaagaagcaaagatgctgtttttaagccatctcccaaataagccaaaaatacttagtattgtatttaacaactttttttagttttttaaataatcgtttttaaaatacattcttctaagtagtctttctctcaaataaaagctaagtatcttgtagtctaaattgttgaaggtccagaagtttgaatttctgatatttttaaaattcaggaatgtatatcattgatattattcaccaaattaattcaggtgttgacatttatagtcaacgtagcacttatttaagtaatcagaaagtatccctttcaatgctgctttgaaattatcatttaaaaaaattcatcacaacatgtttaaaaattaaggcattgttttctttgtttcctttattcacatacgtccccatgggttttttttgttgttgttttgtttttgtttttgcttttttgagacagggtctttgtctgttgcccaggctggagtgcagtgtcgtgatctcggctcactgcaacctctgcctcccaggttcatgcaattctcctgcctcagcctcccaagtagctgggattacaggcatgcccaccgcacccagctaattttggtatttttagtagagacagggtttcaccgtgttggtcaggctgctctcgaactcctgacctcaggtgatccgcccaccttggcctcccaaagtgctgggattacaggtgtgagccaccgtacccggcctgtcctcatggtttttaccattaccttgtcctaccagcactatttctgtttatttttccttccatttaaatggtcctgtttaatttaaacatctacctttgccttctcttaaggaatcatatccaggaagtcatggttttgatgtattagttactttttcttagcacacaataaatacataacgaataaaatttaaatgtttgtttctccactaggaccactttaatttgaacatgattctcacatatctactctaagtacaagttagcttaaaagttaaaattagtttgtttaacggtcatccattgatccgaggtgttttgtgtccttggttgggacttacatcttttgaaatacatacaaattcataaattcatttttttggttttctttgtgaattataactatattcacatgtaaccaaaattagaatatgttaactgtcctaaagaaattttttcaaagtgcagcaagtaaagcatggatttgttggttgtttatggctgcctcactataaaactccagcagactccacccacactgggcctttcagcagtttagttccttttctttcagtaaaaaaaatggtaccttccttttataaagacttttttttcaaaaaaaaaaaaacacaaaatattttcatacttaatgttacattttctcttcactgaggcataatatggctgtatgacttgctcaacatcacagaaaatggtgaacaggatgtaagaagttaacttactccttatctattactcttctgtctcccatttcactgaagaaaaataacataaaattcatactacaacttagcacttacagaacaagacaattttttgtcagtagtttcttttagggtgaatccttccttcatagatgtcaaattcattgacaaactacaagacagttttttttttttgtcagataatagcccttactttgaatgcttcatagatgtcagatttaatgactactacaaagtaaatagaaggtacactttggttctcaggaatttcacttactgatttgactttgcctaagattatgattactgtagatttttttctctctctgctctttttaatccaagtaaataaaaagctgaatcttattgacctctcaatacccaagcaaactgagtttataccaagcaataattaatgttttctactctggtcaaattacttaacctttcaaaagacttatcaagttttcttttttaaaaaaatcaattaatattttggaggtatttaagaaaattaataacacacttggcattaggaaagaatttcgagaccagaagtttttatgataagcagattcacttaaacagtatctctaaaaagatcatttccaaaatgtacattgctttaaaatatttaaattatttttgagaaaatgctatgtaatattttctctaggttatttaatcataggctaattaaaacttgctttgtaaaatgggaactctttgaagaattgctcctttaataaatacatgggaagtatctaaatggcagaagagtgtggctcataaaatcctcatggacaagatggagaaatatggtccaaacaatattttggtggatccacacacagttgaatcccatgctcagagaatgttaataaattgtgttgtatgacaggaggtgtctgctagcctgttacatagttgtttcctaaacaaatccatgttcatcatgttattaatgacttgaatgagagtatttttaataaaattctcaatttgcagaaatgttaagcttggaaggttaataatgtaattattaggcaacagaatcaatctgagaagaagaaaaaaacttcacagtagttatttccaaacttgggttcaaaaaatccagttgcattacattagaggacggatgccttaacagtcataggaaaagcctcagagaatttaattcatttttcataaatgggatgacagtttagttgcatatatgtatatgactgtgtatgtgtgtatacacccatatacatataattgtatatctacacccatataattcaagaaggaacgtatttcttacacttagttttacagaataacaatgacatgtgcttttttttaagagacagtcttgctctgtcacccagactggagagaagtagtgcaatcatagttcactataatctgaaactcctaggctcaagtgatcctccaacctcagcctcctgagtagctgggactccaggaatgcaccaccatacccggataatttttttaatttttttattttttagagatggattcttgctatgttgcctaggctggtctcaaattcctagcctcaagcagtcctcccacctcagcctcctgagtagctgggattacaggcatgagtcaacatgcctggcaccatgtgttttctttgacgttgagtttttctttatttgtgaaattgacacagttgatgatgtaggagaattttaagtaagacgtggggtagggagtggcagtagaatacttgaactcattgaacttcaaagattgcttccagtcttttaatcctgtgaattattacacatctccaaatgaatgcaaaagaatacattttattttttaatctgagaagtttttaaaatttagtatttttccaaagcttaagttctgttaatatttttaatcaattttgaaccatgtcttagaagtgagttagttgaacaggcttcacaatcgttaaagtatgctttatgatatagctgcaaaggggatctttttttgaaccttttcaatttaatgactgcatctgtccgtgtaatccacatatatttatgcgtaatttattttacattccagatgatctcaacataagtggcatcatagcagccgtagtagttgtggccttagtgatttccgtttgtggccttggtgtatgctatgctcagaggaaaggctacttttcaagtaagtgaatttcacccttctttggcagataactttctatggctatggagtttatttatgagatactgtttctcctaggaagttgtttttttgtttgtttgtttgtttttcagacagagtcttgctctgttgcccaggctggagtgcagtggtggcaaaatctccactcaatacaacctccacctcccaggttcaagtgattctcatgtctcagcctcccaaatagctgggattgcaagtgtgcaccaacacacccagctcatctttgtatttttagtacagatggggtttcgctatgttggccaggctggtctcgaactcctggcctcaagtgatctgcctgccttggccttccaaagtgctgggattacaggtgtgagctattgtgcccggccctctcctagcaagttttaacaaactctggagaatattgttcatttattttctgctatagaaaatgttcaggatgacatgcaggtggcttatgaaacaccttggcaaacctagggagaaaaggcagaactgcctagttgcacattccagggagcaccacagaatatgcaagaggcatccttggagtggtgcagtgcagcgagacagagatattcaatgtgaacggatatttatagtatctttgcatgtttttaagatttttttttgtttgtttttttgagacggagtctcactgtgtcgcccaggctggagtgcagtagcgcaatttcggctcactgcaagctccacctcccaggttcacaccattctcctgcctcagcctcccgagtagctgggactacaggctcccgccaccacgcccggctaatttttgtatttttagtagagacggggtttcatcgtgttagccgggatggtctcaatctcctgacctcctgatccacccaccttggcctcccaaagtgctgggataacaggtgtgagccaccgcgcccagacaagatatttttaagttaggaattgtatatctcaagatataagttgatttcaaattctttaagaaatttcattgaaataaataagtgaaatatttcatcagtgtagaacagtgaaatgttgaatgttaaatttaggacaactgtatttagaagagaattgttcagctgggtgtggtggctcatgcctgtcatcctaccactttgggagtctgaggcgggaggattacttgaggtcaggagttcgagaccagcctggccaacatggtgaaaccccgtctctactaaaaatacaaaaattagccaggagtggtgacatgcacctgtagtcccagctactgaggaggctgaagcagaaggatcacttgaacctgggaggtggaggttgcagtgagccaagatcatgccactccactccagcctgggtgacagagcaagactccatctcaaaaaaacaacaaaaaaagagaattgttcagtcaaaaatagaaacctattgtatttatgagagctacttctgtacacagttttgaattcttcaaatttagacctcttgtaacttcacacctccatttgataatgcaataggtttgatgtaaatgggtgggatttaaaaatgttttattctcttaatgcatttcttcactccctctttaatattattggagagctcagaagctgcagcattctatcagggccactggcaatagtgtgtaaaataaaattcttaattgaattataaatttatagcatatacaagttctagacccattgttttacagcgaacattaatttcggaatttagatttttaaaacaattttttttttttgagacagggtctcactctgtcacccatgcctggtgcagtggtgtgatcaaggctcactgcagccttgactttccgggctcaagcagtcctcccacctcagccttctcaagtagctgggactacaggcacataccaccacacctggctaattttcttttattttttgtggagacaggttcttgctctgttgttcaggctggtattgaactcctgggatcaaggaatcttcccatcccaacctcccaaaatgctaggattacaggtgtgagccaccactcttggcctttaaaaatatattttatgccaaaaataaacttaaatataaaatgtgttcctaataatacctacaactaggtattatgtctcataaaatgtttccgtggacatggattcaaagagatgccctataattaagaataactgggctgggtgtggtggctcacacttgcattcccaacactttgggaggccgaggcaggaggatcacttgagtccaggacttcacgaccagcctgggaaacatagggagaccctttctttacaaaaaataaaaaataagccaggcatcgttgcacacacctttagttccagctactcaggaggctaaagtaggaggatcgcttgagcgcagaaggtcgaggctgcagtgagttgtaatctcaccactgcactccaagctggataacagagcaagacactgaccaaacaaacaaacaaaaagagcggctctgtcaattaatacttgttcagtgcttcaatttagcccactttaatgtaactttatgaattgaatccagctgtggccccctgctggtcatcagtgaaagtacagacaaataagataactcttccaaaactcttgtcatctttatctatagcctaaaataatactggtctgagtttttttaatgaggagttagtaaaaaaattttcctaaaatattgaattaattaaaagttgacttgaatattaggagttcgttacctaagaatgttactctgatttttcatctagcagaaaaatctatccaagagaagcatattcttgaatatatgtttaggacagaggttggcagactactatctgtggaccaaatctgccctccccgcctatttttctatggcctatgaacaaaaatggctttacagatgaacatttacaatctatttgatgatagggcccgctgactttgaaccccaattaagagaaatgttatcttccccaaaagcattccatttctctaactagtaggcctgtttttcaagacttttattattattgttattattattattatatttttattttatccataaaaatgtttggaaatttgtttgctctcttgttacttaagtacctatatagtatcctcttggccccaaagcctaaaatggttgctgtatggctctttaccaaaaaagtttgccaactcttaatttagaaggtataaacgtcagcaagtgaagattaaaattaataaaaataaattaaacccaaactcatttttatatgaatctgtatcataccataataacccttgcattaatgatatatactttttcttttgtagaagaaacctccttccagtaagtatactttcctacaatgcatgtctttctcctatgtcaactaattttctattaatcatctgtttaaagtcaaaagagagaagttgggttatttgtgtaggtttactctcacaagaagttactcaagtttatcaagaaatacatctgtattaggctgttcttgcattgctgtaagaaaatacccgagactgggtagtttattgtaaaaagaggtttaattggctcacggttctgcaagctgtacaatcctggcaccaacactgcttggcttttggggaggcctcaggaagctttttactcatggctgaaggcaaagcgggagcaggcacgtcacatggcaaaagcaggagcaaggttggggaggtgccacatacttttaaacaaccagatttcaagaaaactcagtcactattctgaggacagcatcaagggggcggtactaaaccattcatgagaaatccgcccccatgatttaatcggctccaacaaaccccacctccaacattggggattacaattcaacataagatttgggcaaggcaaatatccagactctatcaacatcccacttcacacttcatacctacttgtaaatggtagtacagagagaatgatgattacccagcctacttgtaaatggtagtacagagagaatgatgattacccagacaagaaatatggtcactaatttgatttcataggcatttgtataaactaacttaaaaaaaatttactgtattttgctaaattgaaaattttcaaataaaattttagttaacagtcatttttttatattaattgaataccaattttgtgcctaacactgttctaaggaatggggatacagcagtgaacaaaacaggccaaaaaccccacaaaactctgccttatggagcttacattctagtagagaaaggcagaaaataaacaggtaatactatatagtatatcagatagggccattatggagaaaaataaaacaaataagagaatatacaatacaaagggtaggagtagagattctaatttcaaatagggtggtcagaaaggatctcactaagtgatttttgagaaaggcctgaagagggtgaggaagcaagttgtgcaaataaccatgagaagagcgttcaggcagaggggagagagcaaattgaaagatcctgaggccaggcaagcctagaatatctgagggatgtcagcgggaccagggtggctggaacagaatgagagaaacagaggagatgagcgtacaaaagtagcggtgggggcagattgtaaggagtcccttttaggcagtcgtgaggagtctggctttggtctgagtaagatagaaagtcactggagggctttaagcagaggagtggtgtcattttaatttttcaaaactcacactggcttctctgttaagaataaactatgagatgacaaaaggtggaagcagggagatcagttagcaaactaccacactaagtgaggcaagagaaaatggtggctggtgccaaagcagtgttggagatgctgagaagtgacagtgttttggatataatgttttaataacttgctgatctgttggatgtgggctgtgagagaagcagagaaatcgaagatggcttcaaggttatgagaaggatggaattaccatttacggaagtgtggaagattttaagaggagagagtttgggagtggtgatgggaataagtggagaggttggagtgtttggaattttaatatttgatatgcttatttgattccaagtagaggttatcagtaactgaatattcaaaatctagagtttggggaaataactggaaatggaattgtaggagtcattggtacatgaaatatgggtgagctccccaacgccctgtagtttgtgtgtacttgttttatgactgtccttcttgtatgtacagatctggcagacctaactttggctctatgggcgtagagagaagatggatgacaaactatctgaggctatggcagctgggagtggagaagatatactgaagccatggcttcagacagtttgtcatctcctaattcctttgaagaatcatctgccattgacttcctgttcccagatttctggctcaatcctggtctctcagtctcgtaagatcctaatacaagtctaggttgaagttcagattatcaagaattagcagtaataaagccagtgagttcagaagggcagggtagctggaaagtgttgctacttcccacccctaacctccaggtgattgtgaggacttctgcttttattgagtgacacgaaaagtaattggaaggttttgagcagaggggagacatcatcttacgtaagtgggaagggtgacatagctgcagtgagggaggttattcttctatcagtatctctagcaaatcaagtagtaatctggtggggaataacttcattcctagacatatgccctcacattcattaaatctgtggccttcaaaatatgttcaataacgaaatggatgactggaacactagtcaccatgtaaaactttttccacggaaaaataaataaattttgagattataatagtcaagctttcaaaatattaaatgttaatatattaaattaaaagttagtaagtctctggtttgtgtattccacaaaaatctttagtatactagccacaagctacatttacgtgcacaaggcttcacactgatgttttgttgcatgactttctctgtgaatattgtctgtaaatataagaaattcagtaagaattgtctttttttctacctaagatatatgttcatgttcttgctgagaaaatgtatggaagtaaaattaactaaaagagcatatatgttccagattggaagtgataatgtagtaaatattgtcttttatattccacaaacaggaagagtaattcttcatctaaagccacgacaatgagtgaaaatgtgagtatctttaaagcatatttatagaatgaatatgtttggggaatagggcagggaaatgaagtaattatatggactttgtgaattttcacttttaatacactttgcaccagtgtctatcactggtgtttaaaaggagctaagtagatgttagcttctgtaccctgtctaggatggcatgataaagatacctggcatttccaatagcagaagtgatctttaatcatatcattatttgtttcatggtattttctataattagtctgccttcttagtatcactaggtctggcattatcagctccctttgacagatgagtaaattaaaacacaggttcttacagggtaacagtggtggagctgggacccaggctcttttcttccctgtagcttgaccaagcagagtggttccagcagagctgtggttctaggactcacctttggttatgtgaagcacttggaacattttagggctatgcaatgtcttagtcatttgggctgctataacaaaaataccatacactgggtaatttacaaacaacaaatttattttcagttttggaggccaggaagtccacaatcaaggcaccagtagactcaatgtctagtgagagcctgttcctcatagatggagacttcctgctgtgtcctcacatagtagcaggggcaaaacaagcaccctctggcctctttggtacgggcactagctccattcatgaaggtcctgccctcatcacctaatcacctcctaaaggccccacctcttaatagtattgcattagggattaggtttcaacatatgaattttgggtgacacaaacattcagaccagagcacagaatatcctgttataattgaaaggaacatttcagaaatgtttgaaaagacgcagtaattacctaactcagaggttttaaggaacataatttagacacttggaccctttgtaaacactacattgatgcagcaaataccattgttactcagattttgtagctctttggatggatattcagccttctggatgattttctcaggaatatagtgggttggggcagggggagttcctatggttttagaggcctaagtcgtttcttgagaaacaaagcatgggttctcagaaatgctttactcatctatggcaggaattctgtcagatttcttctcagtagagtctggggggtggggtggggcgggggagcctggacatcagtattttaaatgcttacccacttttctgtaaaaatttgattttcaaaaactgttccagaaactattacagaattcaccttattttgtggtttactacactgaaagcttactgatgtttaattaggggacaagaaactttgttcccaccatttttgtgcctacaatttatggaaagtctttgtttctgcaatttacagaaagtactcttggagtgtggaatcgaatactcccatccctccaaacagtatgaagcacattgtggctaaactgaatgaacaaaagccatttattttttctttgccttcctctcagttgcccttatcaactaacagctagagtccccttcagttctcttgtgccctaccacagggtttctcaacctcagcactactgatattttgggccacatcattctttggtgtaaggtgctgtcctgtacatcataggatgtgtagccacaggcctggcctccaacaccagatgccggggcatcctcctaacaggatttgtctgcctctgccttccagtcctacctctttactctctaggcaaagcttcagagtaccttgtctgctaggagttagttagttaattccccataaaacaagtttaattaaatatatactggttttggccaggtgcagtggctcacgcctgtaatcccagcactttggaaggccgcggcgggcggatcacgaggtcaggagttctagaccagtctggccaatatggtgaaaccccatctctactaaaatacaaaaattagctgggcatggtggcatgtgcctgcagttccagctgcttgggagacaggagaatcacttgaacccgggaggcggaggttgcagtgagctgagatcacgccactgcagtccagcctgggtaacagagcaagattccatctcaaaaaataaaataaataaataaataaatactggtttttacctgtagaattcttacaataaatatagcttgatattcataagatttatgtttctttaaatatgaattcatatatttaaacctgttttttctttcttttcctaggatttcaagcacacaaaatcctttataatttaaagactccactttagagatacaccaaagccacc

SEQ ID NO: 5 - DNA, 483259 bp, Homo sapiens
cgcagcgcctgaacagcggactccggagtctccgggcatctattctggctgtgaatttcaggagcctcaagcggtcatttctcttcaacgtagcttcctattttaagggatcttggagaggggggcagcattgggataatcaaggtcttttaggttaatccctgcgttttcattttacctccccaaaacgctgtttagttgtttacggatggaggtaagtgaaagaaaacgcaagagagccatctgctgtcttaagctgtgataaaagaatgtgcaaagctagggtgaaaaccaattcagggccggtgaacacaaatgtaaaggttactgtagttcagaaaataatttgtcactcatcagaacctccttggagttgttaattttacctttgacgttataaagaggaaaataaagtacggcccaggtggtgtagctcctcaccaagctattgggagcctgaactctcatttcagaggttcttggttcatttcttgactctgcaacttcctagctgtataatgacctccaaggtgttgctttagtctctctcagcctcaatttcttcatctctcaaattgaggtgaaaacagagcctccttttcaactgctgtgagattaaatttagtaaataaatgtaaagatcctagtaccacatctggtgcaccctaattgaaaatgacagctatgactgtattatcatcatcttccagtttactcatttctatcttgtaaattcttttgcagtttccatgttttttcaatatcaaaatatatgtattccctatgtatatttcctcaccaccacccccccacagtggatgcatgacaagattttagataattcgaaacataagaagttattttaaattttgacgaaataagtcccaagttcaaaccttagttattattaactacatttgtgaactgagtcccgtaagcctactttcacaccaactgattgataataaaaacatttctctacctttcagagactatgatgagggtctatgagaaagtacttctaaaaacactaaaatactatacaagcatcagtttggaaggtaattagtacactgtgcttgatggtctcctgaagatgctatgatccttttggtcctccaactttaagtatgttgttccctctacctggaaaatttctattgccctatcctcacactcctcttgatgattaaaaaaaaaaaatcatcagctaaagagtaaggcatgagccaccatggcttgccaacagatttttaaataaaaataaagagactttttggctctgtcttgatggagcttatagtttaggtctcagcatagatatcttctctgggaaacttcttgccacctacccctaattaacactgaatctagggcaccttctaaaaacttcatcattcctctactaacaccagcaattgttgaataaagagagagctatattgaaacttctacaaagatgtctgataggtaagtgtctcatgcttaaaatggccatgaacgaactactgttcttccttcttaaacctgttcttccaatcctcgccacttctgaaatggcaacttcattcttgttcctcaggctgaaaactttagtatcatattaatgtcatttctttctctaataccccgtatatatttgtgtaagatctattctgtctatctgcaaaatatatccaagatatcactctcaccacctccactactacctaccaccatcatcttttgggtgattatactacaatagtaactacgaaatcccatacttcaaaaccaaagtcctcactgtagtggcctgccatggctcatgtgatttgtgccccatctctgccttcagttgttctctgacatcatctctattcatctcccttcacttaccacttgctgtccatcaaaccacctggcatgatcctatgacaggacttttatacttgctgttgcatttgactctcatctcctatgaatctttcctcacatctttgctcataaatctatttaaaattacaactcataaacacagacatttccttcttgctaccctgctttatggttctacatagcacgtacaacttttaaaatttccatgtactttccttatttatttgggctgtcttccccgtttaaaatataagcctataaaggtacagactttgtctcctttgtttactgccacatatccagtgtttaaaatggtgccaggcaagtaggtgctcaataaagatttgtgtattgaaaggattaagacattggatatctgaacaaatagacagttaataccaaataagaggaacagaaaatcttgcttaatccagtctgtcaaggatgaagtaccccatggtacctaaagagatccttgatctctttaagcaccaagacacctaaaattctatctggattacacacaatctcaacttcataaataggatacaccgaaaatactttagcctttgcttgatgtcctgggctcaaccaaacatgacaaacagtttgagttctgaatttcaacagtgacaccctcggggcttactgaaggatgtgagactgtttccatttgaatcaaaaaggacttctggtatttgtgattcaccacttctccacacttcctaacacacacacagttttctatcttgcctcctcattttcagattgttgattgataaattgacaatatgccctttttcaaatttgctacatctaatcatgtaatccattatagaatttgacaccagataaatgtatttgttaaaattatctataaatattaaagtatataaactcgaagtgaggagagtatacaaacaagaaacagccttattgaaattgaattgattattaaattttttcctattgcattctgagttccattatgttctggatgactttgtggcatacattgtttgccttccaagtagataagtttcgatacagtttactaaaaaaaaaaagtgcctggattttgttttttatttatccttcaaatgaacaaaaaaatccaaaaaacatattttgtacattgatatatatattaaattctatcatgttatttttccaaataaaaatctattacttttccttcatttctgccattgccacggccactatttcgcctttcctaaatttgtcaaatttaagaagctgttaattttaagattattttaggtacttcgatgaaagaaataaaaacacttcattaagctatgttattttatagattataatacgcatatgaattctaaaggtgtttatacataaaaagtattggcatctaagaatcactaaaatatgacgtgtacttgatcgttttcatacattaagtgactcactccgttttgtcacatggtttcctttgtgaatcacttttgacatttttcaacatctccaaaattaaagataaaatatgaaagtccaacattattttttccacaattaaattattataaaccaatttggggtgagcttcagtggaattaaagatgatatatattggcatttgtttaaatctcctttctcgataaatgggttctatttgaaaatgtttgaaatacttccggaaaagtaatcgatattgatgtcccttttcattttttactcatttggaagaatatttaaaaagtcatattagtatgtacttggggcaaattttcaactagttaattaagactgactgcttatccgctcattacagtttaagttcaagatcacatttttttccgtgatagtattattgacctttattttagaatcaaaggttgatctaactgaatattaaataattctaaattagattttcaaaaaccaagtgattgcattaatgttataacagtcttgttgattaattttgctggatatatttatttctggtaggcaacagatttctatctattaaaaaactggaaggaattttattgttgcttaatgttttgattcaataaaggaaaagtagaaactattgatactaaaaacttgtgaacattctttcctatagaagcaataccagattgatactagcagatggtttagctttacaaatttagtgattttcttttaatccagctaatacgttggaaaaaatattctcagtagcttccagccttcaatactaaagtgaatccaaaatgggcatagaagtcatttctgagttgtgaatattggcaaatcttttcctactctaaatcagtagtggaagattaaaataccaagcattttaataatagatcagtgaatttttaacactactgaatacctcaacagaaaaaaaattactcaatttccaagaaagtttgagaaaggaaagttcatttataatctcaatgcaaagagagtccctgtgcacatgtgatataatctttttcatatttagcactgtaatgagtttttcaataatttctagaatgaccactttcataggaaataagtgagctggattaagattatgttctttgcatttagcatacatgagttaaacatatatgtaaacttgtacatctgcacacacatgttgtatgcatttgtgccaaaacacacaactaaatttctgactctgttaaaggtaattaaaatagtgatttttttaaaaaagccattttcaaactcccagttcatgcctcctagtaacctgttttcattactaccttcacagtatagaacttttacattcacatttgaaagttttctggataatagttaagtgggaattaataataaattagagaatatttcggtcataattatttaaatgggaacaagagcatgtctgtttataaaacatccaaataatatgtgtataatagtatgtgaaaagcttttagttctagtgaagtggacatcatgatctctattttacagaagaggcaattaagccccagacatgttaaatgattgccaaagttacacagctatgaagtggaagaacaagatcttaagcacatgccttttctatcacactatctgccacccagaagtcagctatttgaaatatacatgtctgacacagtgaccagtgtagaataagaactcttacatgggagccaaggacttccagaagctccaaggatgggtgtaggattatctgattcccctgaaatttatgctgaaaaaaaggtgtgcatgtgcatgttgataacaccagggttcacaatttttattcaactgttaaaaagctctgtgagcaaagcaagaataagaaccgaaaactgtagaggagggcaaagaaagaatgagaatgagaacacaacatccaattctacattttctgactataaaagtacaattagaatataaaaataaatgacaaataaaaattgcctctaatcccaacattcaaatgttttggtatatttttccagttttttagaacgttattttacatacaaatttgctatcatatttttggcccaggttggtgactgagaagacacaaatgcagtaaaagccagtgcatcaaagaccatacactttaattatatgacctgaaagcgtaccagggactacatattctacattcttccaaaaactctctacaactaagagggcacttcctcctgcaggttctgcaggctctaatctctggggacaactggtacttcagtgtgcagggtttcagaaagtctagttaaataccggaagccttcaggttctggcaaagttgctattaatctgcctctgatcttgtaatctacttctaaaagatgcaagtgaaagtaatttccaaagtgcatgcatgtaggaaatgttataattttaaattaatgccttattcctgagcctagtttctactttgtatgtaactgctaaaaatatagatcttaaattattcccgagtctttctcagtaacctacagtgtaagtttcatattgcttctgtaacaaattagcataaacttagttgcttttaaaaatacacatttattctcttccagttctgcaggtagacagtcccaaatcaatctcactggatttaagtcatgatgtctgcagagccttctggaggctttgagagaagaatccatttccctgctgctttttgtttgtttaatcttccagaggccacctgccttcctggctcacagaccatgtcttgcatcttgcttccattgtcacatttcctactactgactctgatcctcctgcctccctcttcaagatcctagtgatttcactgggcccacccaataatccaggggaatctccccatcccaggatccttaacttaatcacatctgcaaaatcgtgtaaactgacgtattcacatactcacaagttgcagggataaggatatgggcaccttgggggaggcaatcattctgtctaccacacctaccctgtatccaaaacacacagaaacagaatccttcctagcctttgacacttacccacgcccctctgatggacagaatagctgcttccaaataccagtttttaaatgagagtccggtttcctaccaacataattttttaaacaccagcagctgtttactcgattgaatctctaatgattgcctgctcctgcttcctaggctgctttactcccctgctcagtgttacctgttatcatttgctggaccgctccagtaccacctgcttacctgaatttcttataactttaattattgcatcgctcagaaaaaaacgtacagcaattctcagtgattgtggagacaggaccattaggctccccagtgaattgtgagaatgcatttttctaagccccacataaatccatgaagaatttaatttcttgagtttataacatgcctttcatgagatttaaggccatagaatctagctaaataaaactaaagctagacatgtgatgctttacaaaatgagatttggggcctaaggctattgccaaatgaaggaaatacattctgcaagtcttttttccccattccactttcatttttatatagctgtaggggaagtagataattggtctttccttttagaaatttagatgaactccttaggtaagaatttgccttaaccgtataggttgacactgactgcaaatggaaaggtgccatttatgcaaaagatttttaaagaaatcagaaatatttcctgaagctttatgcggacagaggaagaggaacctcaggaaaaagaattatttcagagagaacatcatggatatttttaaataaacaagttttagagccccgagacaagccctgctcaccacatttttctttgctcactccttcaccccttttggcctttttgtgttgtttctctctgtaccctcctctgaggtcctacagagatttgaaactggctttcagggatgagggtacccaatggttaaaagaaggctttggctgtgagtcaggaatagcggccattgcacttgacaggttttgttttatatgtattgtatatatacataaaatatttgaaagcaccaagacatatcagcaaatgaatctctccccgacagggagggataaactgtccaaacacaaatttttccccaagacacctaatcgatgcagtcagctgtgctcaggagaggcctgcactggccatgctcacaggcttgtgttcatttctccatgaaatgggcttcgtgatcctctcaagagatttagttctagcaggacaagtttcagattcatttatgtcatgggtatttgagtacagataggagacagcagttttacatatttgtactgtacaaagtttagatctgagcccttgttgccctgctgcaagagtcaaagctgatactcaaatactctaattcccagctctttgtcataggtttcatttccaggaccgggagttgcccctttctggcctctttgaagggtcattctaccctcggtgagtcaacgatgtgcacaggctcccagcttccctgcctctccggggatcatttctttgactcctacacactcctggctttcccaacacacagctcctgatcagaggggctccacctccccagagcctggagcagtgcctgacccaccacaggtgctcagtcagtgtttgtcaaagggaggatgagactcagacaggaatagtcccaggttctggactgttcctgatgtctttaatcctcctcccaacggtaagacacatatgccctccgtcccgtttccctctttcatccccggtgacactagaacttttcaaaatatctaaaaaaaatagtccctctctagaagaagctacttttactcttgaagcactaaaagaggccctgtgggcagaggcttgtggagttctggatgaccacgagctggacactctgcatgtggaaggaagtggaaggtctgctgcccaggagattttcctaacattttaataaaagggaatggcatatgcaaaggaaaaggaagaaagtcaaccaaatgcaggctttcggcttcattgataataatgagtctgaaaataaagacactttttagtacatattaacataatcgaggaccattttttattcaaatcactgaaaactaatacaacttgaattttttaatagtatacttaaaacattctaaacttgctgtggtgtgtgtgtgtgtgtgtgtgtgtgtgtagtttttgctaacttcaatcaacagggaaagtcactgagcacaggatattttcatattatatttctcaattttattcgtttatggctttgaactgaaatcttactgttatcttattttccctatttttttttgagacagagtcccactctgttgccaggctgaaggttagaacaagaagtagccttagagatgatttaaaactaataatcccattttactgatcaacacactgaggcccatggaggttaggtaatttgctaagctcacggctaactggcagcagctctcagcctgatttctcttctcctgatgtggtgtgccaggacctctccatcacagctctgtacttctcagaaggccttggctacaatgcagaagagtggccattatactctctccagagcatttctggaacatggctatctctcttttcttgttaagcacagtccattttttttttctatgcagctatacatactattattaaatgctctgagttggatatgaattactgcctccaatgtttgcaaaataggcctcgcttggacaatatattcataaaaacataattttcagaaaggtttacctcttggtttatatgatcaacctttatttatcatcaaataattcattacattaatgcgtctattgagcgctaactctgcaccactgtacttgacccggcattcaggcatctccccttgagtggctcagaatatagcggggaagatgttgacataggcgcttgtgcctaagtgtctcagatgctgggtgtgaagcacgtgcaagaacagtggaaagagtcagctccacctggtatgggttgggaaaggtctcatggaaacagtaacacctggagctgagattaaaaagatgggagatagtcaccagctagtcaaggtgggtatggggattgcagtcagaaaatgtcaaaatagaggaaccctgagttacaggcacagcctaatctgtgaaggtaagcggaagcagcctaatctgtgtcaggggaaaaggatacaaaaagcctgtcagtgacgaaattaggaattttgtatgtcactggggacattcacaccagctgtagaaccagctgaggtaataaacattaaataatattcatgaagagctattttccacataggtttgcagtagacccactcaattacctgggcgttgtcacgtcatctgactattttcatgctgacctcttcccatgcttttctattaatgtgtgagacatggtcattggacttaaaaatgtacacattatatggcatctttatttatatgtgttatatatcattaaatatatacatatatgcacatatatacatgcacacattcacataaaatagactgaagtataaacagtgtttatcagtaggtggtgggttgtagccctttatgttttttattctttgcacttttccctgacttttcacaaggagcatgtgcaacttgcataatcatagaaggatgactttgtttttaatataggtgttcatttagtaaagagaaaaaaggggcaacacatacataaaggaaaaagtctgtagctgtggagcaagctgtggatatccactagctgattagagggctttacttccaaattttaattcatcccattactcgttttaacgtgagagcttattctatttatatcaaaaggcttgcatttctaattcttaaacatcaaattttttcccttcccttcctgttttcaaagacatgaaatagttctgttccaataagacacttgaaaaaacaaaccaaatgagaaacccaacaaaaacaacaacaaaacatttttccttgaaaaatcaaggttgcaaatctcagaggcaacttcagtatagctttttagagaaatattgagagtatttacaaggtcttatgtcaaaaagagccaaattaatttcctgcattaaaatattgctctctttatggtcataccttggctcctgggtaaacatacttcattgtatttatagcacactcatgtccccatatcctagtgttaatactgtattgataaacacagaaatgaatctcagccactggaatgctccattttcataacattccttatgtggttacacaatcattcagcgattttctttttagcctagagggactcagtcagttgcaaagttttttccatcaactttccttggctacttggtatgaacagtttaatttcattttcttcacagacgaaaagtattttacactgtaacaatccttgcatatcattgtagattcaaacatgctcactcacacacacactcacacacagagttaaactaatactgctaatccctctaggtatgtcaaggaaaataaaaatatctgcttccatatagagttccagaggctagtttgttaaatccacatttattcttctgctcaaaagtttagtaggaaggggacttacaatcatctggtcctacagtgttctaacagccctgtaaagagaatgcctgttttccacttagacggtccaacaagttagagtccaacaaatttacccctctccttttttgagatggcttgtgttttagcatgcccttctcagaattggccccaaagcctggttttctaaaatgtccagtcatctttcacttattgcccatcggaacaaaatatttatccttcttccatatgatggtctttaaatattttatgacaaaacctaccctatttatttctgtccctttagtttcaggagacctcactgacgttgacccacccaggagagctattgctgagatcaaacgaaccctgtaggttttttctgcttgtctctggaatgcaaaggcgcccttcccatcctcttcattctccctggtcctggcttcccagctccttccattctccctcacgctgtctcagttccaagtcttcactcatttcactgtctcttggtttttcaccagcaatttagttagtagtttgcatttgctttctttggcacttcttcagaatacacattttgatgctctctttagtcacaacaccaagagacttcacaatgaggctgcaattatctcaattctctgaaaaccttaggactggatgctcccctctctcctcctccaccatgtctgaaaggcatgagagattttcagcttccctgagtcagggactttgttttgttcactgtgcatccagtctaccctcagcggctagcactgtgcttggcccacagaagcaattcaatgaacagctgttaagagtaactttgaaaggttggtttcctccgggtgagccggacaggacactgatgcccacgtgaaagcctcacatcagaaatgcacaccacagagaaaatggaataagtacttcagcggatctgtacctcgcaaagcacctgaagaacgcgattgacccattttaaacttcctacatgtcactcctaagtcttcttcaccacatttcctattagaaattagtttattatttgaatccagcagagctccaaagagctgcctattggaatcaaataggacacttctaaaaggttctctggggatgggtgtgtcttggttataagaactttccctaaaagctctccaagatcaatgccaaatattaagatattatataaatgatcagggattccattaaaattaaggcaatatcttttcaaagattttgtggaaacgcatttctttcatatgctgacctgcagccttgctctgcaattttccttttagtttgtacaaaacagagttctttagtggaagacagtcttgcctttattttgagcccacaggaaaaggtgtatggcgttcttttcattgctttttaaaaataaattccaggccgggtgcagtggctcatgcctgtgatcccagcactttgggaggcctaggtgggtggatcacctgaggtcagaagtttgtgaccagcctggccaacatggtgaaacccccatctctcctaaaaatacaaaaaagttagctgggcgtggtggctggtgcctgtaatcccagctactcaggaggctgaggcaggagaatcgcttgaatctgcgagtcggaggttgcagtgagccaagatcacgccattgcactccagcctgggtgacataagtgagactccatgtcaaaaaaaaaaaaaaaggaaaaaagaaattacaaaacataaaactcgataataaaattacagatttacataggatagtactggggaagctttgtttcttgagccacaagtaactactggctgagttgaattaggagataggcaagtttcctaaaatgaagttatctgtcagtcggttgcccctacacacttttgataaatccctctcccttttaaaattacagtaaaaaaaaaaaaaaaaaaagcactgagaaaaaattatgaggacaagaagcaggttctgaaatcccaggccaagatatatttggctttagtgtttaacacggtggacaagtttagaaagataaaaacccaattcaatgaattttgagatcaaaattgatgagatgggagatagcagctgaggggaaaatggaaacagctaacgagctacagtgatgtcctgaagtcctatttcttcctaggtgtgtttctttttaaaataatctatttttgtcataatttttcactctattcatctccatctttcttacttgatcataatatgaagatgactgaattaatttcagtaaagttagtgatattttatatattctgttcttaatattttaaaaacttagtttaactatttttatccgtcaaaacaagttcaaacaaatccattaaaactaaccaaagttatcgatatcccttttcttggcctctttgcatgtgtttgcagacattctgtgtctaactctaactcccatttgttctatgaataatgggaggttagaggttcttccattattcatagaacaaatgctttgagagcaataaataagaagttatccggtacaagatttgctaactgtctttgtgaatttctgttgaattctacagaattactgttattaataatgtattggtagtccgggcatggtggttcatgcctgtaattccagcactttggaaggctgagacaggaggatcactttaggtcaggaattcaagaccagcctggccaacacagtgaaaccctgtctctactaaaaatacaaaaattatctggacttgggggcgaatgcctgtagtcccagctactcgggaggctgaggcggcagaatcacttaaatctgggaggcagaggttgcagtcagccaagatcgcaccactgcgatccagcctggacaacagagtgagactctatctcaaaaaacaaacaaacaaacaaacaaaaacatatataatgtattggtatatttaatctgtcttaaattttacatattactctttcttacattaatttagataaccaaatattactctaaatattattgctcatatgtatatatatttgacaaataatactttatatatgtgtgactgtgtatgttttatatatgtatacacacatatatatatacatgtatgtatatgtataattcagagcaggaaacaaattttaacacaatttcttttggattgtccttgttggcagaggataaaactatcaactcttgtattcaatttggttaatatttttaagtgatgacttttcttcctagcaagaaaataatgggaagataagaaacatttaaatgatttggtaaacaagtgtggttgttgctaaattagaaagcagtctgcaagatgcagcggcaggtgaaggcagctgattcttcaaagcacaacagaaacgaaccaaatgtcatctgtagaatgcaaaacaaagtggtatattcgtacattttagtactacctatcagtaaagaaagcccaaatcactggtataccagtaacaagaataaacttccacatcattatgttgagcagttaagaagccagacacaaaagagcacaatcgtgattccattttaaaaaatggaatgtggtatctatagatatcagaagaatttttgtctctgaggtgggagattgactggaaagcatcaagaggcaactttttggggtgctggaaatattatttgccttgatatgggcaatggttacagggattacacatttgtcaaaattcatcgatatgtttacctaagttatttactttgtatatgttagacctcaataaagtgctattcaaaataaacaaataagaacattaattcaaatgaacatcagaaaaacccattaactgaaatgaagcatcaatcccatgcacaattttagggcatgcagattctctgaaagtccaaatgcccctcactctacactgccattttctatacatgaagaccccctgatggttggtggagattgggagaatggaatgttctactgctgcagactgtctgccgggtgagtatttccatggttcccactgttacaaaggaaactcaattctatttttttaatattgttcagtgaggacacttaatatgagatgtaccctcttaacagattttcacgtgtataatacagtgttgttatctacagacacgatattgtacatattgtattggctcctagaactttttcatcttgcataacttgttttaggctcactgagatacaaaaggagattgtggagctacagatacagtacactgaactcaaagaaagaaaagtagggcaattatttacaagaatacattttaataaaatatttcttactaaagttgaaataataaaggaaatctcatcatttcctgaaatgaggcttaggccaatgtaagcaagctgatgtgagagcagtatcctcctttctgccccttcagggctacatccagcagctgcttggggcccctagaatccactgttgagtcctcactaaccaggcaattttggcttctcacattctgctgacagagcagctaggtgcttcttggtcctgattctcaagctgaccccaactgctatggtttggctgtgttcctgcccacatctcaccttgaattgcagttcccataatcccctgtgtcatgggaaaaacaggtggggagtgattggatcatgagagcggtttctcccatgctgttctcatgatagtcagtgagttcacatgagatctgatggttttataagtgtctggcatttcccctgcttgcactcattctctttcctgctgccctgtgaagaggtgccttccactatgattgtaagctttctgaggcctccccagccatgcggaaccatgagtcaattaaacctctttcctttataaattacccagtgtcaggtattttttcacagcagcatgagaacggactaatataccaaccaaatccccagaaacatatgccccccaaaacaaaacacacagagatgttctatccatccagcaaatgtctcttttctccacagagcttctaagttgtcatctagctaccgtgactgattaatttgagaatgcattaaatgcatcatattttcctgcttaggtgagattagagatttttaaacatagtatgaaatcccaaaaggataatattttggtggttctatgacaggtcaatgaaggggaaatttttaaggtagtcatagaaaggatctgtccatggtcttaaacatcccatataaactaacatgtactgaatgccaggcacagcagcaagctttaacataccttatcttatttaatccttgagacaattttataaaggagaaattctcccttccattgtccagatgaggcagccagtgcgctcctgcagggtcatgctgtttgcagtctgctgagaccagctcaggactccttcttaatgcctgacccacgagggttgtgggcacttacgtggtcaagaagtgaaaagaatttcacagttgatttattagtgatttactgagaagcgctgagttttgagggatgcacaaatcctgccacttgccttcaggtgccctaaagtccataccttaggccacgtctcctaaccctaaacattgccgagtaacagtcaccatggatttcagaactcaagtcaggaataccagttgccagtatcagccttccaactttgtaactatgagaggcaggtgactgtggataggaaaacacaggcatttcagggacatttcaacagtttgtggggatcacgggataacatattttaattagtgcctgttccaaaagatctagaatgtaggaccaccatgccaagtcagcaccagaaatatatcctctgggagctagctgccttcttcctaaagttctcttatttttcttgtttccagagcaagcaatgaatgctatttgttcactatcttccccacaatactgagcccatggcgtatattgtcaataatatgtgctgaaagaataaatgaaggactgaatgaatgagagaatattctcagaatggaacattcagtcaattgctacaaagccttaatttaccatccataagatatttgcaaatgaatgttctcttcctaggcagaaaaattaattagtgtatagaagcaaatcagtttaaaaatgtcagatcaaaggggtagagatgggggtgtttgaaacaccagtggaatgaagactgtattttatacaactcataatctctgtgaaaaatgcaaactccccttgctaaaaaggatggcgctttaatttgtcacagcatccccaagcctgcctcagccctaaaggacattccagacttgaaacccactgccactgtagataaaattctctctttacatctatgtctttttatggattagtggaactaattgagaataatgaacatatcagaataattcccagtaatctgtggtactgacatggaagctaattgttacaggctgaattatgttcctcccaactccatatgttgaagacctaacccctagtacctcagaatgtgactgcatttggagacagggtgatcaagtgaaaatgaggctgtcaggtgggtcctactgtaatctgactggtgttcacattaaaggaaatctggacacacagagatcccagggttgtgcacacacagagatgaaacatgtgaagatgcagtgagaaggtggccgtgggcaagcccaggagagaggcctcagaagaaatcaaccttactgacaccttgaccgtggactgctagcatccagatctatgagaaaattcattgctgttttttgtttgtttgtttgtttgtttttgagaaggagtcttgctctgtctccaggctgaagtgcagtgatgtgatctcagctcactgcaacctctgcctcccggattcaagcgatttgattctcctgtctcagcctcccaaggagctgggactacaggtgctcaccaccacgcccagctattttttgtatttttagtagagacagggtttcaccatgttggccaggctggtctcagtctatcgaccttgtgatctgactgcctcagcctccaaaagtgctgggattacaggcatgaggcaccgtgcccagcccatttctgttatttaagccacccagtctgtggtattttcttatgacagtcctagaaaactaatacattatttgaaaatgaactcaacccttctgttaaaagaaaaaaatctgaaatcaagaaggcctgccttcatgcaccgaatagacaagcaatggctttatactggcttccagacagggcaccacagaggccaggtcctcatggggttctgccagccacgtgctgcctgcattgacatcagtgggggtcggaatggtcaacccatcaagccttcacttttgatttcactctcatcttggagactaaatccacttatgaataaaaagcaccatccccttgcagacaaagattacatttgaccatttgcttcatacacaacaacaacaaaaaaaatccattggcatagagagggctgtctgtcatgtgtatttaccaagaatgatttctctttttcaagcactgttaacattaattatgatgaacatctggtagagaatatcttcatgaaattagtgtttataattctttcctcagcttttatcttgagttaatattagacatgaatatggaaagaacattgatttagttcctaataaaaagggctaccaaaatactactctgccaagtttgtcccaataaaatccatgccattgagaaaattttgtttgtagaaaattagtatttatttttcccttttataaattaatgaggattatacaacttatttttccttctaaatgtatcctcttggatctcaaagctaagcacatttttaaaatataattgttatcctcagcctagatatcgggtgtatgtctctccctcaccactacatttcatttgaccttcagtatttaaaccaacaaatgtaccaaactttgcttttcccccataagcttcttcaaattcttagctggaattaggacatagatgataattcagaattatcctttttagaaaataagataacttcattaaggagagtagttcttcactgagggcatttttgccctccagggaacatttgataatatccgaagacatttttcagttatcataatggagtggggatgagcactgatggccagggatgtgctaaacattgtacatcatgcagcacatcccttcccaaaaccaagtattaaccagctcaaaatgccaatagtgccaaggctgaggagccctggcatggagtgagcagattggaaacatcagaataatttggtatggccctagtcaaacattcagtgtttgaggatggaaaaacctatattgatctctaacttttcctttgttatactttctcattccagagaaacaattgttcaatacaatctgtgcgtttcatagatattcttggtttcctttgtctgagtattagtggcagaatttcttcagctctcctaaaaatacgtttaaagttactaacagcaccattacacaaactcgttttaatgattagaaatagcttagtaagccacaggcagcttactaaacaatctcagtccatttcttactttatttttgtctgactttccatggtcccaagagttacagcacatcctttctgtccattatctctgacagtaagcctaactcctaccttaagtaaggttgagtgaagatgttacacttaggccaggaagccccagggtgttgggttaatgcgaaatcctaaaatgcaccactgaccatggttattagatttgcatcttgagtaacaaagttctgtaaaaatctcaccaatgtgcagtcttctatcctcttccttgtttctaattcacagactgtaaatgtcaatctgttttgtatacctgcattatccgtctgaaccagtctcactatcagaaggattcaatatggacattctttgtatttaatctagtttattggaaaaaagttaaagtcaaaaaccacctcatattaaataaaaacgagacaaagaaatggcatgctttagaaagaaatagcatgaatgaaagggtcaaaaagtgaaagaaccatgatatacaagagaagaaggaaaaaaagtagttggagaaaacaataaaattttgcagacggatatattacaacagacagaacaaggtaattcagagagctctgggtgggatgcagaatcctttgcttctcttttctccttaactggcaaaatggccttggccaagtcacctctctggacctgcaaaagaggacttatcttgaatgatctggcttcaagtccttctaagcagtaaatccctagttgtatccatgccttgggttggctactgagaaactcaaggatcacacactgaaataggcaggctgtcaaatacaagtcgaatacaggagaaagtgaagaacagtgttttaaaagggtgatcgggaggtctcccaaaagaggtcacctcttcctctggaagtatgcaagaggtggcggtcaagggagaggaagggaggctcaagcattcaatagagccttaattctccagtgggagatgaatgagaaaaatatcccctgtgcacacctgttctttccaaggtgaatgggaaagagtacaggcagagagggtggcctactttccattcttcaaacatgaaaagcttgtgctcgccttgaggcttttgtacaaattgcttttttctacttgaactacttgatagggttgaccctgtcctttcattcaggtttctactccatatcacctcctcagaaaggcattccctacccatccaatctaaagtaactgacaatccacagtaaccacctgcactctttagacctcacctattttctctgtctgctcaagtcttttgtcagcatatctcattttgatttttgtctttatacatttgatgatcagtcttcctcctctacagtgtaaattccatgagatcaggggtcccttaggttttgttcattgctctattccctgctcccagcacagtaaaattcaacaaatattgaaagaattttttaaaaaatatttttcattcataagcaaatttttcatatgcaaaataaaatttgcatgtggaaagatctagaagacagaaaatgaaaacaaagtaagttaagaacagatagagtcttttggggacatctctaagacttagaaaaaaaaacaagtcttgatcctgcaggtcaagtgaaaacctgaagggtcacagaagaataaacacatgagctgaaaagagcaacattgcggagcgatttatgttttcaaactactcagtcctgatgtctaggaccttacagctccaaatctcaaaaaatgggattcatcacaaagcaaggacacagtgagcagagatggagtcaacaccttttcacaaaatttaacaatcatcatcgatatgcacagccttcatgtgtagtgtatgctcccagctacagctgtagttacccaatctcaaagcaagtaaacagcaagattccacactagctcttaactggccaagctatatttctataactagaattgctatttgtggatttccataagttataataacacgataagaccactttatccatgtattctagtgactttttcttcctatagcaaaaagaaaaatacatctttcaccatttacaagtacaaatttcaaggagaaattttaaaaggagagtaacaaactgtcctgagttgcagcaagactcctgagagttccatttcctgggccctctgctgcctgtttttggcattgaacccaggaatcttttctaaagcacacagaaatcttgcaaaagaggccatttctagttaggcttttgtccaactgtctagttaaataaattaaattcttagattacaaaatgtgcttcaaaggtttaacaaattgaaatgtccttaagtatttcaaataaattaaggaagaattcccattcccatagtcttctactttcctcttccacacctatgatgaatgtcctgaaaagaataaacccaggtaaatttttggcgagtaattgttttaaatgatgacaaaacttagttgcatcatggtaatcatttcttttgcttattgggtagcattaagtacaaaccttagtttgtaaaactatatgttttactctcttaatattttaaacctcaactatcttaataggaattgttactatgttgttttcttaggtttagagaggcaaattgattgctgatcaatcattaattgactattgggctaatataaaactaatatttttctcttaaataataatggcatcttttcacattgcatgccttaaaacccttacctgagaatacatcctggtgaaagtaaaatgttattcctcacatacagcaactgtgtaaagtgtggtgcaattatctgatttgccagcagtggacactgttactctagttatcaccatcgagtaactagagaaaagcctgtttagtgtctcaggaaatgccttctccttattcccttagacagagcagaagcctgtaacataggcaactattctggaaaaacaacaaaataaattctagaaaaaaaatactagtgttattcttgaacatgaaaatattattaagaaataatttttcacagttaaaaatttagtactcatttgattttgtctttttaatttatggaacagatctattagctgcagaatgtccaatcatcatcattctccagtgtatcttatgcatctgcaaattatatctctctgagaaaacactgacaatcagtgaaagaaacaaactgagctaaaaagcagtggtccgcatcagttctggcttcctaggaactagttctgcaattctgggcagattatcattttactctgatcttagtcatctcctgtctgtaaaagaagtagctaaactagaaaatggccaagaactcctacactggtgtctgtgtttctatgactctctcaggatagactagagctaaaagcctttgcttcacttgtataatcaggtaaggtgttaattgtttaatctctagccagaaaataactatataaaacagctcttccttccttaatgaggccagaagcataggcttcagccctcagggttggcattatggaaatcaatcggcagagctaatgaaaaccaggcagtgggctcaaaatagaacccctcttaatccccactttctgccctgcacagcagggggcctcagcttcccatagccatggtgtttactttgtgtcaagcaagtattagtattaatcccattttagagatgaggaaactgaagtacagaatgctaataactagtccatggataacaactagtaaatgtaggatctgaatcttgtaactaggcagtctagctggaaagcctatactcttgaaactactaggttcactcttccgggttccatactgactctcagtataatactctcctgttttagacttaaccgtgtgtctgctaccatctactagattgtgaattgcttcagagtagaaaaccagagaggcatggtcgaaagacatggatataaaccagtggttctcaactccaagtgattgccacccccaggggtaatttggcaaaatctaaagacagtttttgttgtcacaagggggaagaggtgttactgacatctagttggtagaagccagagatgctgctaaacattctacaaggctcaagacagcccctcacaacaaagtattatccaggtctaaacatcaattgttgcaggggttgagaaaagctgctgtagaataagagaagctgggtttgaaccccgactctgccacttacccgctgcatgcattcagacacttgcacaaactccgtaagcctctcaatctcctcccttaaaaatggcaaaaggctgggtgcagtggctcacgcctgtaatcccagcactttgggaggccgagacaggcggatcacctgagttcaggagtttgagaccagcctgaccaacatggagaatccctgtctctacttaaaaaaaaaaaaaaatatatatatatatatattcacaaaattagccaggtgtggtggcgcatgcctgtaatcccaggtactggggaggctgaggcaggagaatcacttgaacccaggaggcggggttgtggtgagccgagatagcaccattgcactccagcctgggcaagagtgaaactccgtctcaaaaaaaaaaaaaaaacaaaaaaaaaacatggtaaaaaacaaaaccactttcagcagacaattatggttgtgaggtggattaaatgcttttagactgtgaagttgtctgcatattttcaaagacagtgccatactgcagaaagagcagaagttttatggccaaagaggcatgaatacttaaactttccaagcccagttttctttatctattagaaaagaggaatggatagggaatttctactttatggtcttcctcaggattaaatgaagtaatgcaaagattatatcattgtaatgtttgtcacagaacacatccctaaaagtgattatttctgtcctccaaagtatttacatattatttttttcttttggtcaatcttgtatgcaaactccactctctgcaaacaacattccttccttcccaaaccaaatccaattgtgttctattatctaaaactttatttattaaaacagatgtcaggttagatctgacttgagggtcatagtttgccaatccctgagttggactatcaaatacgtattaaagattaaaacttaattacaatattaaagctcactatttatacccatgttcattgcagtattattcataatagccaaaacgtgggagcaacccaaatgtccataaaagatgaatggataaacaaaatgtagtatacacaggcaaatcaatattactcagccctagaaagaaaggaaattctgactcatgctacagcatgaatgaactttgaggacattatgctaagtggaataagccagtcacaatagaacaaatattgaatgattccccctttataaggtacctaacatagccaaattgataggtacagacagtagtatggtggttgccagaggatggagtggggagggagtggagagtaagtgtttaatgggttcagagttttggttttgcaacatgaagaaaagttctagagatgaatggctgtgatggttgcaagacaatgtgaatgtacttagcatcataaaactgtacacttaaaaatggttacaggccaggcgcggtggctcacgcctgtaatcccagcgctttgggaggccgaggcagcaggtggatcacctgaggtcaggtgttcgagaccagcgtgaccaacatggagaaaccccatctctactaaaaatacaaaattatctgggtgtggtggcgcatgactgtaatcccagctacttgggaggctgaggcaggagaatcacttgaaccccacaggcggaggttgcagtgagccaagatcgtgccattgcactccagcctgggcaacaagagtgaaactccatcccaaaaaaataatggttacaatattaaattatgcatgttttaacacaattttaagaaaaaaataattgaataaaagggcaaaaaataatccaaacacgtaagtcttcacttgctctactcctgttgtattttatatgaactgttagaacagttagccatacacaattgctgctggagttgggggagacctctatcttggcagggatgctggtggaccgtggcaagaggctgaacctctgggcctgcacctcggcctgataaagcaactcttgtgtctgctactgccctcccatggtcaccccatattacaaacactgcctcagcagcctgtttcccttctgccttccttctgtctgcactcccacaaaaccagggacagcatcctcatccctacctcccactgcattagcagtgggtattcctgacctgccaaagcccaggcagctctgctgctgtgacacggcacacttttcaacacggggaggaaatggaaggatgcagtgtttaacgcccacggagcattatggcactgttgccctccatggtggcatgggcaagatgacctttaattgacctcaagtctcattctcttatttatagactgttttatacgtgggtcactagggaatttattctgtctcccatccctacactctgaatcatcgtgaagccttaatcaattcttaatcaaaaatcaattctttcatttttttcagtctctaagaaagaattctcatttcccttattcaaactaatatccatgctaatcttttataccttggatttaaagtcaccttgggttggggcaacagggttctcactcgtgtttaagatctccttatttcagcctcatacgatcaaagggcagtcttccccttttctctttcaccctcaggactcccatgccttggagctgactcttccaggcagtttccacagatctgcagtcctgctctgccactgtctctctgttgtccccacatctacccaacgtcctgttgtattgcccttctgatttcatttaataaaagcagctgcttctccatcaaaaaaaaaaaaaaaaaaaaagaggctgagtcccaagtccccctctagcagtttggatgttttttgataacagaaattccaaatcaaactgtcttaaacaataagaaaatgtattatttaacatgtagtaactccaaaggcaatgcagtccatatggttgatccagtagttccactatgttctcaaatatcacccttctggtctgtccatttccctgttctgccatctgtggagttagtttttcctcctcaggctaacagtaaaatgactacagcaacttctggcaccatgaacagttgctgtaacatccaggaggaaaacagattgtctctcacagggactactttttaagaatacaaactcttttctccaaagtcctccaagttcactgtccaggactaggtcacaaggctgatgttaagtctgtcactggtggattacattagataaattcaatggaggcttgtttctggatttgggaggtaggatcatttcatgaggcacttggctgcctgattttaatagtttttataatattgaacccagtgaggttattatatttttatatctagaggaagaactctttagtgccccgagtttttatccacttaatgctgagattctctgataatgcaatcctaaagataaatttttctttaacatgagttgtttctgacatttctcaaaagaagacatacaagtggctaggaaacttatgaaaaaaatgctcattatcactatcagagaaatgcaaatcaagaccacaatgagataccatctcactccagtcagaactattattaaaaagtcaacaaataacagatgttggcgaggctgcagagcaaaaggaatgcttatacactgttggtgggaatataaattagttcagccactgtggaaagcagcttggcgatttctctaagaacttaaaacagatctaccatttgacacaacaatcccattactgagtatacacccaaaggaaaataaattgttctatgaaaaagacacatgcatttgtatgttcatcacagtgctattcacagtagcaaagacatggaataaaatgtaggtgcccatcaataatggattggattagaaaaaaatgtgatacatatataccatggaatactatacagccataaaaaagaatgaaatcatgtcctttgcagcaacatggatgcagctagaggccattattctaagtgaattaatgcaagagcagaaaaccaaataccacatgtcttcacctataagtgggagctaaccattgagtacacatgggcaaaaagatgggaacaacacacagtggggactactagagggggtagggagggatcatggattgaaaagctacctactgggtactcttcccactacataggtgacaggatccataccccaaacctcagcatcattcaatgtactcatgtaacaaacctgtacatgtaccccttatgtctaaaataaaatttgaagaaaaaaattgttgtttccaaaaattaaagcaatatgtaagaagcaataataatatgtagaacaatttaatggtagaaacaagacttttaaaaacagaccaattctttcaggacaaataaagaatattgattcaaataaaatttaaagtttcatgttttaaagaaagaaaaactttgctgagaggtgatggtatccaagcaggccatttgaatggatttctactaccattttgtcttttgtcaattcttagcgttgtagtcaaaagatgttttcgatatgctaaaacttagcaatggtacatagtaaatgctaaggtgaagcaaagacatttggtcatatctttgtagggcatattatatgttacttttggagtttattttttattagtagcaattagtcatccacatgtattttgaaatagctcaggtttccttgcccaatatatagcatgccaaatgcaaattcagaattatgttgttaaagaattctataggaaccactgaaaagacagaagagaaagagggagatagaagagggaatagatgtggttgaaataggtatactacacatatgtaacaaacctgcacgttgtgcacatgtaccctagaacttaaagtataataaaaaaatatatatatatatatataaagaaacaagtatactacattttcactatgggaagagcagacttctaggcttctctaaagaagtcagcttaatcacaaatgcaaatattaaaatgagctcattcgtaatgatagtaaatgggttcccaacacataagcttcccaatacataatgcttcccaatacataagcttcccaatacataatgacaaagaagcaaaaatgagtggtaaataaaaaggtttttttaattatgaaaaaagaacaaataaaaaggaagtttggcacagaatgttaacatttgccaaagttttttaaaataaatacaatcatcaaacgtttttagaataggggaaatgctagctcaactttgccttgaattttttaaatacaaacataatcttcctgcaattttgcaaaagtttttttttctgtcttattttttaaaatcactgttccatactcttaagcccaattcaagtgactatgatggtctcatttgtacgaatttgaaggtttggagaaaatattgatttcctatctcttttccagttgtatgggtgtgttgggggctggggagatgggcagcaacaggaactgggtgatgaactacaagataatggcacaaaccgctttcaccagtggtttgtccattttacgtttaggttaatatttctaaatatgtgcctcggttttctctctatgaaatggtcaataaactgcattttgtggagattgaaatctgaccaaaatcgaaaaggtggcccaatatttgtccctaccgggaacctttcctggtaataactcaaaattctgtcctactttctaatgcgatcactgcccagtgtggacttccatggtgacacagttctgatgactactgcttggagtcctttctgtctagaaagttgctttcctattcttcctgagtgcttctcacagctgcttggctgcggaactgcagaaacctgaggggctgaacgagtggttctttggagccactggggtactatttagtaaatggatgccatttgcagataccattaatttggtaagtgctgaaaagtaaacagaaaagaaattcagtaaaggcacattggttcttagacatgcatgccctttagttactgtactatggggatttaagagggctcatgcatattcccaaatgcctatattttccccagaaagatgttaactcactgaaaaagagctaaagaagagttagtaaaatatttcaaattgcttgctgtgggatacactaagttttcaccaagcagcattgcatccatttttgttgagagaacctcaatctcattcattgtggcaatatgctcaactccagggaatgaaacacagctgctctaagccaaccatggctaacccacttcccttttctagaaattcatttcccctgctttccttgaagatatgtgtagctattggacccagttgctttttaaagggaggtcttgggcaggtggcaggaagtagggtgtggtaggagaggtgatgaggcaagttttctttttctttttctttttttttcattttcctccttgataaactgacaatccatttctgtctggcctctttctgtatgggacatccttataagcaagagatgctcagagctatggaagtcatcttgtacctaccagatgcccaataagaacagaaaagcctgggtttctaagtcattaaagagccactcaacgagtctataatgacctctctccagacattccaagttacacaaagaatgaaaaacccaacataaatttctaaactaagctactagtagttggctactctgttacatgtagctgaatgtatcctaattgatacgcttaggtattttctaggtatgaataaaaagcaacattagttatccttaactcaggacctccatggacagctatacatgattgtgttgatttgtgttattttaatcttcttcattagttagtaaagtccttagtgatagaaagcatgccttttactgtcttttaatatcctgtctctaaacatgacacctagagtgagatgcttcagaaatactcaattaaaatttgcataactgtcaactcagtaatgtcaaacaacttaggatcactgaaaccagcctctcaaagatatctgtttgtgtagtcacaacttcaaaatgccttttcgttcaaagggaaaagctagttaagccaggcctttgctctcagcaggttttgcatttgaatgccaaatttaaaaatgtgatcatcctattaaacagaaaacctaatcatgtttttttttttttttttttgtctttaaggagttttcaagctaataggagaagaacaggtttgcagagttaaaaagaaaatggtagttcaagtggtcaaattaaaaaatggcaagataccacaaacaaaaaggggttactttttcctgaaatgcttacttactctttaaagaaaagtgttggaaagtgctccaaagagcaggtaggtttttggtacgtaaaactactagtagcttagtttagaaatctctgttgggtttttggtttttgggttaatgtggggtgaataatgagaattctaactaaagaaaatagctagagctacagcatggatttttggtgaaatttatactacaaaagtaatgcagtcagataaatggctatttgacatcatatcattgaagattctataaatcaggctaagaacgttgtcctttattaaggaacaaacatggaaaattgcctaaggtttgtaatcaaagaatgatgttcatatgatttgatgcatgttgtagaaggttgcactatgaaagaggtattattagcaatacgggcacaagttcagaggttttaccagtctaagagggtgatgaaagtctaagcatagagcatggcagtggaaagaggaagagaaataatttaatccctttattttttttcagttttctagaaccaattataatctgtaaattggacaattttaggaattttattaagaagcaagtcattgattatattaaatagattctagaagtttggaaacattaaggaacatggtaaaagaattagactcaaattatatttcccaagaaaattaatattccttgtttctttaaaagggatgaatttcaacattatttgtcttgtttatgactacttgagcttgttgattttcaaactagttgatttcaagccttcagattcaccaatttagaatctgatgtcattctcaaataataaacaggattttcacaagaattccaaattggaatctaattaataattatgtggccatgtcctcacagcatacagtgcagcagcatcatcatttatcattcttatggttaataataacattaataaaccagaccatcctcttttcaatccttaaatttgttaatactggaaggagaatactacatcatattcaatttcttggaatcacctatcaaatatttgagtatggccaatatatcaactctagtgtttacagaattttccaatcatattaacaaaatgaccccattgtgtttaatactttgtgctttataaatgtgatacaatttatttaattaaacccagtcaacatttgtcaagtgcctactattttaaatgctggaagatattttgttcatatttttttttcattttgtctttgaaataagcatccaaactatgcattattatcccacttcatagataagaatatgaaggataagaagatgacttgtctacaatcttgcaagagtacagtaggtcttggaaaggattccaagtctttccactgcaaattcaaggctggcttgtttaccatacactatgatcatcagaagtttccctttgttatacggcatgaagttacattttaaaatgaggacttctctagatcctgtttttcttttacacctgtcttcataactgcttctttgtccgtttttggctacttttttttttttctgtctttattgtctgaaagaaaaaaagtcccaagcaaaaaatgttttgtctgaggtgattagtttgttgcataagaataataaatctgaatgatgaaacgacacaattggcaaaaataactttcctgtggctgtttccataggtagttaagggcatcacatcaagtacctgccttcatagagctctttttttccctgacatggcaaagaacaggcaaatatcacctatcaaagaaacctggcaccaaaataaacttcatctggactattcctaaaccacttctgatgaatggatcaacataaaagttaaaaaatgtcttggaggtcaggtgtggtggcccacgcctttaatcccagcactttaggaggccaaggcaggcggattacctgaagtcaggagtttgagactagcctgaccaacatggtgaaactccgtctctactaaaaatacaaaaaaaattagctgggcatggtggtaggcgcctgtgatcctagctactcaggagactgaggctggagaattgctcgaacccgggaggtagaggttgcagtgagccaagattgcaccactgcactccaacctgggtgacaagagtgagactccatctctaaataaataaataaactgtcttggaaagttgtgtagatagcccattttttaccctccctctactatttggccagagttgctttattactttacaatctcagaagcgtcaacagttgttctatgtcattttgagaagtttgtcaacatctcagtcctaccttcacctgttctgtttgcacagactgaaaaccatcttttcttcaggttcatctgtgcaccaacggttttatattcttctgacttttttctgtttatcttttcctttttaattaattccaccacctgcacacagttgtcaactctctctactcagctgaacaccctgagtgtttaacccagcaggggatctgggagctgttctgctaggacagagatgaacaaatgtggcagcaaagtgataggtggcttctggactcgaacccaatgtcatattcactcctggaccactcttctctaaaggttctttctactgcttgaaatgttacttggtcaactgctacctttctgtatgtgtatatatatatgtgtgtgtgtgtatatatatatatatataatttttattttttttttttgagatggagttttgctcttgttgcccaggctggagtacaatggcgcaatcttggctcactgcaacctctgcctccccggttcaagcgattctcctgcctcagcctcccaagtagctgggattacaggcacgtgccaacacggctggctaattttgtatttttagtagagacggggtttcaccatgttgatcaggctggtcatgaactcctgacctcaggtgatccacccacctcggcctctcaaagtgctggggttacaggagtgagtcaccgtgcccggccagctttctagatttttaccaacctattactacaaattttagatcaaagcatccatcaccctctgtctatgtctcaacaaaaaagattaattgaagttgagggaataactagagattgcttgaacattgtctgcagtctaaagtttctttcattacagcactgtgggcttgacagaaaactgtccttctaaatttttgaagaagcaggtaaaagcaaggtcggattaggttttactgctccatggtcagtgttgagaacattcccatagaactaaatgcgtcaactaatcaccagagaagccgagatgtcagactcaactctgtaacgtcaaaaaacctgaccaggcgtgaccttgacttgttctgttcagtaaaattagtccctgaagagttatggagcatcaacaatgtatgaggcactgggcggggtgggggggtggtaactgaatttgatgcaataactagagcctgctcaaataatgtccctggtctaaagttttatttcattgtagcactatgggcttgagagaagacaggccctcttctaaatttttgaagaaacacgtaaaagcaaggccatgttaggatttactgcccaatggtcagtattgagaacattcctttatgcttgcaagaagttaaaaataaagatctgagacacattatggttttcatccttctgttggttgttaacctctttcttcaataaaaggctaagggaaagtccaatatataaaacctgtgtaggctgagctatgctcccatggcccctgagggcactcggcagaagacagttctgaattcactgaaagtgtgtgtgtgtgtgtgtgtgtgcttgtgcacgagtgtgtgcacatgcacagccataagataagcaaacattagaggtaacaaaatagcagtataagttctagcagctatgagaattcagagactgaaggaaatcagtattggaagtggctgttaaacatctcagctaacagatttagcctggaggagagtgtcttagtcaggaggaatagatgaaataatatggtctctatggactaataatcccccattctccaacttaaatctgaaatgaagactatttccaaaataaaaattagacagaaactcttgctggggcttttaccaactgttaggttgtttttggttcttttatttgaacaaagctgccacctgtactgaggcctctaactcttgaatagtgtggatgggcgcattcccagctggagactgtacgtagatctagcaagccagaatgagctatgatcactgcagcctgaacactttcattttagttgtctgaaaattttagcaatacaccaaagttgttttctaaatggaactcagttttcaggaatctctttgaactagtaggcaatttcctttaaatcgttctacactgcaattgggtttagcttctaatgtggcttcaatgattctcacaaccagcaggcctcctgccttcatgagtggggcaatgatttgtggcttgtgtcagccatggaaaagctggtttcttgtgaaagtacaaagggacacaatttgtgatgcaaggaaacaagctcacaaagacataaaaattagctttccacatgatttattctactgcttcatgtcaataaaatgggaaaatggtttaaaaatattataaaatgcataggtaggtaggtgtcaaagttatagatgacagcattggatgtgcgtgacacgccaccttcacatgcaagtctcctgaggggaagggtgagacatgagtgtccaatactgaccagaaactatgtggacagctgatttcaatggtattccctatggtaaaattactatggtaacatttatgtttcttaacagattgatctggaatcaagacctttgctccaacataaaagggaagagacacttgatgaagaaagcagttccatggataatccaagagagctatttaccatccaagttaccttttcttcattaaccgaattttttaaaagataaatctcagatgggtacataaaccaaagacaattgctgcctcgtgttacctagacaaagcagaggggcaagaaacaagtcccacgttttcactttcacttttcatttaagtatttggcaagttggttcactggtgaagactcagagagaaatataaggaagaaacaaagtggtctataaaaatattgtcacttcatcatctcaaaatatttcctgcaacctctgcaactctctgaggaagcaagtcaattctactagtttcccaggcatgaggcatgctgcatgaaaaatctctacccaagtaaagaaaatggcccattggttcacatattcatgtgataaattgcactgttaatatgaatattaaactttagatagatagatacagatacagatagacggataacatctctctttacataaaacacacttgacattgcgtattatcatgtaactcctctccaattttagattacactatcgtattatagtggtgaataatttttaagtcaaatagaaaaatacctgaatttgcccaacatctatattaggaaatgatcattccatgaggtgaaatatacaaggcctggaatgtatcgggagactggtagtttattgctggcttcctcactctctggctagattctctggaaaaatttgtcttagttctgagcctcggttctcaacaatatacaaacaacaataacgatggacctaaatatctgctggggttaatgaggtaaaaatataatatccacaagctatttaagtagtaacatatcatatagaataacttttataactaaggtttgatttgcaaaaggagtcacagttggtggtctttaaatgcaaagctccctatcttcagatattattcactttaccaaaaaaaaaaaaaaagaaaaagtaaaagtatttactgaaaatcttcaagactataaagaaatgtggctgagatgctcccaggaaagaagaaaaagagacgtccttcctttgtttttgtttttttctctctctctttcttatgtatagatttcattatttcattttagaggtagaaaattaaactcttactaccatgacacatttaattgagagaataatgagaccatagctaaatataatcaatatattcaagataatgtatagaaatttaatcaagaatctgcttcatgaatgcagatgctttccaggatataaagatactgaacttcaaggagggcctatcttcccagtgtttcactccagcaactcaaatttgcattgagatatgtgaagtataatacaaaacagaatatacaatacagatatatgaatcaacatcccttgaatgctgcacttttcttgtctaatttccaaacttcggtgtgtttctttcagtgtaaagtaaaaaagtaagtaaatttactaaggcttttcttttggggcaagaaaagcaggtgagagtagaagaaaggaataaagagacactatatatgttagacaaagaggaataagacgaagaaaatacagaaccttaggagaaactgaaccagagctcacagagtattgaatagtcagcaaactaagtaaatgcaaagacaaacagctttgctattcaaagtatggtccccagaccaacagcattgccattggtcagtaacttgttagaaacacaaattctcgatcttgttcaacccaccaaatcagactccccattttaacaagctttccaagtgactcatatgcatattagtatttgagcagatctaactcagagtcatccattttggcctattatgattagagctcatcttttccatccaccctaatttctcataaccagaaaatcatttcccataggcaatctttatccatttacacaggcctactatttgcaaacacatatgagactcaactctagaggatgtgtggcatgacttaaggaaaccattgtcactctcttaatccacgttatatatgatcacatgtgtgttcaaaggcagttacttcttatccatctgactatgacaagaaaaaaaaattggtgaagaacatggaatgaaagggccaaatgggtccaaaataatgaactaaaatagagtaaataaatatagtaaatagtataggaaaataacgatttaaaatataataaaatgtactataaattacagtaaataaaacacattgtctatggcaaacgtgttaacatctgtaaacaactttcacctgaatacctaattgttggaagtgatgccttcctcctactcagctttcagagaacttgagagctttcctaaactcagagagcttctctaaagcatgttctgtgtctgtgaggttggcaatttataaaggaaggtgtttctattcctccagaagcaatgctctgaatgaccttggacagaagttaaccaaaagtgacccatgattggcagcttccagtgttggcagggaatctgaagatgttaagcatgtaggagtgccagcccctggcaaaattgtgaactcatttcatcactcctttactttcctttacttcctcctgtcccacttatgagtccaaagcccttgcacatcctcctggaccccagtggtcctgctctccattcagtctggtttaggcctccttgcttttctgaactgttgcaatggctctcctggcttgtgttctctctacactccacttgctgctcttcaaagcacaataaagtcagaaggtattaattcttatctcacaagtcttcgactctgactacatatagaatactactataagtcttgacagagaaaaaaagagcatccctgtcatttagaagccagcctcacactcagatattctcttgtgtataaacaatctcagaacatatgcacctcagataaaagtcactctgagaccataacaaagtgagacaaagcaagggtattttataacgttgcctaagcaatgacaaaatcaaggtcactgcgcctccaccaaaataccaaacatcccctcttggcataacataagcaattgctatggctttatcaattgcatttctatcctcaatgtagtcactcctccctatggataagacttattgagatacacaatcagagatttgccattactctctgacagcattcagaacacacctccccaccccttagaccaccctgaaattacccaagcaaaccttcaatcttctaatgcagcagatgacttcaggatgactgtttcactgcagatcatcaggcattatctagattctcataaggagtgcacaacctagatccctcgcatgcacagttcacaatagggttagtgttctatgagaatcttgtgccaccctgatctgacaggaggtggagctccggcggtcatgctcctcagccaccactcacttcctgctgtgcagcttggttactaacaggccatcagggttggaacctctgctctaatagtttccttctagcaccctcctaccgagataccccacagttgcccatggtgtgtgttctctctcgctgcaatgtgtagtaacaaaatttgtttaactacaggtatattactggtggtctttgggtgaaaagcattaacaattcagtgtcatcttgaatgccctccctgactttgtttcacaactttcagtcgcatatttgtttcattaaactacttgtatttcctcaacatgcactgtattttcacaatgctgcacgtgctgagctgttattccaacttggagtttctttcctctgactcccagctactgaaaccctgttcacctttcaaagctcaggttaaattccacaagcaaatttctctgatttctctggtcaaagcctattactttcttctgagtgttttgttcatactctatttgacatttactttatttgatcttgcactatagtgatttgtattcttctttacttcttcactcgctatagaagctccatgagaattccagtcatgcttcatccatcctctcctttctgtggtgattgcctggtctctgctcggtatataacacaattttaataaatatttgctaaattgaatctggagatgaagtctaaaactgctcagttaaagttgaaaactttgagaggtgtctgtaaattaatttaataatctcagcttaaccatttaaagcttttcatctatgttatagtaacgaacatatttattgaataaaatgtcaaattatcaaactgtttgttgactaacacaaatcagtttcacttgcctcaacctgaatatttttattattttcaattcagcaattactaaaagtggtattaagcatataagctggccttgagaattttctttaaataaatgtttactttgtctcctttcttaattaagttctgggacatatgggcagtgtgcgcatgtttgttacataggtaaacatgtcctatggtggtttgctgcacctataatccatcacctaggtattaagcccagcatgcattagctatttttcctgatgctctccctcccccagcatactccacctgacaggccccaatgtgtgatctgttcctctccatgtgtccacatgttctcattgttcagcacccacttataagtgaaaacatgtggtgtttggttttctgctgaggataatggcttctagctccatccatgtccctgcaaaggacatgatcccattcctttttatggctgcaaagttttccatagtgtatatgtaccacattttctttatctagtccatcactgatgggcatttaggttgattccatgcctttgctattgtgaatagggctgcaatgaacatacacgtatatatatctttacaatagaatgatttatagtccttcgggtgtatatccagtaatgggattgccaggtcaaacggtatttctggttctaggtctttggggaatcaccacactgtcttctacaatggttgaactaatgtacattcccaccaacagggtaaaagtattcctatttctcctcagcattgtcagcatctgctgtttcttgactttttaataatcgtcattctgactggagtgagatggtatctcattgtggttttgatttgcatttctttaatgatcgttgatgtttagctttttttcataggtttgttggcaggataaatgtcttcttttgagaagtgtctgttcatatcttttgcccattttttaatgggatttttttgtagtaaatttgtttaagttccttgtacattctggatattagacttttgtcaggtggataaattgcaaaagctctctcccattctgtaggttgtatattcactctgatgacagtttctttcactgtgcagaagctcttaagtttaactagatcccatgtgtcaattttttgcttttgttgccattgctttcaacattttcatcatgaaatctttgtccatgcatatgtcctgaatggtactgcctagattttcttctagggtttttatagttttgggttttgcatttaagtctttaaaccatcttgaggtaatttttgtaatacatgtaaggaagaggtccagtttcaattttctgcaaaagtctagtcaattttcccagaaccatttattagatagggaattctttccccattgcttgtttttgtcaggcttgttgaagatcaggtggttgtaggtgtctggtcttatttctgagttctctattctgttccattggtctgtgatatgctttggctctgtccccacccaaatctcatcttgtagttctcataatacccatatgttatgggagcaacctggtgggagctaattgaatcatggggacggttacctccatgctgttctcatgatagtgaatgaggtgtcaggagatctaatggttttatgagggccttttccccttttgctcagcacttctccttgctgccaccatgtgaagaaggatgtgtttgcttccccttctggaatcattataagtttcctgaggcctccccagtcctgtgaaactgtgagtcaattaaacctctttcctttataaattatccagtctcaagtatttcttcatagcagtgtgagaatggactaatacagtctatgtatctggtttttgtaccagtactatgctgttttggttactgtagcctcatagtatggtttgaagttgggtagtgtgatgcctccagctttgttctatttgcttaggattgtcttgtttatacaggcttttttttggctccatatgaattttaaaataatggttttaattctgtgaagaatgtcaatggtagtttaatgggtatagcattgaatctataaattactttgggcattatggccattttcaagatattgattcttactaaccatgagcatgaaatgtttttacatttgtgtcctctctgatttccttgagcagtggtttgttgctctccttgaagaggtgcttcacttcccttgctagatgtattcctaggtatttgattctctttgtagcaattgtgaatgggagttcattcatgatttgactctctgtttgtctgttgttggtgtataggaatgcttatgatttttgcacattgattttgtatcctgtctctcttttcttaatcagattataattttgatataatattaggaaatgtaaactgaattaataggtcctaataacccatagaatgactaaagttgtgatcaaaaccaaaggcactcaagggaatatcagaaaaaaaacactattgaaaaatagacataagataatttgtcataaagccatttaggataaaataaagttcattttcactgaaattgtaaaataaattatacagaactctactacactttatgaatagcttcagttaaattttttatattttgaatataaaatttgtgataacttcatgacagttgtatgcaacatgtttatttttatacatgtattgtttggagactaaatagcacaataatttagagtactgcatccagcttgctgctccgtttccctatctgaaaagcagtggtgataagagcccctaactttgtcctttgccgtgaagattaagtgaataaatgtaaactgcttgcacctgcaccttgcacatgggaagtggaattgagtgttaactgttattactatatttcatcttccgtagaactgccatagcttccttcctggctttctttctttggatatgatcatgcttcttccatttaaaatcattgaaagtctcccgttactggcaggatcaagttccatggcattctcatgccattcaatcctgttcactctcaactgctgacactcagcaaattttattttaatccaaatacttaaggagagaatgaaatgttggtttcttttctaaggaccattgctccaaccaacctacatctgacgattgcttcgtgttttcacacttgtgactcttctattctagaaatgttaattcccccattttatttatctagggagtgccccaccctttcttctttctttgttcaaatttcagttgttttggctgtattctctgactctactagatatactgagttgctccatttccttgattctccaccttctacatgcctccaaatggtccctctaattctgacatttgtggggcactcattcacccttttttccccctatgtcacaaactaatgctcattcccatccttaactgtgccccactctgccggaagttccttgtttttctaagatacagtagaaatcaaaatatgcaatagctcttcattttctacacataaatgcatgagctcctgaccatggctttcaaggatatccatgatatgaatgcatttatattctgtcacccttctgtatggataaacttgttagtagccatgttggtttcagtagcatcattgaactcattctgtgttcacaatgaattactttattattatccaacaaagatttaatcaacaaatactactttccatatactgtgttagtcatgggagatacagagacatttccagttgtagaaaatttgagattatgaggatttttaagtacttagtataaggcaggaatgtcataaattcaattttataggaaaacagtgtaatgtactcagacaagaggagttgaaacactttgtgtgaggaaagacaacatacatgtaataaaaagatataataataaatgctgaagtggttttcaaacatgatttatttttaaaccacaaagtcataagggaatttatcatgaaacatgaccatcttaaaaccacgattttctcagcaagatcactgaaggtaaaagttggatgtttggcttttgacatttatatacagtattgaataatcaagaaagttcatttcagttcaatgtattaaatatattaaattaagggtttcccctctgtggataaattattcctatcccaatgactttttagttgtaaagatttttttttaacctgggtatttaaaagttttcatgtattgtttgacaaacatatattatttatactaataaatgtgtatccccacaactggatacgaaatgcaaacaggttcctaaggatgatgtttaatgaaaacttgccaaacaggatttctgatctatgcattctgggagctgggtctatccagcccatgaagaacagcctgctttgcaagggctgaggacttcaatcctgtcttgtgacattgcctgacacccgtttttagagcctcatcattgtgatatcacacaacatgaacaaagaaatatgatgatataagccatcatccagagagtatcactgagcccagagaaagacttgagactcttccatgtgctggtggcccaaaaagtaccatgttaataataaaaataattactctttagatggcatcttctctgctatagttctccttcttttctagcaattaaagaatagtatttccctttccttttctactttcattttttttctttcttttcaatggcaagcttcataagccaatgtctatcttttattcaggatacaaatagttgtgcactttccctgatagagaaactcccaatagctatggttagctttctgttttcatatttagcacattctcattctggttctccttctggcttttgtgcatattatctccttcaaaaccttctcttttatggccaggcatagtgggtcatgcctgtaatcccagcactttgggagggcaaggcaggcaaaccacttgaggtcaggagttcaaaatccgcctggccaacatggggagacccccttgtctactaaaaatacagaaaaaaaaattagctgggcgaggtgggaggcacccgtaatcccagctactcgaggggctgaggcatgagaattgcttgaatccagcaggcagaggttgcagtcagccgagatcaagtcactgcactccagcctgggtgagagagcaagactgtctaaaaaaaaaaaaaaaacctcctcttgtggttaactacagagtgaagttattgcaaacgctacacatgccttcacaggtggtaagctgcacaaagatctccatgagtcaatgctatgtgaagaactgcatggcagaataacttcacagtctgctcacttactatataaaatgatgaaaaatttaaatgttgtcaaatttgaccaaacatcaaatataaaaaaaattcttatctgacttggagtttattttaaaaattttaataactaagggattaagaacaactgacagaatcatcagaggctctgcctttaagtcttgacaatttggcaaattttattttaatccaaatacttaaggagagaataaaacgttgttttccaggatctaatgttaggatgaatgtgagatcctaaaaaggattttgtgttagtttttttttttttgtaagtaacatgaaagaaaaaaccaaaaatctaaagaaaaaaagatggataggagaagtcaatttactttaagtagagaaaaaagaatactgaaaatataaggcaatcaattttaaggaactgacttaaccccaggatgaggttacagcaagtttccttcatttaacacagtccagtccaaacatttttcatgggcacaactgaaaagtgtcactccataaagaaaaaataattggtaattttatacttttataagaagtcagccagatgtatccacacatcaccgtcaccagaaccacaatcaacttttctattcctgtacctaaatttttctgagtgcttaaatatatccaacaacagaattaaggggaagggaaatgttctggattgaattgtgcccactccctaaaaaatgataagttgaagttttaaactccattttctcagactgtaagcttatttgaaaacaggttcttcacaaaggtaagtgggttgaaatgaggtcatcagggtgggctctattgccatataactggtgttcttataaaaatgggaaatttagacacagagaaaacacacttatgcaaaaagaacaccatgagaagatgaaggcagaaattggggtgatgatttacgagacaaagaatatcaaggattgccaaagaccaatggccacttgcagaaactaggaagaggcaaatacagactctggagggagcatggttctgcagaaaccttgattttggactcagattccagaactgttagagaataaatcttgtggttttttttgtttttgtttttgtttttttgagacagagtctcgctctgtcgcccaggctggaatgcagtggtgccatctcgcctcactgcaacctccgcctcccaggttcaagcaattctccttcctcagcctcctgagtagctgggattacaggtgcccaccaccacgcccagctaatttttgtatttttagtagagatggggtttcaccatgttggtcaggctggtctcgaacccctgacctcatgatccacccacctcggcctccctaagtgctgggattacaggcgtcagccaccgcgcctggccaaatcattgtgtttaaaccactcagttgttgatgctttcttagggacgacctagaaatacagaagacagaaggatcgtgagacagttcgttattgtttggcgaactgtagctggactccggctcatataatgaaagaaacttaaaggaatgcctaagaatattactctacgagtgtaagaatttggtttgtcagtttaaactgatatcagcagttacctaaaccaagttttttaataagaacatccaggactgacataatgctattttgttcagctctttgaaaaacagcacaaagctagcatctctgtgacattcattaggttctgtagcacaacatcccagaggatgcttttgggcttcctgcatctcagtcacttagaatgaaccttaaaattcagatttttcaaggctcatcccaaacctaccgaatcaaagtgacttcttctgttgagtaagaatgtctgagggtggagtgttctattgagtcagaatgtctaaagtcatttgtaaactaatctcagatagataatccttgtatacattaagagaaccactgtcctatgtttacttgactgttttcataatgttttccttctgattgtggtaaagttaaaattgttttgagctaaatgtgtaccaatatcagtttctgcagtataaacaaagcttgattatttcaaggtcatgcagtgagaacatttatgctgtgtgggaggaacctctaattccttctaatgaataacacaagcaaaatacaagaaaaacaatgcaaacactggaaggcataagtaagcacatctgtttttaaatgttctcctctcattgattcctctaatcaaggtgcttctttagatagcttacacgttgaattattcatgcatctgtgctttaccaactccatgatactgaagagtctttgggcagtctcctggaggtggtaaaacacaaatgcgtgaaaagggggcagagagcatatctttgctcttgatgtctttttaacctctattgaatcctctacaaaacctattgcatggcttagacacattaaacacccaataaattcctgctgcctaatcagaaggaagaaaatctgatacatgaacactcccaggataaaatggggtgatggcttggacatgctggtaacagaggtaacattttctatttccaaattgcaagttcacccataactgtaatggagatgagtcactgggtcaatggtcatgctgtaaatttgtagctctctgctaacacttgaaaataattcttaaaatgattgtcttcattttattagcatgactgatgacttggaagggaatctataattgattacattctacaaccaacctctgttactcaaatgagtgaaagtgcagttataagtagataaatcttgtctaagaaatgaagataaattcatataaatgcataaaggtgaaattgttatgtaatggctatgcctaatttattaagcatgtcataataagcctgacaaaaagtctaaaaaatattttttgcaagatactgaacagtaacaaaatattttacctgttggatgtacaaaatcttattttaacagctactgaacacattaaaaaaaatacagcttaggctgggcgtggtggctcatgcctgtaatcccagcactttgggagaccgaggcaggcggatcatgaggtcaggagatcgagaccatcctgactaacatggtgaaaccccgtctccactaaaaatacaaaaaattagccaggcgtggtggcaggcgcctgcagtcccagctactcgggaggctgaggcaggagaatggcgtgaacctgggagacggagcttgcagtgagctgagatcgtgccactgcaatccagcctgggcgacagagcgagactccgtctccaaaaaaaaaaaaaaaaacctcaatatcaatatttcctgtattttatacttaagaataccacaattacaaaagtcacagccacaaaagtgtgagatcatacagctgccagactaagtgttcccccacaactcttttaactcacttttcatttgttctgtaatcatgcattccatcaacagccttttttttttttttttttaaatctgggcattgtttgagttgaaaaaagctgggggtttggaagcagggagggtactttaaggaagatgggtttttatcaccaggtcactttccatccacaattccttggtatggacagaagagaagggcatgcctagagcctgaagctagcacagaactcactagttgaaagaaacaaggatggtcagtggaaggggaggtaaggaaaatctggccagtgggctccatgccttggagtcatgcttagatccacctttgtgaaggggtggactgcctaggtcttcataactacctgtgccagcacttagctcatagttgtcacttatcatgggtgggtaagttaccaaataaacaacttcatctggtctggttactggggattgaaggataagaaacggtatagtctaggctgggtgcagtggctcacgcctgtaatcccagcactttgggaggccgaggtgggcggatcacaaggtcaggagatcgagaccatcctggctaacacggtgaatccccgtctctactaaaaataacaaaaaaaaagaaatggtatagtctagtgtttctggctgttagtcattggtaaagccaaaatactcctgcctttgaagtttcctgatgccttctaaacattatatttcaatctggtgaaggaatagggctctaatgagtcatttgtgaaaccctaatcaatagccttgtggtctccctcatttcttattatcattgcacacactacatccacatgactgcttgtaagactatttttcaccgtaaattgaactcaaaatttgcatatttctaccaattttaaattttggcttatgttacattttgtatgaacaagttgctgcctagagtagaaaagtggcatccaattagaaaaaaggaatttttatttgatgaggccctgagttgtgatgactggggtgaaaggagaggttgggtggaggttgctctattgttctagtctacaaaacaccccatatcttgacaatgagtgcctttaaagggcaaaaactgagtgttcatttcttttaagtattcctgccggtagcaaacattcgtaatttatgggtcagaacatttcagatgctttctcttctggccttattgtcatctgccttatagcaatctcttaatctctcttgattgtcttttattttattcaagatgaataatagtgtggcagcttttgctaattcactccattggttatcaagtctgggagaccccacttaaatgtcatattttgaagatgaggggactgaggctcagagaggctgaatatttttcggttctttacagagacaatacacaggagatctagaccttgtatgcagatctttgaactcaaagcctatttttatcttcagtacaacaggaaacatttattcaattcaatttattcccagtatgggtttaaaattaattgcccttatatgcaatacattttattattttcatatggttccttcaaccaaaaacatttttgagattctcttgtaatttgttctgtctagaggatcccctgagtgacttttcaggattgcagattaatcaaatattcagatcctgggatctgcttccgctcagaaaacaataccccaaggcatgcctctttgacatgctgagtacttccaactaaagaagccttagaatcaaggttgctttgactttcttctgtcctgtgtcttttgcccctctgcctctcctaaagcacaggaaggggatttctttggagtctccatgtctgactgtaaggaaagttccaccagaagaaaaaatgcatttgctctaaacgccttccttggaatctaaattaaccagagaaggtgcaggagagcatattaaagacctccccacccaaaacactacatgcagacagacttttcatctattcttctgttttgtctattctgctgcctgagagactttgtctgcataataagaccacttttgttcatagtgcattcactctaccaaccctcccatagcctgtcaccaccaccctccaggagccttgaagcccctatttctctctgtagctcaaaatgatatttaagagtcaaccatctggcccttctctgagtctcatatttttggggactcctatgcatatgcacatagtttatatgctgtttcttctgttaatctctctactatcaagttatcaagtttattacagagatcgaaccttcagaggatgggtggaaagttcccttcaccccaatagatcctagatagataagaaaataacaaaatatagattttatagtttttttgcagtgatgtttccagttacttaataggggatacagaaatttctgtatgcaaaattaagttttaattctgttcagtgtttttaaagctacataacacttctaagtttgaagaacacaagttgtctcagggaaaaagtggggatgggagctcatttattgaatgtatattacataccaggtacataaattatctcttcaaggtctcagcatataactttttttttttttttgaaatgggtctcactctgtcacccaggctgtagtgcagtggcatgttcttggctcactgcaacctccgcctcccaggctcaagcagtcctcccacctcaccttcctgagtagctgggacaataggcaagcaccaccatgcctggctaattttttgtacttttggtaaagataggggtttgccatgtcgtctaggctggtcttgaacttctgagttcaggtgatccacccttttcagcctcccaatatactgggattataggcgtgagccaccacacccagcctcagcatagaaatttgaagtagttattatcactccatttcacagatgagagaaataggacccagagaaataaaccacttgggccacctaggatgtgtcagagttggtatctgactctaagacagtaaaacacgaaagttattttccactataaagttgctgtcccttataaaatcaagttagtaataacacagtgcagccaatacataactgtttgaaatttcacacgtgtattctacatggcagggcctgggccatgttttccaccactgcgcttgccatggagggatccaaatgggagctcaatgctcaggaacacaagtgggcggagacaggagcactgggggaatgacttttaaacatatactgggaatacattgaattaaacaaatgtttctgcccctctaccaatgtgattttaagtttccaccacaatttccagatgaatcagactcagtacaatggcagaggaatgaaagattacatgctttaaataaatgtggtcctgctttccgaggcactctgtgctttagtgaggacagcacgtagctcattcccatcctgtctcacctgcaagcccagtgctgaacgaggttgctggtaccatagcagattctcatgaggcacagtgaatgactacctgactcagggtgtttcaaagcagccaactgaaaacattaaaataaatacaaaggtctcatttttgtagttacgtgagaattggcgcctgatggcatggacaattttgcctgaggctgccatattttggaataaggaaggtagaatctgaaaaacacattgttactgactcatctgcagatattccctgctccaaattttctctaatttcaaaatatttggaattgcaagtggcctaagagatcattgcctccaggtttctctttcctcactttcagaaaaagagaagactctcctttcaccctcatgactcatttcaatcttattgataaattctttcttttaaagttgtattttgtctttttttttctccctttttgtggagaaaggggtctcgctatattgcccaggcaggtctcgaactccccagctcaagctatcctcccgcctctgcctccctgagagctgggattacaggcatgagccaccgtgcccagcttaaagttgtattttattttactttgttcaggtaagccaaagccaataaatttaatgcatagggattttcctttgctgggggagagcttcagatgcaatgagaaagagctgattttatggaaagagataagcttgatgaagaattgacaaacaggaggtctgagatttgtttgcagaaatattgttgacttgctcggtggattggacaaacacccactgagtactatagcctccttcacttaaaaagaagaaaactctcttcacttttctcatagctgtctctagctgacagcacatcataaagtgtgcttcttttttttttttttttttgcctttattgctatgtttaaagttcttgagaatgcattgaaccagctggtttggtacataattggaactgagtagtacacaggaaggtttaaaaaaagttatccccttcctccagaggtcgtagtcatggaaacctgctaatacctttaaataaaatatatccattctttcaaaggaaaacttgaacaccatgtataaagataaatattttatgaaataatgcaggttggcttggagatattctcctttgttacagtaattattttactttcccttttacactggatgaacgtattagtcaatgttctctagagcgacagaactaattgaatatgtatatatatataaaggggagtttattaagaattaactcacacgatcacaaggtcccacaataggctgactgcaggctgaggagcaaggagaggcagtccgagttccaaaactgaagaaattagagtccaatgtttgagggcaggaagcatccagcacgggagaaagatgtaggctgggaggctaggccagtctctcttttcacatttttctgccttcttatattctagccgtgctggcagctgatgagatggtgccctcccagattaagggtgggtctgcctttcccagcccactgactcaaatgttaatctcctttggcaacaccctcacagacacacccaggatcaatactttgtatctttcaatccaatcaagttgacactcagtattaaccatcacaatgaagaaaccccaatttgatggttgatgttattcagtttatttgctagtcactgttatacctgcttccttagatcttcctttaaaggtctgatgtttgttttacttattagaatggaaatatttcatgcaatataattcattgcaatctttgaatgatgtatcattgacaaccctaaaatctggttaataaattatgcatcctatttgttcattttgacttgagttagcctctgctactcagtcaagagagaataagtccatatctagaaatagggaatacagaaataagtcagtccttgtaaagtttgaattgttaccatttgaagatcctctctacagtcacacctttagaactcatctatggttgctaatctttgcatgaactctcagagcttcatagcattttcttcatctttcagatgaggatgctgaggctcagagagattaagtaaaacgttcaaggtcacacagctaataagtggcagacctgggactccccaggaccataactatgcagcaagcctctcatattagtttgtcataaaacacacaaaacatttaaactagctatatgcctagtttatatcaatataaactagctttaatgactgaaaagttcctatactcagtggcaatgcaacataataatattttaaatataattaccctaatacaatgtatccctgctctctgaaacagagctaccacattgcacaactccaggggccactgtccccatcaaatactataggaatgatccctcttgaagtaatgcgctgagcttgcagggctgctctgacagccctggtgatacaaggctttctgataaacaagttaaaaaacaatctcacggacagtggaaaaaaaactagtgaaccacaggtagtacaaaaagaatttttctttggataatacgcaaaatcaaattaccacataatgtaccacacagatatccaacaaattcttgttgaatgaatgtgtgtccaggcccagatcagaaataagagatttctcactgagtgtgatgtgatgggtaaagaagccaaaattcttgaggtagaagctgagaaatacagaagcatctgagaaatacgcctaaagatgaggggctgggagaggcaggggagtggggtgggaagcgtaaaataatcagcaaaaaggacaagagaagatgaagggatgcgttgattgaggtggccctggcttcctggctgccctgtctggctgttcacattccatgacgactgacaccttccctggcactgctcagaaccctcaactacagacagaagcccaaactccagcctcctgtgccccagctgtgtttccagcctcttctcatggtactcttttcacctcctaccttgtgctgtgaccccacagggcccagctgcttccccagggctgtcctccagtgggagccagcactaaccccctcgactcctcacatcagtaccttcagctccaccttcacctggtgaaattcgcttatgcctgaccccccaccatgaacaccaccttctccaaaacacattcccattctcttcactcagaagtcattctgagcgttccttcttgttctcatcaactctcaaaacctccaggacaccatcctcctcttcctgcctcgttatttcatgacattgcaactccctctgttacatggtttacctgcttaaacacagggctgtgtcttaatcatggttttagcttccatgggcttgagcacagatgagttacatcaaaaatatttgtattgacagggttttaaatgtctgtcatctaccacatttcttgcaaagtcgttcccgctgaaacataggccttcttggcctctttttacagcaaagatgctgagattcagagagggaacttactaaaatagaaaaagctggtgttaaaaccagaattctagcacaggtttcataaagcccttgacccttccatcactatatcctgtttttgtgacaggagagaacaaaatccacttggacaaagtagaaaatattagcctaaaatatattcatatcaatagccacacaaagtcacaagagggccgttgggcctaccaaccacggcctggttctgtgggaagcatttggaaccttaagcatttgcctgcattaaagtccagggtgaagattcgtgttcagaacaatgagcctgggttataatgaaaatgtttcatttattaaatttgctctgctttagaaagcagagagttatacaatatgtcattgatttttttttagttcattaatgtgttgacctgattgttcagtgctcaaacagtgaaaggtaattgatcagtcccaaaatagtataatccagtgatttccaaagtttctcaattcatagcgctattaatgtctcagttttttctctataccttatccagtttgtatttcagaaggaatatataacagttacacttattaataagttctgtttaagcaacttaataagcattgatgcgctagcaacttagtagcccattgaaaaaaatgctatgatatttttgttgtattcttcaataaccataattacaaatgggctgtgtgctcctattgggtgctgtaaaacttactttttttgaaaaaaaatcaacttttattttagatacaatgaggtatgtgcaggtttgttacatgggtgtattgtacccaagtagtgagctagcccccaataggttgtttttccactcacacccgccctcttccttccccactctagtagtctgcagtgtctatctgcacaacttcttaaatcttagaatcagattggacactgtgccatcaccctcatttcctgttcctcactgatttttcattcagtacttggttaaatcatagcaattgccaacaatggcaacaacaaaaatatattagtaaagttaggacttcattgaaaggaagatagcattatttcatatgaaagctgtaaactaccccaacttggtagtttatgcaatgatcagcagatatcgcatactgctgtgtttccttcagaattctaaactagctcattgtgtcattatgagtttgctgtggtgccctgtagtgcctcagtgcatagcttgtgaaccttggataatatcattacattccatatatattattgtacacaaataacgttataaactttcctattgtcagttacatttgatatgcagtttctttatagaagcataattaacacagaaaggtatataaatcatgaatagatagaagaatttgcagaaagtgaacacatccacataactaccaatcagatcaaggagtagaacattaacaacacccatgaggatccctcatgcccaggacccaggcactactcccctcctccctaaacttaaccagaatcctgacttgtacttcatatgtgagattcctaaacaggaaagtactgcttatgaatacaccatattttttgaaacatagccatttctgagttgcagtgaaaaaaaaatgattttttcctgatcatcttttctacttctcccccattgtgaagcagctatgaagattggcagattgatcccaaattggtttaaaggctcaaggctggacttcttatctgaacctaaaccaattgtgccatagaatttcctggccatggtagtcaaatggcctaagatgacccagtcagagaaacggcccagcattttcctccctactcctccttcttccttctttgctttctttctttttatgtttttaataggataccatctctgagctggacaagagagcagatgaccccaggaacccttggcagcaatcttgcaaatggaaaccgagtgatccctgggatgcagccaacatcacagacggcagattggcaaaaatgaaaaacaaacaaaaacaaaaaatgttccctggtatcatcttagaaccactgaatcatcattggactctacattaatgtgtgccaataaactcccattttatataagtccatttgaatttgggttttctttaacttacatgcttactaaatcataagatcagctaactatcagctaaatggaaacttcagtaatgtaaaacagccatttctcaatgtaaaaaaaaaaaaaaaactagcatataattttcccaacaggaaagaaaatgctagtgaactaaaatttccatttgagagaaaaatcagccaagccagcttctgcaataattggttcatctttctaggactctgtgattaactccactcatatatcttccaaaacagggagatttaaacaggttaacaaaaattggggtgcttttttgtggttttaaattattctgttaagtgaaaccttccagatgcagcaaatattctcttttaatagagttgcattttcaaagcaaaatttcctagctgtccttgccttgctaatgaagttttccacttatctataatatgtgcagaatggtgatatttgatgtggcattttcttgacatttctaggctactataatcatactctttaattgtctctgcctaatctgcataggagacctgacatctcatcctggtttctgattttaatcataactgcatggagccagaagggtcactaaatagcatccaaaaaacactgttatcaaagacacttttgccaatgcttttaaaaagccaaagcaaatgatatttttctaaaaaatgaggttgtttgttgtggtgaaaacaaagagatagctttaaattaaataccaaatgggttttctaagcattaaaataggataagtataaaaccagactagggatacatctccaatatcactatgctgataacatcacttaaattcgctaggcatttatggaaaacaatgataattccagtaaatgccagttctactttcagagtagctccactgaaatgaatgaattacctcttatcaggccaccaaggggtactgtgattccggaagcatgacagtacctttgatagataagccctccctggaagaggagaattaatttcccccagctctgcaaaggccagctcttgctacatatcacacaccacacctgccacaaagtgacggagactttcctggagaaatggccatggtgtgatggaattccaaagcagagagccaaaggaaaggagtagtagccaagagagcagccatgggcgaatcagacaagaaagcttgtcaccttaaaccctttccctaagcagggaataaagagagtgcaagtcctgcaaggaggggttgtggtatggttggaggcatgagctccagagccagacctcctggctctcatcccacctgggcaactgcacagccttcagcaagatgctgcactgttccgtggttccattttcacaagcataaaaatggagaaatgaataggacctaattattggggtagttatgaaaattaaataggttgatatttgtaaagtgcttagaacaatatcaagtatgatacacatttggtaagtaaacaaataaatgggactgacatttactatggctgtttactgacatttgcccttttcattgctcccacaaaggagaaaggaacagatgttttacttcctttatctcactgaatttcccttaacaaacttcaaaataggccttgttattagccctattttacagaagagaaaaccgaggaacagagagtttaagtaacttcccctgggcaccatgatttacatcaggtccccatcattcccaaacctggtgtgttatttatttgcttgtttttccattgcacaaccttatatctagaagctgggataggatggtaaaggactgaagttgaagtagaaagaaggtattttaaaatgcagcagataaagacaaatactaaataggttgaaggcaaaaggggatgctctttgtcatttctatcatataatcaaagttagtacaccccatggaaaaacaaaaacaaaacagctttacatagaactgattatacgaggaaaagaaaatgacaagaaaaccaggcacaatgtagaaattcactttgatgacaatacagagccatttactataagcaaagggcaaagtagaaccagataaggcatcggaaatgcaaacactagattcccatctaaattgccagtcaacactaaatcgtttgctgcaaggaaaacagctgcccactctcagcagtgaggcaaccaataccatttttaagcactttttactacctagaaatgccaagactcatgctgttattgctactatttataaagaatgaaaggattaattatctacaagtaagccatctcattacttctggcattctgtagtagataaaacaccctgttatttcataaacagataaatgtgcaatgaagtctaatttaattaagtaaaattgcaaaacgatgaggtaacttgttctaataatttaagttacctaaataaaaattatagataaaggctagtctttttatttggactttacagggatttagtggttagttttataatattatttattaccagaaaatgtcaaaaaaaaaaacggggctagaaagcattctaaggttttcgattatgagagtgtttttaaaagtctctgcatatatgtaagagaaataatgtaaaagaagtctactgtaaatgataaaaatgataatatttaaactagagcattataataattttgataaattttccattagagagaagttggttaggacaaaatttcaggatttacatttgtttaaaattttcagggtctttgaagaggcagctgcctgcttgaaaacatctcttatgggttccgcaatattccaatacatttgctacagtggatcaaggcatcttctttagaaaaccatctttctcttaccaagtgccaacaagccatcagggagggttaacacattaaagcataacccctaatattacatctacatttcacagcacaggacagaatgcagaaggaatagatttttggaacaaatctatccaggccaggtattatggtctgagttgtttatgtctaccccaaattcctatgttgaaatcaaatcaccaatgtgatagtattaggaggtagagtcgttaagaggtgattccaccctcctcaacggagtaagtactgttataaaagaggccccaggggctgggtgtggtggctcaagcctgtaatcctaagactttgggaggctgaggtgggtggattgcctgagttcaggagtttcagaccagcctgggcaacatggtgaaacctcgtctctactaaaacacacacacacacacacacacacacacacacacacacacacacacaattagccaggcatggtggcatgcacctgtaatcccagctactcgggaggctgagacagaagaatcccttgagcccgggaggcagaggttccattgagccgagattgcgtcattgcactccagcctgagcaacagagtgagattctgtctcaaaaaaataaaaataaaagaggccccagtaagctgccttgccccttccgccatgtaaggacacagctagaaggtgccatctacgaaccaggaaacaggctttcaccaaataccaaatctgccagcaccttgatcttaaacttcccagccaccagggcagtgagaaataaattgttgtttgcaagctgcccagtctggggtattttgttatagcagcccacatagactaagacaacatgtggcagacatggaaaagttaggtggggcctaaccaacatactagtaaagtaagccatcactgtaagggctataggtttgagaaagatcagaagatgaaacccataggagagaaagtggccataattaaaaaacaacaacaacaacaacaacaaaaaccctcgaaattatactagggtgggaagaaggaatataaaccattgattctcaagcttagttcaaattgggcccttcaggggtctgttgaagattaggaaggctccatgaaagaaaaacactcttcagactcctggtgaaacagaagctgagaaaggcagagatgaaacaaatcagctccacctttagctaaggatgaacagcaagagagaagctagtggaagatattaggccaatgtaggagctcacctgagttccatagacttagctaccatgggcatttacactgcctatggggtggatctcaggggaaaataaatgatgtagcctagttaatgtctagagtagtgattgggtgaaaaatgagtgggaccaatgctgttctctaatttcaccagttagtagggtcaccataaaatttgacaatcaaagagaacgattttaaggagtgatgctagtaataattatggtggaacaacaggtataaaaagactagactaattcttctcattccaatgcttgtttgatataaattgctccatcacagttacagaacatactaaatatatatttctaattaatacatggttttaaattatgcttttctattttatgcagcaggtttagatctaaaagtatttgattgttcacagaaattctttctcaaatgttaaggtttgttgtttcttattttgtttctcaaaatgttaaggtttgacactatgaaaagtctttaaaatgctgcagagtaagaattacaaaagagaatttccagcaaagctttgaatactgccatattctagaataaaggcgtgcacactctgccaccctaacagtgatgaattaaaaggcaacatcttttatgtgaatgtctaacttgtaggatattctttataaaatagatcacaacaattcatctgttatctaagagtgcaaatttgcattttaaatattaggtagctaggcatgctaggcctcacaaaagcttaaggaactgggttataaagacaaaaggccctatcctcgttttgcctgaagtaccctacgaagatagttgacctctctgtcctggagaaagaaaaaccaaacaaaataaaaccttatttattgtctgacttaaatattttatcttgcataaatatgaagaaagctctaaaggctctacatcatttatccaagttaggcttccggcaaacagatgaaaaaactggaaagaatgttttcctatacaaacccatatttttgaagagacaaggtatacatgaaaagcttgggtacattaatgctatacagaagctcctttagggatgaactttctacttagaagttctcatggaaacaatctaccagatgcccaaacaaaagcatatcaattgagtactgccagcagttgatatgaatggctgtttgtgtattgtctctttggagttataaataaatgaactggtaaagaggctttcagaattaacatgttaggctataaataaacatttgtgcagctgcttattacccagatcatttgtacccttgtatctctccaaatcagcactcagtattcctgataaagcattcaggattcctgacaaaggaattaacctatagcatatggcttaattctatattttatatcagaattataaaggggtccaataaatactgaactgtctttgtgacatattctattcgtttactattaaaatacttccaacactgtacaattgaaactcaagtcgttggtcagatctcagccacgtatcaaaagctcattttaaatatttaaagtaaataagatccttgttatgaataggaatgcaataagtcatcaatccaaatccagagaaaaataaaaaaacattttaatgtctttgattgttagccttggatccttccactaaggtagaaatagcaggccagttaaattgcattttgtgtatgcaattcacgttgttttcctggccttacttactatattagttggaatactttatgaaatgaagaacctaccctcatatttttccaccagtgaccttgagttagtattgacagaataaatatttcaaaaaactcaaacccagggccgtgctgaggcatttctgggcagccatagactacctgaaaaataagataaggccttgggtctggataaaaatggatcctgccaacgtctacctggctaacacccatatagaactgccttactagctgggctccccctaggaggagagcttgggggctagtggctatgcaggcaacagtgtttcctaatgatctgggatcactggtcacgctttcccatctatactttggagtcagaattgaattcaaaatccaggttttccacttactatttctgtaacttaaatacattacttagcttctctttcagccttcccattcatataacagagataatatcaccttcctgttgccactgctgtgggaactaaacaagatgatgtaggtaaagtaactgctatggaatatgcgctcgaaaatgtgactatattgatatattgacgtcagaaaaggcctggtaaataaatcccaagattggcattgtgatgctttttcatttggcaccttctccgtatttcacactaaaacatgaaaaaaatgcacatataattggttttagtagtcttaaattttctaagaaccgtttattaattcaaccatcaattgtaaccacgaacattaaacaatattgataaatcaagttttattttttaaactctctttaaaaaatctatctagtacttgattttcaatctgtttaataagatggaggaccccaccaaattactcttctttgaaagttgttcatgtataagtgaataaaatatattttactaaaactcatttccaactgtaatttttaagaatacttaaagaagggatatgttcaattctacattattacatttttatttaaccatttttaaccagcattattttgtaagtccatcacaactatcaatttccataaaatgtggtactgtcctaggtaggagtagcctatttaggaggcaggtaggatctgcattccccaaagacacatacatgaagtgaaaaacaaatcatgacaactaaattacactgaagacaagtgttcataaaattttaagaaaagtgatatttgtggggacacaggcttgagttgtgaaaatattacaattatatgcaggtagcattatagaatctggataatcaacaataagaaaagcataaaaatattcttaaaaatctaattttttgcaagactcacttggactatggttaaaactttgtgattttataagattaggaaagacaagcacctaaaatgtgaaaaaatagctacatcataaaaccatatagattgtcatgagcgtataaagacctggccatgaattcaagggttttttttttgttttttttttttttgccacaacagcaacaaaaaattatctcagaaattagtttcagaaaacagtttttctactcctatagaagcagaccctcaggctacttttatcatcttcaaaaaggagtttaaccctgcatggaagcttaaggtatggagggagctgccaatccactggcaatttctaagttagtttaattaaatgaactgactgaatttccatatgtgtatgtgatttctatttagaaaaagaagagttatacgtatgtgtgtttcattatttatacagaactcattacattatgatgttaaataactactaaaaataaaaaaacatagcacttgtattaaaatgttccatggaccatgtgttaagatgattgcattcctaaaatgcagaaaaatcccattatttcagtatcttgctgtgtttcactgaatcatcagcattaatcatagatgacatattcctcatgcattagtactgtccttcatggtgtgagaacatctactaaggaaatggctttttctttgttgtaaaaaagagtctacggttgtaataaagaaacctgaaaatatgtgtttttcatctttatctctcgctctttttccagctcctagtgtcatcctgtaaaatgctatgcataaatttgtgaacaataattgctattcagtttacaacaaaaattaaccaaactataaactgaataagctgtgggactttgatgcagcttaaatatttaaaagtagaataaaatgatctttcagtttcccatgttcttaaaaaaaagttctcaaaatagcttcttattaggctaagccatatttacccctcctaccaaatctgcaagtgttcagaaaacatccaactgctacctaagataagggtttacatttctgattcttaaagactgatctatgtgcacacagaagacagatgaaaatccaatttcaaggttaggaaattaattttgcctggagaagaaaacactgtaagttcaatttgatacttaaggatgcttatttgtttgttttaatgtcaagttgactattatttaggtctattataagattaataaaccactattacctgggaaaagtacaatcattattgggcattgtttattattttctagcttttcataaggattttccataacaccagtagcgcacaagtttttcaatttgggtttcttttgcttccttttctggaataaaagaaaacctttccggtttgtgatgatccactctacttcctggcaatatctactgaaaagctatgacacaataatagttcaataactttctcatatattgaatctacagcaatcttacactggagttgtgaatatctctccattaacatttcaagtcagcgtatccaagctgtaccccagggaatactgatgtttgattaaatatttataggaaccccaaagaaaaagagtgttctgagtcaaatacaaaagggaaacaatgagtcaaagttgcgtaggtcttgctgttattgtttttattgccaaatttctaagaaccttaaaaatgaggcttagaaaatatttttaataagagcaggccttgctcaggagcaagtagcatctttgagatacttcagaaaacacattacctatccatgtgcacatcacaaaatctccactgaatgtctcatagacgtgtcaaacccttgtctaaaactgaactcttgatatcccccaaccaaaatctattcatgtttaaacctcccccttttcactagattccaataatggcttttcagtttctcaggtcaacaattttagagacactcttgtctgtctctttgtctctgtctttctctatgtatacacacacatgtatgtgcatgcacacacacacacacacacacacacaccagtctgtcatgaatttctatcagctccatcttcataatataacttaatttcttcctaccacttcaactgccaccaccttagtccatgccatgattggactctggcttagattattgtgtaagtctgctaactggttgcccttattccactctttccacctctaatctaatctctacttagtatcttctttttaaaacaaggttcagattatatcacatttctattaaaaatcttccaatactttcccatcccactccaggaaaaaaaggtcatgttctcactatgacagctactgcgccctgctctcctatcagtcttcctatcccaagtctgctgctctctctccctgtactgagaacacactggtgctcctgctcagcagcctgcctttttccagaactctccatttgccatgatgtttgcttctcttctttcatttcctttaagtctctgctcaaatgtcaccttatctgagaggctattcccgacccccatatattgaagtgtttttgtttcatcacttccctgcccttttttctaaaacatagcaagttttagcacttaattttacaaatttatctttttctttttatcacataatttatataagaaagtttatatttttactagtttatttttatgtcactctgttattacctccaagagagcataatttcatttgcttttgttttgcacagttatcttcagtacctagagcaatgttctgcatgtgggcatcctatgaagaatgactgaaataaccaatgtgaacacaatatataatatgtttttttaagaagtcattaattctgttttcattattagtcttaaggaaaattcatagtagacatcacctgagtcattgatcaatgatcatctccctccaccacagcatgagatcctaagtgcagaggtgtatactatgtttatggatatatagtcagtgcccacaactgatcctggcacatttgttaagtgttgagtgaatagctatgatgtattttcattaccactctagaatcacgaatgaaatacatagaaaaataatatttcttgcataagaagccatatgtaaatctcttagagacactgaagtttatacaggaaaatacaataatttagttttagaaaggcgagaaggttcctgatttattagcaaagacacattaagctgggtcttagatagttgtagcagagatggaaacaaatggtgatcaaatccgcagatgttagtcctgatgttaatgaacaaaacatatcaaagtgaaattgcagaaacagatggcaaccactgttggccaagaagccaacaagcagaagcacaggatgatggcaggttcatcaaaatagctcagggagaaggaaaaaggggtaactggctagcaccatggatagcgctaaatgaagcactatgttccgatctattcaacccaacacaaataaatgttttgctattgctattcacaatagcaaacacttggaaccaacccaaatgtccaacaacgatagactggattaagaaaatgtgacacatatacaccatggaatactatgcagccataaaaaaggatgagttcatgttctttgtagggacatggatgaagctggaaaccatcattctcagcaaactattgcaaggacaaaaaaccagacaccacgtgttctcactcataggtgggaattgaacaatgagaacacatggacacaggaaggggaacatcacacactggggcctgttgtggggtgggggggaggggggagggatagcattaggagatatacctaatgttaatgatgagttaatgggtgcagcacacgaacatggcacatgtatacatatgtaacaaacctgtacgttgtgcacatgtaccctaaaacttaaagtataataataaaaaaataaaatatatgttttgttgttgtggggtttcttttatttgtttgtttgtttttttacccacagatggaaaatttgtacctaaagacttcaaccttaagatcaaacataattgcttttaaggatctggaggtgtcacagtgaattttcaggttgcttgagaaatacctatcagataattctcgccagtcttcctcagtttttcaatctttctggcactaaaagtgatttaaaaagaatcttttaataatcacttatttcactgaagatatacttttcaaaacagctgtacaggcctgagagaattaatgggctttgaaataatcaagtaacttactgtcctctctgtttgggatatattgttatttataaattttactttttaaattataaaaagttacaattttgatttgtaattattaaaaactccaattcacaaatataattttaagtggatttttatgcctttcatattcacctcccacatgcaaaacaattatccatgagtttttagttttatgaaagatggagaattctatgttgattataaagaagaataatgtacattttgtttcctacattataacgtgttttctatacctcataaatactgtactattcttagtcaatttcacagtgactatttcctaaatcccttagacagggatttaatgattaatgaaatgctacagcaattcttttaataaataaagttttcatggaccatgccatagagccatgcatatatgtttttgtatatgtagatatataattgttggcttaaagcttacaaatacattaattaggttcatagatttagtagcattttaaattaacaaatatgttttagtcttaaactacttggcaaagaggtaagcaagccttctgattttctccacaataacatttatggggctttaactaggttctctagtacaggatcttttgtaggagttaattagagacttcacttaacttattgtttttaatcctttcgaatgtcatcctgtagttatttcactgagaacttttaactataaattcttgccaagttctctgtattactcattccaagcacacgctggatttattataagattaataaattatccctaaaagaactctgtctcaccgtttcttccaaatatttttgtcaactttttgtttggaaataactttccaaaatcatatgagctgtggtgctcataaaacaatatgagtcaaaactcggaacacacaaacaagaaaaactctaattgaatctctgttcacattttatgattcgtggtctcactttgagtagagctagcaatcacagggcctgagtgctgccactgcctacaccaaacatggcagacatggttcatcagttactgaccacttttggcctcacaattccttacacacaaccacaggcagcaactacagatttattgggttttcacacaaggtgaattctgcttgctcttcctaaactggaactttgaattagaatttagtggcatacgcctatatagttaagaaagggcatgatttttaacaattttaaatactttagaatgggtggttatcaaaatcctttttttatgtttactcaacacttttttttctaattaaatgccaagttatatctatgtccaattacatattaacagttgtacttagtgacggcctcaaagttacttgactttgaaggatgattgtccttgagggaggacttgatcatgaggtttaaaaagatggccatctctagcactgcatcagtatggggctttggggtggctcatgcacaggcctgggcagcaggctctctatgcacaggtctctagggtttttgacttagacaacttgctctgtagaaatgggggagtgataacatccattagctacaaataatattataatcagagaaaaatggcttaaataaattctggcttgttaggagccatgtgatctcaattatgttattcctgaaatctcagtttttcacatatagcattaagataataaaacatactccacaaagttgtcatgagggttgataaaggtaatttaagtaaaatcgacagaacatctagcacaattgaatctaaatttaagtgaaaagaaacagtactaatgtgctcctatttatactaatggagcacattactttttaaccttggagcacaatggagcacaatacttctttaaccctgcagttgaaaaacttgttttgtatctttcacagataatgaatttctcaagattcgttatataaccaatatatgctttaaaatatgatcttattgagatataatttgtatactatgtaaaatttactcatttaaagtgcataattcaatacttttttaaaatactgaattgggtaacaatcaccaccaaatacctaatatattcttgaatttatttttcaatatcaccaaaggatgtctcttccataaggaaacaatctgatgaaatcagtgtaaaacttctataattgaaatggcaatgactttttaaaaaaaagtttgaattcagttggattgttgctagattaaggagaatacagtggaaaaataccaattgaaatgtgtagcctatgattagttcctgggcctcaaacagaaaaattatggacttccagtttctagtctgacgtgcaaaggttttcaaagttgtcactcccattctcgtaacaagaaaaaggctggataagctaaaaatcaacaacactgcttagatctataagggaattgagatcataggaacaactgcttttcccaaaatggagagacaggtgggtacagagaatcacatgtaaatggcagagaaacccagggccaggtcctacagatgaagccagtatcagtaggaacacttaagctgtaatcggtgaatgactgaagactcaatgtggaccaggttgagagtaaaaaatctgaggaaaggggctagtctcggcaagaagcccacactttcttaaattttacctccagcagctttgtgttctcaaagaaaaatcccctcatgtttccttcacgcagggagaaggacaaagtgacctttttgaaatatgtccccaaggccagctattttaccagagtctaactgattagggttttgccaaagcataacccatgtaaagaagaaaaacacccaatgacagcctcctctattcttctcagatagctgagagtacttgtaaaggccacaggccaggagcaaaggctcactaaacactcagacctaaacataagcctacagatgctttcactccttctacacctcaccaccatataaatagggcttccatataaaaacagaggattatagctgaaagaactacaagcctcagatgctattttaaaagtcttttgggaaacccaaagcaattggggggtgggggacaaaaataaggccagtcacagaaattttagccactgacaccatagctagaggaaacagtaaacacagcatgttagccagataaatatcaaacctcatattaaagggccattgactccagttccttttgcccaattcatcatatctgttttcaacaacaacaacaaagtcatgctaaggggcaaaataaaacaaaacaaaaacctcaggctaaattatccaagcaagaatcaggactccattcagacatgacagataatttggagttatcagaccagaaatttaaaacaattttgaacaatatgttaagggatcgaatgaaaaaaagtgaacaagatgtaagagaagatgggaaatgtaagcagaaggacagaaattccaaaaagaatcaaaaggagatgctataaaataagaactttttaaaaagaaactgacagagatgaagaatttatttaatgggcccatcagaaaacttaaaatggccagggaatcattggccttgaaagtaagtcaatagaaatttccaaaattgaaaaccaaaaagagtttgaaaagtaaaacagaatatccaggaattggggaataattaaaaaggtataccttacacatttttggaatagcaaaaggagaagaaagagagaaaagaacagaaatatttgaagtaacactggctaagaatttcccagaattaacgatggatgtcaaactacagacacgaatctaagagaacacaaagaaggataaatagcaaaatatctgcacttaaatatatcatactcaaactgcagaaaaacaaagagaaagagaaaatctcaaaagaagccacagtggggaaaaaccttacatatacagaaatgatgataaggattacaccagacttctctttagaaatcacacactcaaagagaaagtagagtaaaatatttaaagcattgattaaaaaaaaaaaaacccacacaaacaaaaacaactaccaacctggaattctatatcctgaaaaattatccttcaaaaacaaaagtgaaataaagactcttagagtaacaaaacaaggaaatttttttgccagtggagctgccttgcaagacatgttaaacaaaggtcttaagagagaaggaaaacaatattggagagaagcttggatttaaatgaagaaagaaagagcattagataataagtaaacataaaatatgttctttttttgtactttaacagataacagatttttcaaaatatttttagcaacaaatagatgaggtattcatagctagtgaatagtgaaatgtatggcagcagtgtaatagcgatgagcaggagagattggaaatactcgaaggggcttgcactacacaataagcagtattgtgttatttaaaagtggataaacattacttgtaagagtatattgcaaactccttagcaatcactaacacttttttaaaagaagtacaattgataatctcagagaaaagagaaaatgggattatataggatgctcaattagaaccagagaaggcaaaaaaatggaggaaaaaagcagcaaagaaaatctatgaaagatacagtttgtgacgagttaatgggtgcagcacaccaacatggcacatgtacacatatgtaacaaacctgcacattgtgcacatgtaccctaaaacttaaagtataataataataaaataaaaaaaagaaagatacattttgaaaaatggggaaaatataaatataggttggctattagatgagattaagaaattccttcatttcttacatgtgataatagtataatggttacatgggattaagactttattctaaaaggatgcatagtaaataatttagaaatgaaatgttatgatgtctgaaacttaatctcaaatgatttagccagtgtgtatgtacatgtgtttatgtgcaaataaagataaagagaacaaactttccaatgattgttggttctaaatgattgttatatggcatttagtgtacagttcattctagtttcctacatgttcaatacatgataaaattaaaagttagaaaaataaataaatagattaattaatgtcagtatatacctattttatttgttgtagatttggttttacagcaaaggtcttgataaaaatctatattttaacctttaaggtgtcttttgaaaaatctcaaggcttatgggaggacttattgccaatgatcttgataatacctgttcttcaaatttacaaataacaagactttttgtgtgtaatgctgttacttatttttactccaattttcagagtgccgttgtaagttggttttgtcatcgagactaccaaatcatcagctaccagtcaggtaaacccataaattacaaattgtgcaacttttatttcatttcccgagtaatataattgtgtaattatatgtaatttgagatttataggaacttcaggaaataaaattagtagcatgcaaaattaaatatgagctaatataaacacattctgctaaattaacaattatatttcatgctatcccttattaaaaatctaagcccccgagttaatttcctagttattcaaaatatgccttgcattctatagtatattcccaacataatcaaaaggcctgttacagtcctactacaaattttgttatgtaattaggcgttacatatgcatacatataatgcatattacattatacattatatggctaataattatgcaatacattatttggctactaattacaaatatactactgaaactgcaaggccattataaacacctatttttctactttaaattatttcttaaccacaggataaaaataattatagcaatttgaatagagcatattgttaaagtatcataatgtctgttatcaatcgttatatgtaagtgatcataaaaatatctgaagagcagtaattttctaaaattcattgaaagtctcatttttgttgttgttttccctctctctttgaaagaattgtatttgcatgcgtatgttttatgtgtgtgccactcaatataagatggatatgtgagggatttctctacacagcatggccctaaacccaaaaggtcatggcttaaggaaaagataaaagttctcagttaccacaaaatcagaagtatgcacatgatgcaattcaggaaaagcaaaataattgtttttcagctttgatgaaacaggagtgtggcggtgagtcaaatattctgcctaatgtttactttataacatacactatttcaacttctaatacttaattcagtttaacaagcatgtaagtacattatcttaccaattagagtaatataaaaatgattaaaactcatttttaacttcaagacagatcagaatctaatgagggataacgtataagccaacatgtaactgtaatggaaggctgagtactaaagaaaagcgaagctactgtgccacagaagaggagagaagagcaactctcttcagtctcaaatcagggaattctgcctagaagagctggcatttgatttgggccttgaaatgtgaaagggactttgaaaactgcatctaaacattaaaacaattgaactcatgacatagagggtagaagaattgttgtgagaagctgggaagggtagtggggggctgggagttaggaatagttaaagcatacaaaaaataggaaaaatgaagaagacctactactcgatagcacaacagggtgatatagtcaataataacttaattacacattttaaaataatgtaaagagtataactgaattgtttgtaactcaaaggataaatgcttgaggggatggacaccccattctccatgatatgtttatttcacattgtatgcttgtatcaaaacatctcatataccccataaatatatacacatactgtgtacccacaaatattaaaaataaaaataaataaaatcttatattaaaacaagaaagggaaagctttttgtgttttgaataggtacaaattgccagatatgtgaaaaatgagagtgggaaagtagtttgaggcagatcatggcagaccttgatgttggagctcagtagattgtgttgagcattgtgttgatggagaaactttctgaggagggtagtgactaattcccttatttttggaatcagactccagtggcaaaatggatgacttacagaatggagacaaggacagttgtttgggggctgagtaattcaggtgaaaaatgatgaggagaaaaagagaagtggtcatgaaaacaactaggagatgtagctgataaactcggattagatttgggggatggataaagaaaaagatgagataaaatataacttgggttttggcgtggttgaaatcttgtccctgaaatggaactcagagagaggcagatctgagaataaagagctgaccattgggaattcatgtagcagctccctcacaaatctagtttgtaagtaagttaggaattggtggtcagtaaataaaaggcattcctgatacttcaagtgatctcctttaggttttcattgctcttccttccaaacttataagtgacatcaaggaagctggtttacaaaattactgctgcatggaacaattttctctaccttccaaacatagagaggaagcaacagaaaccaatggaatccaccagcaccctaattataaaacaagtgtaggaagggtgctctctgatgcctggcatattcctgcctcaaggcagttgcacctgctgttccctctgctgagggcaccactcactctcactttatttaaatgccatctgatgagaagggcttctgcagccagctgaattagcagtggtcgctcagccgggcactcttttactaggcttcaaagcacttcctagcagttttcaccaccagtcttgatactatacactactccacatgtgtgcatttattgtttattgtctgtctttccccggtagaaaacaaaatgttccatgacagcagggcctttgttttgcttacaaacaatgctacaccatctgcttctagaacagtgcccactatgcactgagtcttaaataaaaattaaatgaatggatgctgctttgattttggacttggagctctcagatatcccagtttcaagagttttcaagttgattggttactacatgtataactctcaatcacaagacaactatgtcctatttactaaattaaataaaattattaatgctaagactcatggagataactgattttacagattttaggcattataacagtggttttaaaatttaagcaaagatcagaatcacttcttgcttaaaatcatgcttaaaagcagattgctggaccccaggtctagaggttctgattcagtaggtctgggccaggtccaaaaatttacttctaacaagcttccaggtgatagagatgttgctagtccggggagcacactgaaaaccactgcattacaagctataacataattgcagcatacacatgagagaagtctacagagtttgggagtttagaagttgcagtattttggtggcaaaatagtaggcccctaatagaagagattactgttcgtctgtccccaaggcttggggtttttcagcccattttttgaagttttctttcttatctttagtttttaaattttttacattaatttaattgtgcatatttaagtacacaacatgatgttatgggatacctatagatagcaaaacagttactacagtgaagcaaatgaatgtatctatcatcacacccctttgtgtgtgtgtgcgtggccagagcagctacaatttactcatttagcaaaaaatcctgaatataatcttttacgatacttggaactcttttgatttgctaattgggttaagatatcatattccatttcattcagtcgcaatacgcttctcaaaaaaaactaaattcatattaaaaaaagcactgatgctctaatggaaaaatgaaagatatccttagaaggagaatgcaccataggacttctgcttactctcaagacaacattaaagaatattggaacatttcttggtacaattatgcagtataaggccctgggaatttcctctttaaatgttttctcttgggcccttttttgatgtatgatttaagaccacaaaaattttaatgactaaacataatataaatagaaggatcatgttatttgtcatacaaaccagaactctttgggagagaatggggtgctattaattacagtgggttaatagctatcaaataggactatccaaagaggtatgatcatcttagataggttagaaaattgtattaggttcaaatcagttcttgaaagattgttgtttattagttggattttgttttgtgattctgaagtatttctgaaatgtatttacagattctgtgcaagaccttcagtcaatgctccagtctaccctcacacattgaaaatcttcacatctgcacataggctggaggctccccgtcggtgtatgcatatgatcatgatgtaatgggaggaactttgtaagtggccaaaatgtagtttgcatgccatctcggctgtgtggctttggatctctctgcacctttgtttccctaggggtgagtggtgaagagtaatacctatcccataaaattacacacatagcacaaaacacctagagtgtctgctctacagtatgtgcttattaaacacccatttttttcttttccaaaatactttctaaaatctctataagccaaaaatttaaccctagtattctaagaggttcacctatttattaaccctataaatgatttcaaactatgcttctcagaatctccaagtgaaaaaccaaatgctaagactagggagaggcagactggggcataatttatttagaaagcaatcaatgagaaaacctcaaccttattatctaattagtcacagtactcattttataatttaacattaaagaagaatgtgcatttttaaatcttcatcaaaggtgatatagattaataagtgataagaaacactgaaagaaattgattaaattatgagttgaatttctagatgagagtcaaaagaaaatggaaaaaatctagcaatgtgtagagactgggttaaagaccagagggccatggtgtggtagtctgggtcgcccacagcatcagctgtttctgcttttcatagtctctttgttctattctcctcttaacacacagatctccaaaagcagcaaactattttgcaaagtagctcttcttggtggaagcatctgcctcctggagataggggtgaaaggctgggaggacagaagaatccatgagtgggtggctgcttcggaaatgggacaattactttattctcatttcaggagctttgacctgaattccacatttctcagcttccactagaattccatgccatgcacttaactattcttcatgcattatcctcagtgactttttaaaatgtcagagctaaaggagctgagaggtaaactaacccaagactcttaattttatagataaagagagactcagaaatgtgaggtaatggatcccatcatatatacgataagtgaagtgccaggcccttatcttctgactcttgaagctatgtttctgttagtggttcacactatttcttctctatttctgccactaaggatccactcaaagggggtttctccataggtcactcaaattccttgagtttcttcaaagctattcttaactctgagatttaacaatagggacttttctaaatacatgatataaaacctatatactgaagctcagtatatccattaaaaaactcatgtttgccgggcgcggtggctcacgcctgtaatcccagcactttgggaggccgaggcgggcggatcacgaggtcaggagatcgagaccatcctggctaacacggtaaaaccccgtctctactaaaaaatacaaaaaaaaattagccgggcctggtggcgggcacctgtaatcccagctactgaggaggctgagacaggagaatggcttgaacctgggaggcggagcttgcagtgagctgagattgtgccactgcactccagcctgggcgacagagcaagactccgtctcaaaaacaaaaacaaaaaaaatctcatgttctagaacatttcacagcatgtgaaaatgcttatattgttttaaaaacagagtacaaaaagtaggtacattatgatgcaaatatctgtaaagaggctgtatggaagaatatacaccaaaatattaatgaccattaactctaggtgataatattgcaggtaaattggcctcatttatagttttgtgattttcacatattcttcacaagtatgtatttttgttactataaaagaaaaaaaggtatctgaatagcagagaaacagtccagcaaggaaatattctgagctggctttatctagtccatactttttgctttctccctttatcgctggctttttggtcaccctcagttttcatccctgactcccattatcactgtgttcccaaatgcaaatgctcatagtgatctcagctcacctgctcactacacctctgatctcaaagggaactaatgctcctttttgtactcttacaatttggctgtgatagaaaatgccaatggaaatgtcctataatcaactgaaactataaatgagaggcttcagctggagatgagatggaaagtcatttatttactgaggacagcaaaagcctggggaacaaaagccaaggaatccttaaagggcagagactagaacaaaagttcaaggctggagtttagggagagggtcatgatttagggttgggatgaagaatagagtcaggaaacagagagcataaatagcaaaaagtgatgtcatggaaaccaagaaggaagatctaaagtattaaatgttatgatataggcagcagcaggagcagaacaattaaagaataaattgaaaatgtttaaaaggattcataggaaaaatattgtattgattatttaagaacaattctgggaaaaggacacactaaaaacattttgatacattgtattttatgactggaaataaggaaaatcatcctaagcataatacctggtttcagaggagggataaaatccaggaacaaaatttttgagtgatggatgctcaccaagaaagccttatgacaggaaaaccagcaagcattaggctcaaagagacttttggatcatgtactttcacacctgggtgcccagaaaatataatatttttactggaataaagggatgagaccctaagttctgccaggtacccttgagggttaggagatcaaatgatccacatgtccactgcccattctaagaacatgggtgtatcccacacccgtaagagtaactctggagctgggaatatagataaagagatatactatttacattacattatatggtagtaccttgcagggacataagtcctatgccagggacatcacaagtgatgtccacttaaaatgaaggcctaatttcatctggagtagattgggaacgactgtcaaggaaataacatctaacttagaaaccaatggatttgtcaacagaataaagaataaagagaagagcactgcaagaaaaccagagaaagagaagagcaaaaagattaattccaagggaggtatgctgtgtcctgtgcccctcatttaggtggcaggtgggaaccagagaccctgaggccaggtcccacatctacacctcctgggaccatccctggctggtgctacaggcactgcagcttacgcttagctcttgggatgatccaatttcatgattaggaatggtttattcccaacacaggaggctataaaatataaaacctgtggatgccagctgtgtgcacacccagcaagagccaaaaaagtgaaataaaacatgcctgggacccttgatcccactgccaatggagaatggctttcagtaattctgtaacgcctcaagattccagaagctgactttaaaagtgtagttaaaaaaaaaatgggcttatttcacagttaatttccaatgatgtttaccaaaatctggccatagaagattggatccacgcccatataaatctaaaagacaagccagttttttccttttggagaaagtctgctgctgttataaatgataggcaccacagtccttggcaggagtgtaacctgaacctgttgagggaaggtataaaactgtccagaagaagtggaggaggagcagcctactgtgatatggatagtatcaagttgactttccttacagctgcaaacaagtatgatacaatggaaaatctgaagttagttgtgagagctctgaatgctgtccaacccaaatggaatgtgcagcctaccaaaatatttgcccttttacttgaagaacagtttaaaatgtcaggaacagcttctaagattagctagatgactgttgatcactttattgcaccttattacgtagcgctaatgggactatcttgtcttctttggtaaagagcccttatcaagtgattaggagcaatataactgctaagataccttacttagctaaaactattttggaaaaggatctcattctggcgtgcaagtactgctgaatgctattgctgcagaatattctgcttatcatcaaattgataatcacattaaattaataaacccaacagatgatatgggtaatatcaagttgactttccttacagctgtgtccttagagttgactttcccacattaaattaataaacccaacactgcttcctgaaattaacagcaaagtcacagaatgacaggcttgggagtggatatatggaaaaactccaaaatttagtatagacagttactttgttatatgaacagtcacgcttggaaaattattcatagatacaaaaaatgagagaattaaaatttataatattaaagcacctaagctttggttatcactggaaatgtataacaaagtaaattcaagtcttattgccagtaagttttacccagttgaaacgactgtgctaacaaatatattgcttagaatatgtccagaagaccatgtactacagaggaaattgaatactccctgtgaataaagagagccatgggattccaggtaagtttcttaatgctgacagtttcaatgagaaaataaaaatttcaaattaaaaaaagattcacttgagggactgaaataaatttgatgaggctgactggattataaatgtgtgtttctgtgcctaatggtgggcagggcagtgtaagacatgagctgtctcaggaaccacgtaactatttctatgggaatacaatgctaagctgagggaccataggccacaagataagcttagtttcttacatcaaagatgttgtgaccaagtatatgtttgagtttttgttgttgttgtctgggtgctttctttttgtttggtttgcttgtttctttattgcaaggggttagctttttttttttttttaatttgggcattgggaacaatttacatagaaaatgcacataatgctaagaaatacctgaagaagcaaggcctgctctttcctttgacagctttcttctggtttcaaaaatggcatcctctagttggaactagtggatattttaaatgcttccaatgcccatatatatagccaaaatgaatagatattgaactttataaggaaatcgaagacaccactcagttagtgatcaaatggagaagaaatcccggcttttcaactccctggtgcttttgttgttttctcaaatgtcccctcttgctttctcatacctccccagagagttatctctatgttattcccactgacaggaaagttgccaagttgattcaagtgctgctgagtaccagatttcatcagggagcttgtatcccatgcttctgcattgactagcattattcaatcaaaataacacaaataaaataaaatagcatttactccatcaggttggaaggtaaagtatacggtgactttaggagagagggaaagggacattcctaataaacttatacttgaaaagggtctagaaataattccagacattttctgctagttcgattacatttgaggagagaaaagagatgagtcacttcagaatgttatgttcaatgcaggagtagacaacagctgtttcatcagaccagactggaatgtactaggttcaccataccatagaccaagggatggcatatgcaaaagtgtgactgggagccttcttttgaaaccagagacacttcagccaaagtattctctgtagcaaaacaacctgatctttactggaatgtgtgaaaactttagtgatgctctctctctataacaacaagcctctctctagttatagtccctcgatgcaccaatgaacctgattactgattggaactggatgtgaggttatcttattcctcagtaattatcttgactgagttgcctttggagaaacaggctgatatggtttggctgtgtccccacccaaatcccattttgaatcccataatccccacaggtcatgggaggcatccgatgggaggtaattgaatcatgggggctgtaacccccatgctgctgttctcatgatagtgagtgaattctcacaatatctgatggttttatatggggctttaccccctttgcttggcacttcttccttccaccatgtgaagaaggatgtgtttgcgtccccttctgatatgactgtaagtttcctgaggcctccccagtcctgtggaactgtgagttaattaaacctctttcctttataaattacccagtcatgggtatttcttcatagcagcatgaaaatgaactaacacacaggcatttatgtggaggcatcaattcctttccaaagaagagattgcattaggaatgtcaggcaatggatgacatttggacatatgatttcatttattactgggatttattctgagaaagtaattcaaactttaatacaaattgtgcaagttttgctttagtacctgttttccacagaaaggactcctttttagttatcatatccattcagtgatgctgttatcaaaatccctacatggatatataatcaaatgcaaataagcccaagaaatgtctattttgctcttgaattacagcattctctatgcaaataagagtttttaaacttgcacagagatttctgtgttcaatgccagcaccatacaaaacatttaatgtgcactaggcttcaaggttttaatgcttttcatctttttctttccacagagcaggaacagtgccagttcacagatctctccaatatgctatgtatgtttttctgactgatgttagaagtttctctgatttttaaagttcagtgcacatcagcacaagcaaatatgatatttacaaagatgactgctgagagttccaaagtcatccgaaaaaggacattagatgacacgtttttaaaggcttctcagcaccaataaaacacggaaaagtccaatgatgtaaattaatcttataaaactagctagtaaaacacataaacctgatataatacatgaaataaatgtcaatctttcctgaaatactattcctgatataatttgtaatctgtttggagaaatggaccaattttgatctctcaagcatttctgagataaattaggcaaagcctttgcataattaaggccatcatgataatcatttggaaaagtcataagaaaaattaaagcaaatgagagcttgttcccaagcttgcaattatgtagggtgtttgtattgtacttgtaataaatacaaccaccactcttacttatctgtaaagtgtacatgagctgaaattacttctccagttgtctatctaccctcaatttattcaaataaaatcagtaagtactaggtacaagttcttagtgctacaaagggctcaagagacaaatgggacatattctgtcattaagaagtttaaaatcttattggggaaaatgttaacaaggggagaacctggggaaatgtatacagaactcattatatttgcaacttcatgtaaatctgaaattatttcaagaaaaattgttacaaaaaacttatttgtgaactaaaatatatccatgtgtaattacaaagcaataaggcataaataaagacagctgatgaagaacagcaggtgttacttgccaatcaacaatactgatggtgaatactgggggccttgggataagccagccagttaaccacaaggtagatctggcaaaccactgcctcagtgtgaggccacctattttcaatctgttgtcattatgtagtgagaccctgaaagcaaacttattttacaaataccacaaaatatcatagaagttttgtagaaactcctgacctttttttaaaaggtaactccttttttgttccacccaagcacacccaaaccaaaagcaaccaaactgaattttgaaagacacaagccttttagtacctacaataagccaaaataaataaccaaaggccttgaaaaataccaaggactgaaatatgagtcacaaaatcttacttcttttttttttttttttttttttttttttgagacggagtctcgctctgtcgcccaggtcggactgcggactgcagtggcgcaatctcggctcactgcaagctccgcttcccgggttcacgccattctcctgcctcagcctcccgagtagctgggactacaggcgcccgccaccgcgcctggctaattttttgtatttttagtagagacggggtttcaccttgttagccaggatggtctcgatctcctgacctcatgatccacccgcctcggcctcccaaagtgctgggattacaggcgtgagccaccgcgcccggccaaaatcttacttcttagagtgtggtcaaatactgataaatcagaaagaaatcaattttctagaaaacaaaggatataacacatttataaataaagttttaaactgtaatccccagtgcagctattttaattagcatggtcctctaaatttgttttagagaaaacaaaaggaaaggaagtagttgttttcatgagtaacaagggtctaaggtataacctcagttgtgatgatctccctctgaatcatgaaatggtctaaactgaatataatgctttatgtatagtgtatgtgttcaagtattaataaatctgaggtatggtcagcaagttgcattttgaggcaaatgtgtctcataatcaaaagccatgaatgcattgcatttattgtatagatgtgggaaatagggcacataaaaacaaaactgggcagagtatagaacaatgagcacgtctctagactcctagttagtgagcaacaaagcatgaatcaagactggctaggtaagagaggtgagtcccacctcgctctgacactgtccaacaggtggtgacattcagggactctgtgactccatctctttgtcaagtgatgttcatcaaactctttatattaattgccaaggagcttatccctgtgagagctcactctgaaaatggaagagctgtgaaaatgcctctgattttcatcaaaataatcacagggggttattaacttttcactctatatttctatatttaaaggacatggttctcccggggatgtcttttagataatataataatgagaaagctataatgagtttcttcagtaccaaggcattttgttatttgttggaataaagtggagcagatgaagaataaagaaatcagggaatgggtgtataatacaagaagctttagattgcattggaatgggtgtataacacaacaagctttagattgcactgagaatcaaggcagggatgagaccaggctacaggtgagaatgaatcatcctatttcactgcatccctatttgtaattcaggtagaaattaccatcctctagagatcctctaattccatcttattagacaacactataatgatcgccaagagaaaaataaaggaaaatcagattaccaactgccatctaattggtgtgtatctattacgtatgcatgggctgctagagactggcacaaatctttactacctgaaagcaatggaatgatcttctgaatatctgtcttgaaaacatattgatccacagctactaaatttcttattatttcccatgtgaggaaagacctctccaagtcactccacctttattaaaagtcatttctgttgactgttcatttgatgaacagacctcagtactcaacagtgctattctgcacttcctaaggcatctgtgtattttgggttctataagtcttcccattaaactgtgatattataggtcaggtgctagaaagacttgacatcttgcactgggaaagtacaaagatagtgacgttcagtcatgtaatgtaatgtaattccattgcctttgggtcacacatttggataattgacagcctttaaataacaagatggttggtatatttctcagttctttccacgtgtttttttttattgctctcttgaactacaaaaatatgaatatggatgtaaatgttcatgttttccaggatgtgagcagctgttctcttgaacttgttacgggaactaatctatttaatataaatcaaacacattttcagtagggacttttaagaacagtgaaactgatgtgtaatcacaacacaatttaatttttgggtgggaaagatcaagaaagtgtcatctgttaattactcctgttatacgatctaattttaccatttctaaatctgtattatatccttaataaaaataaaatatatccattccaatttacagaagactattaaaaaatgtaggtcaacttgaatatttgttggttatgagattataaaaaaaatttctcctttaatataaaagccatacatgtcctttgaagaaaacaaatggagtacagatttaaaaattagggaaaaagccgtatattttacatgtttaacaccttgctgtatattcattcaggctttaccatgtacatttgtccttctgtgtattgtgtgtgtctataagatcatgcttgaaatcatattttgtaacacatttttatttagtaatacactataaacttctttccatgtgaacagtttagatgggtggatggatggatggataaatcggtaatagatatttacaatataatatttgatggctaaatagtagttaactctattggtaaattttccaatcaatctcctattgtcaattggttggaaatagttttttatcagtttgacgtgcatgagtttgtggtttcactgtgcattgtaatcaacatacttgtattgatatctatacacatgttctaaattattttacaatatgattttggaaataaaaagtttagtcaaaatatatgttcttctgaatatttttatgggattaaaaaattgttcttcaaaaagtctacaccaatttaaacatccaccatgaggataccaccttgaaaatttctgaacatcttcacaattactagtcattatctttgaaaaaaaaactagttgtttcttgttttaacatttcattgtgttactaattttaataagagactcaactcatttataagtaggtaaactacagactggttactagatttccaaaggaaataatctaaagaattaaaagtaccgtcacttctcttttcctctccttccccaacacatgttttagaaatatagaggttattagtgaagccttccaaagccatacaaagatgatacaaagaatgatgatattttccaattcttcatagaaaccttgccaaggttgactataaaatttcatgatctaaaagttcttaaatgttgaatgatgaaaataatatacctagagaaaaatggaggaaagaatcaagtccttctaaaattaagcaacagtggagcagaggaaaagaagatggtactgctgctacctctgggccctatttagttattttcacactccaaatgagctattctctttttactaggtgcatggtggaaatggcataactcctcactttagtttagaaacagaacattctctcacagtgggttttatattatataacaggtttgaaacagaaaataaagttgatgtgaaaccatcaacccaaacagttaaaatggcagcatatgtcaccagtgcataaaggctggggctgtttctacggagagaggaagaagcctcgagcacaacattagcctggtttggtccacattttagagcacagagatgtgactatcccacagagataccagaactaataacacaactaatcaactttgcccagaatcggattcctgttctatgatgtaaccactgagaaaaaaaagaaagtgtttattttttataaagacaatgttataagcttttatttgcacaatatgttgttgatgctgaacacaatcctagggaagtgatcatagctgagtttctggaaaaacctaggttttaaagttgaggagacttaagtccaaaacctggcttcatcacttaccggctacaatactgggatatgttaacttcccttgatttcagctttctcgtctgtgaaatgaagatgataataatgctttcctgcccagattactgtattttagataatgcaactggcaaccggcaaatggcagaatggtgaaagataggaaacaatggggcagtatgtcagagtgacagccacttgctcaatttcaatcatctgtgggtagggatgaaggatgagagaacgtggagaaacttacacttaagaaaatcaaagtgagtttttgttctcttaacattgcctacataaatcagaatatgctaaatttaagaactgagtatatttagaataggttttctatttttaataatgccattgttcattttagtgtattattttagtgatgtgccctttatgagaggatgagagtcccatctccatgggaacaagattttgaaaacttgaagacattgtttttgttatattgcattcctctgggaatcatttaggatagcattgttgtaataacattttattaattgccttctttactatattttcctaaacactatatggagaaaagtactgtgattacatactttgaaccttctctcctggagcttccaacaaaatgtacccaatatattaaaaaactgatctacaatccatattccttcccttttcttacttgattatacctgggagaataagacttaagtgtctattcctaacgctgcaggagtatgaagcttattcatagctgagagcatagagagcagctcagacaaacccaggcaggatcacttcagaatgccttttggaagatgctttgccatacgcaggagtatgaagcttatccatagctgagagcatagagagcagctcagacaaacccaggcaggatcgccttttggaagatgctttgccatacgcaggagtatgaagcttatccatagctgagagcatagagagcagctcagacaaacccaggcaggatcacttcagaatgacttttggaagatgctttgccatacagggagtggcagtctttagaagagggtttctggaaggatcacagaaatgcgaccacagaagtgcaaagtctccggtcatcaagctctcagagtgttctctgcaacaatgtgacagggtataatgattctataaatactgatctccagctcacccatctgccaaggaaatattttcccagcatctgaattaagtggagaactgcttaactaaaggacagatgaagcaaatcatccatcttcagcgatcactcatggctttgttcatgaatggtaatttgtggtaataaattcgttcttttatttttgctacccaaatatgtttgtttgttgagatttttctaggtttagcttggagaccaaaatgagggacaggagtaaaatatcactgtcttttatcatgctgccactgagggagatgtcacattcagttttgaacagtccctaaactttaaatataaactaatcaatttgccgatccagtgacctgaaaatgccttgtggaaatggacagaagagaaggaggggctgggggtgaaggggcagagaagaaaagatcatggtctcagctacacaagccatgaatattatgaaaattaaaatttcattataatcataatatttctcactcctgtgcttgagtctggaaagagaaatcaaagtctttaatgctacggtgacaagtagttactctctggtaacaatctagatttcctagcaggcctttgttatgtctgggcctttggagaatttttctctagattattttgtctgtgtctgaaaggttcatacacatgctcctgccaaagcttgtcatttgggggtcattttagtcactggcaggatatagctagacaaacatgaggcagctgataaaggacaggcaatgccaaaaattaaggtctttcacagtagatttctgtttgcagtgaaatgaaatagactcaataccaaacaaagcaaaacaagttaaaagtaaagttgtgtggtcatgtaatatcttgagtttttggagtgtgacaaaatgaagatggtaagagaagaggaacccctcccgcactggggcttgtgaggatagagagcagctctcccgtggcactgcctcactttctattttcagcctttccatccatgcccagtactggctcacatatgaaacccgcctcttctggatgtctgagcccccttattaatctcatctctgtttattctcataaagtgatgccaagtgatcaccaatggagttgatacaagccggggtattcatgactgctaatggggtgatgaattacccattcaaagcatctcctcaccaattttagtaaaaaacatagatactaacacagaatcatgtagtcccagctactcgagaggttgaggcagaaagattgcttgagcccagggggtgaaggatacagtgagatatgaccatgccactgcactccagcctggatgacggagcagaaccctgtcacacacacacaaaagaaacaaacaaaaaacaccagagataaaaagaagtaggacaggggaaagagaagagcaaagaaaaagaaggaaatgatgtaaaaattaaatgcactcagccttctacatgtagtatttcctgctcaggtgtgctaaaatttaatttaaaaattggatcaatcataagcctttctgagaaaaccatgagaataaatgttaaaaatacagatattttaagaaaattactgattgcatgtattacagtttttctaaggattatcttcttggaagaaaacactgtcaaatggtattttaggtttctgtcacaaattttgaggtgctcacaaactaactgctgtctcgctatggagctgtttaagatgttccccactgaaacatgaatttataaataaacagatgaataaacccaaaggaattgtgcaattcttgaataacagaatccattggctgcacaatttgacaatttaaacacaatgagtgatttcctaggcttaatcagccttcctcccaatctcagaagcgtaaggttgcctggaagtgtttatttttcatgtttatttgtttcatattcccctactacctactaggcttgatcatatatgacattttatttcattgttcggacaattgtgtcaaataagcattttatctttattttaaaaccaaggatatctttgggtggagagatgacaggacttgcttagagtctaacagcttgcaagaggcataatcaggtttagagcagacgtcttccaatagaaagagcacaaaggaggtcaaatgctaatgttcaatgagtgatttctatatgtcaggtacttttaatgtactaatgaatttaatctttacaacaaatttaaaaatctataaaagtatcattttaaataagaagataatgtggtatggagtagttaatgaacattaaggtcaaacaggtaaatgatgaggccaagacttaagccacagcagcctggccaagttggaatcactattcatagtacctgaactgaatagtgatgtacacattgtgcacatgtaccctaaaacttaaagtataataataataaaattaaaaaaaaagacttctaaacattttggttgactaacatagctgtaatgcaaaaagcaacttttagttaatttttaaatgaaaattttttccactagtgtaacaactctataatattcagtataatttcacatatgtatagattgaccagaaccaggcatattcctaatagtgcacggaaaaagctaagtataaaagatagccaggaagtgataagattgtgtctatattttaagcatcatcgcaagtgcattgacttggatcccaggtaaactaaagcaaacaaaaatgataagcaatgcagaggaaccaattatcgaaaagtgatttacattcaattaaatcaagagttacattcaactttttcctcagtccacaatagttggaaatttgaatttaaaaagacatataatggcttttgattattcaaaaacacaagtcttccattttctactccacagtcacttatttcgtatgtaaatgattatttcataatacagaacagctaaaaacacaataaataaaatatgacaaacttatttttttatattaatcgccatggttctttgttgcagaaaaaagatggaaagagggcatgagaattaagaacggtcatgtgtgtaaaatatggttgaagtctagattcagtcaaaaagatttttctattctgctaaacattcatttatttatttattcattttgagacagagtttcatgcttgttgcctaggctggagtgcaatggcacaatctcagctcaccgctgagttcaagcggttctcctacctcagcctcccatatagctgggattacaggcctgtgccacaacgcctggctaatttttgtattcttagtagagatggggtttcaccatgttggccaggctggtctcaaactcctgacttcatgtgatccacctgcctcagtctcccaaattgctgagattacaggcgtgagccaccgtgctcagcctgctaaaatttatgagaaacatcagcagaatttatactttgtttacatttctagatacttttatttaccacgcatctgtctaaatagaaaaaagctctgctttcgtatcaccaaaggaatatatatttttaaaatctgttaacttatttcacattgtcacaggctctacacttgaaaatgtttgattgtcaaaagatccatagtagaagaatgaatttaaaaaacagttacctttagactagcaagaaaaatgtatactatcaattatacattaatttttcttatcaaccattgttcttagcaaagaaagactgtaaagtaaattcttttcaagaaaattcatggtaggctgtttctaagtgttcactggataggatatgtggactaatcattacacattcctttctgcccatcaaacatggaggcaatgcatcagtgtcatgtccagactgtaaactccccatggggtcaaggcctggaggatagggtggtaggaacaaaactgtctccttctgtgctatttttccaaagatcctaaagcagccttcccaataaaattaaaagctcaatgcatgctgttacctaaatagaaaaaaaatcgacttaaagacacaatatgcatttctctccctggatatagtcttagttaaacttatattttcagcttcaatagcatttcagcaagttttgtgctatctattaaaaaattgcaaaaaccaatagaaatactctccaaaatttaatgtattagtgctcaaaactaggctgagagattagagcactattatcagtctcttaggaagagaattttatgaatttggtataatatcccttctcaataagagacaataaaattcatgaattttcatgaataacaacttgcatttgagtggccaatatacgccaaagcatcattttaagtattttagttcatttagtcatcaaaatgaccttaggaggtagtttaactgtaatctacataattcccattttacagttgagaaaattgtggtttagggaaattacaaaaacaaactattttctcttcctgcaccacaatatatatgactatatgtattataaattttaactaacctgctatcaggataatttgaaaagatttttaaaattttaaatataatgcaaaataaatattttaaattttaaaaattaaacaaggccacttagaacaaacaaggaataatgtgagacaactgagattagttaattgctatagctgatttttctaaaaatttttattgttgaaccagaattaatacaaatacctagacctaaacataatgtgagctgtattgtacaggtcttagaaccagattacatagtaatatttttcttttattttccaaaggcaaaagatttaatataaagattcaagattcacatcatgacaaatgatacaaatttatgaaatatcctttcttcttcctctttttgtattttttgtagatggtttcaccacactgcccaggatggccttgaactcctgggctcaagtgatccatctgccttggcctcccaaattgctgggattacaggtatgagccaccaagcacagcagtggctttttctattttaactaaccttgccatctttccccctgtgcttctctgttactgccccctcctgttttcctgctacattgactggttatattgacaggtgtgcccctcccccagtagcataggatgtttactcttagacaagctaggacagtataaattctaaaaggactagtcaactgcagtagtgagatgggggcaagaggcaagtagaacaaggaattctatctgtaactgactgtgaacaatcaactgaaataactaactaccttcagaccagcctgttttttttaacatacactttaactttattaacatctaggtaacatctgtaatattccttgctcctcatccccaagtatgctgctagctgtccatccttctgggtagaagtgtattctccagttttacttgttgatttttggatgtgtgctgggggagaaaagcatattgtgtttatagtcaccctagactgctaaagtatattctccagtaattaactcaaagtggccatatgtgaaacataatctctaaattcttcaatatcaaaaaatacctttgttttatccctaaaatcaaatgctagtttggctggatataggaatctaggattaaagcctttttcctgcagaactttaaagatattgctccatttactgctagcatccagtgtgtccagtgataagtctgctgtcaatctgattcttgttccttggtagattatttctcttctctctatagaagtccttattattttctctttatcattagaattccaaaatttcaccaagatgtgtctagggtcagtctcttttcatcaatcttactaggtactcagcaagcactgacaatctcaagacttgaaactttctttagttctgcaaagttttcatcaattatttccttaattatgtcctctgctccattctcattattccgttttcctggaattcctatcaaatgaatgttggagcttctggatctatcctctctatctctttgcctttctttattaattatctttttggtcgtttggactgtattcttagagaattcttcaatttgatcttctagactgttcattctttcttcaagtatgtccattccgctactcagatcatctactgaatttttaatttccaacactcctggatgggaacttttcaaatttccaatctccttttttatctctctgatgctattaatcacactacctctcaagttttcctctatttcctatgttaagtctgcttctttggatgtcagttcttctgtttctagagttctgtgtctctcttcttctgttttcttaaaaagtttggtgactcctgttgaaatactcaaatttgtatgtgaatgttttttatgcttatcataacctatctctagtgactttgagggagaggccaaacataaagttagacagggtgtgccagttccttgacttgtgggcacaactgtttcctcttcctcctgggttttgtacaccacctggtgtttcaccaacattttcttcccagagtccgcaaccaaataactaaagggaatttctttttgtctatgtgagttttcttttttctcagtcagggaggtagctttacctttcctatttcagagccctttccttcctcttcctcctctggctcagaatcctctactgagtcaatgaaaatagtttccatgccatcactggttatctcaactccatgctttgcatctaccaaagtatgaccctgaaaggttgagtcttattccttacagaacactgaagtctgttcctcctccttctctagccctgaggcctcttcttcctcttccttctctggccctgaggtctcttcttcttcttcctcctccagccctgaggcctcctcttccagccctgaggtcacttatccatcgccctccatccctgaggcctcttcatccagctcctctagctcagaaaactcttcctcttaagtctctaagttgttcatctactctggcttagcaactttttacatagtaatatttttcaaatatggcagcttttttaaaatgagctacatctgaatcaatgtggaacttacagattaccagataacattccagacctgctgaatcagaactttcaagtatggggcttgcacatgtacattttacaaatacccacaatgagttgcatgctcaatcaaggctgagaatatgtgtcattataatctaccacattcaaagcacttccttatctatcagtcctctataaataccaatcaccaagtttcaactcattgtagacattttgcaaggcatcatgacaatatgctcagctttgtgatgagccaacctaacagtcatgacaattttgagaatatagtcagttggtcaaaccctatcctcacatcctaaccatcccagatcttcatcttgaggtccaagtgaattggagtccacctaactttcctcagaagagagtatcagtaactcttgccctatcagccagtagggttttaagaatcactttcttctgctctatgtcatgattcacgagggttctgctgacctgtttccaggcagaatcaggacaccctctgtgtctacccacctgcctccctctactagtgaagactttcagggtcctgagtgccccgctcgagagcatctccagtgctagccttgtgcctgacttccctgatttctatgacagataaacatcccatctgtccctggatacccctgaggctgatgttcccacctctcccttggagaagtaataacttgcttaaattcccataagcagtaagtaatggagcaggtattcaaacaggtctctgtttccaaaggtcacactttttctacttttaaagcatactgattaaatgtttctccccaaaatgagatgttctaagcaagcctttggcaagtgctgaatcctgagacatctgtaattaaattctcttcatgttgtacttgtactgaagatatgttccattgcttgtttatgcaagaactgcacactttaaatacagagctgggagaggcagaattgtccttctgttaaaaggatgagaattggactcgtattgttgccaagaaagagggttattctattcaacgcaggtgtgaacattatggatgcctttcataggagataatatttagctcaaaacgaaaaagtaattttatttttgtcaggtgcttgcctacagcaaaaataaaacaaaagcatgaaagactgcattgtgtaacatatttaggaaaaacatacacaatacactcattaatttatataaagcagtcatttgataatcatgatgttgatgataatgaatagtgtaggcatactagagtgaatttctgagaaagggatgggatttggagggagtgtggaggaaatgggcttatttgagggagggacatgagagtggttgcagaaatgtctaagtttataggttcagtagtgaaaagaggagacctaggaggtaagagagtgagagaataggcgggtatggtggctcatgcctgtaatcccagcactttgggaggctgaggcgggcagatcacctaaggtcaggagtttgagaccagcctgaccaacatggtgaaaccctgtctctactaaaaatacaaaattagccaggcgtggtggtgcatgcctgtaatcccagctacttgggagcctgaggcaggagaatcgcttaaatctgggaggcagaagtttcagtgagccgagatcacgcattgcactccagtctgggcaatcagagtgaaactctgtgagaaacaaagaaagagagagagagaaggaaggaaacaaaagagagagagagaagagcagaaatgtcagacaaagagtggaaaagtaagatgattagaagaatggaacaggattttgggtagtgctaagagtacaattgaggttggtcataacaaattaacattttcccagtgtttgtgactttctctagcagcatttagcaactagagtgcaggaactctgaatgtgaacaactaggtcactacacagatgggatgttacctgacaaatacaatgtgtactcagagttaagctagtttagggcagcagcatgatgaccaaattgaaatggcacataagaagggaatgaggaaataagatgtcgatgaacacagagataaaaaaaaaaaggctgaagaatggcctcgcagggaaaagataaacaagaaggttggagggagagtaggttgtggtcagagtacaaggtatttgattagtggttttggaagtgcatagttttgatgacaagctaggggtatgactactgggtgtatgtgccttaagtggagggaagaaaaacactggagataagggcgccaaagaacagaaggccgagagtaaaggagattatgcatcattacagaggaaggagatttagagttaagaagacagcaagtctggtgccaaagtcttggataaaggaagagcataagatggatagtgaataggaggatgaaacaatgatatatttctatgacaacattcttgaaacattctacttagctcattttgagctaagtagaggcttcgtaaaagagagtaagtgcgttgtgctctggtgggagtgaagttcaaggtggatatcgtgaactcctcactccctaatcctggggaaatgtgataagaggagaaagagccctttgggagaactgtagaggaactcagatttcttaactcttactctttcttggtggtgccctttatgagtagctgtgcgttgcctgtcactcagcaacaaccctgagccacaagacagagatgccaggtatctggcataattgaagctaagggaaggacaatcagcaaaagatatggaaaactggtttgctctggaccaagcagagaaaattgttcatcaattaaattcaacatatatttggtgagaaattactttggctaagagtccacagatgagataatttatactcactgccagaaataccaaactgtttccatagcccatcatccttgggacctaatgtgtgtatctgatacaggaggcagcctattctttttagatcatataaaagaaggaagcaggagccatgacttctattcttagttcttctactaatagatcataagcaactacctacaaccccaaaccccagtctcctcacctagaacatgagtgatgattaactagatgatcactaattaccattccagttctcaagatcagtgatgtcatgattcacggggactccccagatagaactgccatatctactctgcgtccacttgggcagacttcctgcctaattctaccttacttcatggattccctcccacaaacttccagaatgctgttaagcagcacccccaccccccttactcaatggccttactaaacagtcaaaaagagcttcctttttaatctgggcaagaaatagccctctattctttaaaggacatagccagttgcctctactggaactccaaaaaaatgacaagcaggtatcatacctttgtattgccagaactcatctctttaaatgaaaatgagaggagagggaacaaattaggggcaattggaagatttcctaatcacaggccttgaaaaagaaagtccacaaagctgttcagtctcttggagtcataagagcaaggaatcattgagatgacaagctaaactcgctcaaagagatggcattatcaacctcccttttttgttgctgttttattttttcctcactccatctgctcagaggaacccaatcttgctgaattggtatgaagatggctggagaattataaattaatgggagggatgccagagaacataaatagatgacaccgtctcacatggccaatacatttattcagtttaatagccaatgaaaggcaaagaaagccactcatttaagatgtttaaaattgcacaaaatgttaaggattgtatcatagtaaaataatactcaaatgaaatatatgccagttccattttaaactataaaaaagagaatatctttgtataaagcctctgtattaataaacattgtattccgtgtaagtgcttaatgtgttagatttcagcatgtacattaaactttaaatgtaacttcccattatgatatcttaagaaaatttctcaatctattaacaaatgagaggaagcaccttgtgtgaagccttgtgctgggctccctaggacaaaggcaaagttcaaggaagggcctctactctaaagaatttacagtcaattaggaaaactgtacaaaagtagtaaaatattttcggacacacacacacacacacacacacacacacacacagccaacagccacacacaaaatacgtaacatatcaccattgctaggtagtgtctaactgattgccagatgtctactaaagaatgttacagtttaaccctaatatcagctgttcaaaactcatttgataggtaagtaaatgaatttagagcacttattcaaggttatatacctagaaagaagcaaaccaatatatgaacttaaagtcaaattttatcctccatttactccactgtgctaccaactaaagtgctacagatttttaataaagggaagaacacgcttgattaaaaatagagattagacatctcatggtatagagctcttaatagagctcttaataaattatttttataacagttttattgacatacaattcatgtaccgtaaaattcaccttttatggtgtacaatttagtgttctttagtatattcttgtggttgtacaacatcaccactctctaattttcaaaattttatcatcacaaaaagaaactacacactcattatcaatcatttcttaatcttccctttccccagcccctgacaacaactaatctatgttctttctctatgaatttgccaatactgggcaattcatatcaatggaatcatacaagatgcagccttttgtctgtcttctttcacttagaaaaaatttttaaggttcgtttatgtcataacagggtgcactgacaggtacagtaaggcctcacttggaaagtttagggcattggcataaggatcattgaaataatgcacaagaggagaataaaataacaaggtgtcaataaacatgggaatctaaatgaggtcccagtgggagaagataaacaagaatgttgaagggagaatagttgtggtcccacaccaagatattttaatgtctttttattgacaagtaatattccattgtgtcgatctaccacattttatttctccatttatcagttaatgaacatttcagttgtctccacttttacactattataaataatgcagctgtaaaatttatgtacaagttttacatgaacatgtgtttttaaaaaattttcttaggtatataaaaattttcctagaaataaaattcctgagttactctgtttcacattttaaagaactgtatgtgttttccaaagtgtctgtaccattttacaattctgccagcaacgcatgaggattctaattcctccacattcttgccaacacttatttctgtctgacttttaattttggttatcctaggagtgggaagaggtatctcattgtagttcgtatttgcatttccataatgactaatgatgttgagcagttttcttgtgtttattggtaattatacaacttttctggagaactgtctattcaaatgcttttcccattttaattgggttatttttctttttaatgtggtctgtgtttttacattctgaaaacaaatctctcataagatacatgacttgtaaatatttccttccataatatgaagcgtttttcactttttgatggtctcctttggaacataagtatttttaattttaatgaagttaaatgtatctattttatcttttgtgacttgtgatttttgtgtcttttctaagaaaactttgcctaatttactatcatgaatatgtacaccaatttttcttctaagagttttatagtttaggtcgatgattcaatttttgtatatggtgtgaggtaaaggtgtaacttcaatctttttcatgtggctgttcagttattccagcaccatttgttaaaatactaccatttcccccactgaatagtcttggtacccttgtcaaaaatcaattgaccatcaatgttaggatgtacttccagaatctcaattcagttttactggtgtatatatatatatacatatgtaaaatggaatttatatatatacacacacacatatataaacacacacagacatgcatatatatatattcatataattatattatatatatgtctactcttatgccatgtatactggcatacttcttgatttggtttgtagtaatttttgagatctgggaatgtgaatcctctaacttcattctttttcaagactgtttcggctataagtcccttcaatgtccatataaactttaggatcaggttgtcaaactctaaaaataaaatgccagctgggattttgatacgaattatgaattgaattgaaactgtagttaagtttggcgagtactgacatattgacatgttaagaatattaagtcttctagtctgtaaacatgggatgtctttctatttatataggcattatataatttattttgatgatgttctgtagctctcagtgaacaagtattgtactttttttcttttttggagacagatccatcacccaggctggagtgcagtggcatgatcttggttcactgcaacttctacctccagggttcaagtgattctcatgcttcagccttctgagtagctgggactacaggtgtgtgccaccatgcctgagtaatttttgtattttcagtagagtcaggatttcctcatgttggccaggctggtcttgaacttctgacctcaagtcatctgcctgtctcagactcccaaagtgctgcgattacaggagtgagccactgcacccagacagtattgtacttcttttgttcaatttatttttaagtgttattcttttgatgatattctaagtgccattttcttaacttcactttcagatttttcattgttagtatatagaaatacaattgattgttctatattgagcttgtagcctgtaatattgtcaaattcatttattagttctaatagttgtgtttgtgtgtgtgtgtgaattcttttgcattatctatatagggggttgtgtcatttgtaaatagagttaattttacttcttcaaatacaatgttaaacagaagtggcaagagcagacatttttgtcttattccttgttctagggggaaatcattcagtctttcctaatttagtctgatgttgatgtgcttttttttggtagatgtctttattgaagttctcttctgttcctagtctgctgagatttcattgtgaaaaggtgttgaattttatcaaatgctttttcttcattgattgagatgagcatgctatattttgttctttattctattaatatggtatattaaattgaagaatgtatgtacgtaacaacaacagtgcattctgggatagatatttccatttggttatggtatatattctttttatatgttgctagattaagatttttatatttcattaaaatttttttcatttatattcataaaggatattgatcaatatacttatttccttgtaatatactttttttgatattagaatattaacttcattgaaagaattgggaagtgtttcttcctattctagttcttcaaagatcttgaacacattaagtagaatttttttataataagcttttaaaaaaatttgctatcttttggtcattttacttttcccagaactgagtttagtgttctgtattatttgtcgtctatattctgtacataagttttatagttcttaacacatttaatccagttaaattagtcaagaatagtgagagcactcaatggctagaaataaaactacttttcactttaatatcactgggtagagcagtacatataaaggttcagactttaattttcccttattttgcatgttttttcttactctgagtcattatttacataagaaattgttttaaaggtcacttttaagtgaggaaaaaagctcctcactatataacacaaccagatttcacttagaattgaacccagtgaaagacttttacaacaaattctattaatagcttgacttagattctgttaataggttgacaatttgagctgtctttctacccattgtagtaaactcataaacctaaaggggctgtctaagaaatgagaataactagaacttgaagagtaaattatgaatatgtttaatgttcaggccaggctatctttcctcctttggcatagtcaattcccaagtcaaggttggatttaaaatcaaactttctagtaagagtaattggcaaaccatctccctaattagcaggggtttaatcaacttgagaaataaaaagaaacacacacacacatacacacagacacacacatacacacacacatatatttataaaatagtataatatgcattatctatattacatataatatagataatgactatatattataattattataattccacagaggatttttttcttttttaagctttaagtcacaaatgttcttctttcagtataaatggagattaaatgagaaagggggatacataagcaaatttcttctaatatatactctttctactatcctaaacggctagcaggaaagataattctaacgatattttacacaccatgttgcaaaggtttaaattatcttgaattcccccaatttacttattccacacataaaagaaatgtcaaaaatggctagtaagttttctcaaatctatgagaaatgtcaaaactttttagaaaattctagcttatggctatcttatttactaagctatccatcctttgcttgactcggtataatcttgtttgctaactatagccttttagagaagagaatagtttaggacattgttggaatctggacgtgggtgcatgtgtgtgtcttcatgcttgactggggctgatgggttatcctgtcacgatttacctgtatttattctaggctaacctgcaggtgtttccatagcaacgtctctcgatgactattattgttgtgacaccaaaggaggtgacaatcttagggagcctttttattatatagagagaaaccaatagaagtttatgttctctgattattcatcaccctttattggcagagtgtggccacctctgggttttgatttggtgtcctttcactccactcacacctaaatctctctgctgtctgttcttgatggtacaacacaactctgccaactgtcactgttagaaaaccccataagaagggaagaaggaaaggaaagcgtgtctttcaaaagacagaagttttgatgccttttctttctttcttcccgaatggtctgcatgcttgtgcttcccccaaatttatattgaaacctagtcactaatgtgctggtatgaagagatggtacctttgggaggtgattaagtcacgagggcagagctgtcacgaatggaattagtattcgcactggactgggcctttacaaaaaagacccaggggagctgatttgcctccttccaccagtggaagtgagaatgcaccatctgtgacccagaaagcaggccttgccaggcatcaaatatgctggcatcttgacatcgaatttttgagccttcagaatgatgagaagcaagtttctgtcatgtataagtacccaggtaatggtatttttgttatagcagcctaagttgactaaagcattgatcaaatgcttactatttatcagatgcttacacttctatagacatttattaagtgcttctaggcacttaagtaaatactccatgtattgaggaagccactgagaaaattaggtattatactgaccccaagttttcatgtcagggaatatggggttttttttgttttgtttttcatctttaaagctttaaatcacagatgcccttctttcagaataattgaggatcaaataaggaaaaactgggaactataaacaaattaactttttgcctagtgaatcattttacctaaaatcttccctgactgttaatcttgtgtatggcattcacgtctctcctgagctttgcaagtctacctgccttgctatccttagaatgtgccttttctctccacaggggaaggagcattcagctaaaaatgaggctcagcagaacacattctctgggcatgctaggaatccacagctcatcggtacagaaataaaacatggctgatttatatacaaacaatggtgacaggattgtcacagcacacatggtaacttcgctggcttggaaatcatcccaaaatcaactaacgagcacttcaaaaaggagggcaaaatgaggctctcatgttgcttgtgtgtgtgtctttcttcaaagtcaagtgccagatctacttagagcagacgttcttatgttttaaaagctgatttggttaatttactgctgctaaatgtagaatcagatattttcccttttataataatataacttaggatgcaagattttttccatctcattctcattaactagatccccatatttataaactgcccctcttatatctactgatcagttacatcacaaatattttatcttacagcagagctagcccaatgaacaaaatattctgaaataaatgcatttgaaaaatgaaacaacttgagccagtatagcatcatgtgtgtagatcaacatgaattgtgtcattacaaacaactcaaagtttaagctacattaaactataagatctctactgcccattacagctcctccaggctatgattttgaagaacttagcccaaagcagaagctacagaaaaatttgactttgagattttataagacaataaattgaaaatctttggaataacataatttatgaaacaaaactgttttttaaccctccactcccatcacttatctatacagaatgcagtccaaaatggaaacagaactgatgttttctttgggagaccagaataaacatttagtaagaatggtgggaaaaggctctggattattcagttcattatttaacacatcttgtgtcttgtgcccctgttatgcattaggctcagtgcaggatgctaagaatataggaggaagcaatagagaaatgattgttcttgtcttcatagagtttataatcttgcatgggggacagtcaacaaacaagttaacaaatacataaactacggactcctctttttaggagagaaaagtattatgtgtcaagtatacaatataatttttagctacactaggtaactgtatgagagatttttcatttataataccattatttattgaacccccaaattcctacaaacaatgacatactttagtaaaagaagcatatttgtctatggataatttgtttttagataatcttattgaaagccaagaaaaactgtactttgtaaagtcttcttgggtggtaaaagttaatatgcttttctaatcagtctgccccaggttccagagatgagtgtcccagggagcacatgcccccacatgccttcaaagatgaggcagggaccccacggggtcagtttgtgtagatatggttttgagtatcattgctgtgaaatagctgcaaccaaccagccaaccttcagcagaaagaaaggacaaccaaggcacaggaaaaggtcaagttcttgagacagtcaccaggcaatgaaagaagactgaaacaaatacattcgggggaaagatttgcataaacatcatggtttcagcacagaaaggggccttaagatgacttctgatcttctttacaaaatcttgaacagtaggagcccatttcaagaagagtccaggcgtacggcttcactgatgtcttgggttgatccctatctcatcaatgtcaggggacagcctgagtcccgcacagggacttcggggaagcctagaggaaaggtggctgtgggagaaggagctacaaacctccctccagctttctccctcagagtaattgtcttacttttgttcccataaaaatctaggctcctgaggttattctcaatggaaaatatggtgtaagcgaatactcggtatgaatttcaatgaaatcatgttgtacttctgatcttacagggaaatattaagatccatgttacatagaaatgcactaggcattgctgtctccccatgaaacatgacttaagcacaggatgtttggcaacagctttataacataagtcaaaataaaattggtttccatgcctcccatatagttacataaaaatcataagtggcagaaatgtccatgttttacatttatgctttatgaagtattttgtgctttgtcctattatgtaacaacccagaaagaatatatgcaccggtcaatttttctccacttctgcatacttattttgtaccctttaaaattagagtcctgatcatgaaaaagatccaagcacagactatttttgttgtaaaaatgaaattaaaattgttctttattataatgaggtgaatgtagtttgcacttagcaacacattacacaccatttattcctcacaacgcgttaggtttccttatgcacttatgatatttgaagctcaaaaatgctaaattatttgcccacattcgtacagctagtgctggggattagaattcagatctgagttactataaagccatgcttttttcactaaaagttcttcctcttatgctcaatttaataacagtttagttaaatttgaaacattccactctcattatcatattagaattgtaaatattcctccagaactaaaagaccaaaaatctatattttcttatttgattgaattatggttaaactcccaatacagatataatgaaaacataaaacagcaaaaaaaaaaaagcataacaatattggcagtcttcattttggacctttgaagagcactgagtccataaatgggtcccctaagacctttagaaatgtatttccttaaggccaaaagggtatgtataacccatgacaggaatctatagtcaaaccttttcatatgaattcttaatcaaacaatttataaagaaatgaaacattaaggaataatggtgatgagatttcttttcatttgttcatccaggttttaagagtaacaacaaaattaacattcattgccgtacttttctaacattacaaatctgttcattagcctcctggcacaggaatcataaaaatgatgaggggatgttgaatttataacatcaagggaaggtgagaaatatgctgctcttgatattcaacatgaagatactgatgactgactccaaaactcctgctggcccacagctccacattctcctcagaccaaacagcctgcagcacaggaccttacccactgggagcttatatccacattggaatcaaaattactgaaatgcaactgctttcagccttttctctccactacccactaaatagggtttctatttggctttcagcctcttccttctcccactctgcaaggagggtcctaatttgtctgactagttcttgtgctctgtggttcagaatcagaaagaaatagacaaagtgggcaacaagagaggcaaagagagctggaggaattgcacaaaaaaataaaacaccttgaaaaaaaggtgcgagaacagccatagtagctgaacatactggatgggagagaaaactaatagggtcttaaggtattttgagtaatgacatagtttttatcttcctatggcatttggaaattccagtatagaatttgacttattttgaggcacattttgttgcatggttgtatttggtttgtgtcctttaatgcttataccccagtagggctgcactatgtgggccacccacatatcagtgtgacacagtttgggggagagccaggcaggggacatacactatcactggctttttgctcctcttcaggaacaacactgacccttgcagatgcactgtcaagctgtactaggatggcaccatacggaggccgtccatgaggaaaagaccatggggaaggcagcagtaatcccagctatgtcctattcatcccttctggatcttcacctctaagcaaccaagattttattcccagagctttcttcatgaagcctacctgagaaggaacaatgacaaggagctcacaggggccaactgtggtccaagactcttcagaggataaacttcatgacaacaatcaaaacttcacttgaccacagctgtgtattcactttctggaattgcctcatacacaagaaaaatgccttgaaataagaaaatccttgaataccctacccataaactttaaaagttggaatccctttccatgaatccatatgccagtatttatagtatcttcatgatcagttacttttccagtacatctcaagcatattctgatttccagaacattttgaatcccatcttactgtaactaaccatggaaaatcatggtgtgacaaacagtaacaaagccatataccagtatacaaataaagtaaaataaaataacaaataaaatacagtagttctacaatagaatcatcatgagaagtggtggttaaaatggggcacatgacaagggaagccttagcttagatcaattcctgggagaaaaagaagcgttctatattttaaaagaacaccaagcttaacagacccattcaaatcaatatttcagcctacgcttgcgtgtgcacgcacacacacacacacacactcatgcacgcatactcaatgacaccataaatttcagagacttaaaaggcttatactcttaggcttgtcacctcagcattactttctcctgatctgtaaagctgttctcaggacaagatctgagctacccatgctgaaacataagcttaagaaaagagaggagagcctggcaccgagttatattaggatgcaatgtctattcagcaagaaagctcactggctctaaagcatttatatcaattttaaagattatttgcaaagaatcgtttggtttcagcaaaacactctgaaacaatttcacaattgcaattcaatgcacttgaaaccaagactccctaccagctcagctcacagcatggagacgtacagtgtggagaggtggggcccatatattgcatggtgtcagaacgctgtctgcctgaaaagccattcattacaaaatgctgcatctcaggagaatgagcctagaaaagtgaggaccgcacagcagaggaaaatgcaagctctgtgtttgccatgatttcaacagctgtgcctctcttctttctgggatcaatgcactattttatctaacagcaggaaaggagaagactgcataatgtggcagcaatacaaaaggagagaatgttaatatagaggctgcaactcaatttccctagagactgtaccctccagaagcccaggactccgggatacaacataatgagagagagctgactcaatggagcacgacaagtcatcacattacaagtcagctggaacacctgatggagtcacaatgttttctcattctgtggagagaacaatgaatgagaaggctcttaagagttagaagcatagctatcaagcaagtgatttgtataaatagatgacttcttcatgatactggctgtttaggccaacagagaggatgacagtggcagcatcggtcgctgccatctaaacattctatctggaaataagaaagacatcttcctcccatctaatcctccgactagagctgcaatgaagttgagtcaagtgaggcactagccttgggcaaaaatgtaatgaggtgccaaaacatcagtcaccaaggtagtattccaacataagagctattttaatgaaaatcaatgcaaaaatatccatgataaaaaagtcacattttaaaattaaaaacagaaaacaatcttacatctgaaccactcagctcaccctcctcaccctagtcctggtcctgcccctcacagggatgttggtggcattagatgatggctatgccacgaaactttaaaaataaaaagcactattacccttgagcacctgctggagtaaatgtatggccccagactctctatgaacagagtctcactttgttcttgtaaaattttgaggcttccattattgttccattttgcaaatgaggcacctgatgttcttaaaagtcaagcatctgggctggaattgaatcctggatgtctaataccatcttctgtgctgtttccaccccatcacgccattatccactaacaatgaaactcatcctaagactggtttaatgtattttaagaacttgaaataatacggagaaatcaagtgaggttgtctgatgcctgagttgatgagtcagacactgctcaccttctaaaaagagccctatgtctcagtataggagcctgttaacaaaattcatatcagaaataaggttctaaggatatgcaagggtgaaatctggggtgagcatagaaagaggcaatagaggagactgtatgactctctttttgtatttacttatatttatttttatattttttgcagccatgtgtttggatgaagatgagtacaaagaagccaggtagctttatttaaatgtgaagtttctaggaagggcctctcaacccttgccctatctgtcctgtcctgcaacacatttcaatactaattagctacttgctcttgggctctagcctgtatatggaagagtcccatgtggccttgtagaaggtgtgactactggtaccactggatgactcaggacagttgatcaatcaacagcttcccctggacctgaagccaacattttcaaatgcattgcattgctaacttttactttttcactgctggagttattattagcttctctctttagtttcatgaggaaggaagctatatttctgtaataacatcttaataacttttagcacttcaaaattatttaaggtttttactacagtatctttctctggagtcagaggataaatacgtccctctccacctgtgtctcaggtaaaaatgcagttgctttaccagacagtcaccaatattccttctagctctaaagtgctgtgttgataagtccaggaaaatgtgctaaagacaaggatcaaagaagcagaatgtgtggagcacataaaggggacacgagtcagaaaggaaggcctggggaaaggaagatcaatgtaagggaaatccctcaggtgttataaattaaggacagaaaggtaaatttttaacaggagcaaaagagtaacagctacaggctgtaagctggagaggggatgtgggagtggggaaatagagagagaaaaacattatcccaggtatttcagacacaggaaatgtgttttcacaagcccttcttataatgactctgaggctcactgaagcctgaaaaccactgggctaaagcacagtgtcaatgcctttgtttaaagatatgtccatcacatttcttatgtcaacatcaaaatgactagtgggaaacaatatgtaaggtgttcttggtaaaagaggatatgctagccagtcttatgtacaccaccaacacagatgtccctacaatgtgctaagcaggatacacctcctgttcacatgacagttagacgcagaactattaatctgtcccatgactgagactctaaccaaaaggagggacaaagtttacctccagccactcgagggtgctcctgaaatgggagagagggaagcagctcaggttcaatctgggttggttgtggtgagcagaaacaattttccaaacaacatcatatgatgtcactaggggcattccatgatgctataccataagttacggtatttatatgaaatttctgaagatataaggaagcaataagaaactaaagtttggatcaaagaggaaacagaaggaggaggagaagaaggagaaggaggaggatgaggaggaggacgaagaagaaaaagaagaacaacaacaacaacaacacatcacaccttgggtcaaagctatgaatttctaccttcagcttctgagaaatgcagaatcctatgtcacagatttgagagcaatgaagaatattaacttagagaaagataaaggaatgctaatatttcctcttatattttaaaattcttggaaagatgaacttgaggaaagaaaggagatttttcctgcttggcaatcacaaatctgaaaatggtcagagcaaaatacacagggagcatattttcagagtggcatcctttccaaattctatctagtcatcaccctaatggataaccatgttcatcagtgcacaattggggaaaattatctcttgagtgtttgagagtttgttggtgactaattactatcatggattaaaagagagactataactcttaactagattttattatgaaggtatatcctatagttctattatattgtattaattttctgttgctgctgtatcaaattatcataaacttagtggttttaatctacagaaatttattgttctgtatgtcaaaattccaacacaggtctcagtggactaaaatcagggttgtgttccttcctggagtctctaaggaacagtctgtttcctgaccttttctggtttgtagaggttgcctgtcttccttggctcatggcctctctcctctattttcaaagccagcaaaattgcatcactctgtgcttttcctccataaactcatctccttcttggaccatagccctaattataatgagctgcttggataatccaggaaaatctccctatatccatattcctaacataatcacatctgcaaaaccctcctgccaataggaggaaataagggaatgggggaaagatcatgaaaaggaccacaactactaacactaaataaatacctagtgggtacctggttctctgttcatcaaacgtcagcagtttgctaaatttgttaataattgtcttgtttcaaaatgactatataaacatttattaaagaaaatcagttgcacattaaccgttgcagaccagtatccaagtggattgagcctagtaatggattcctgtcctcaggcttgatagacaccatgcttgcccaatgcacagcaagtcaactcacttcagtactccctagaaagtataaatttccctttatatcaaatatctcaaactccatgttaattcccccattttatacatccagtgtgaacaagcaagaaaggaaaaacaatgtaaatgagatacgaatatgaataaaatggatctcttgcttggtggaagaggtgaggtacagaaggaaataatgtacagctagagagattgctaaaaagtcaaataaatacatctaggctgggatccaaaggaagattgcattattttgcatgaaatgctttattacccaagtttagaaatgctcatattcaactatatgatcataaatccattctaaagccaaatatgaatgggtttggatcaaccaccattaaaagtatcttaacttcttttattcaaaaatggaaagggaataatatcacccagtgtaacagtttgtcttggaatatatgttattagtgagcatagccattttgaggaactgctaagttccttgaccatagaatgacacacaccacagtagaagagattgactgaagcctgctcctagggtatgcaaaacttgataaatcaacatgaaaaacattttccagggagcacccgggaacagttatattatccatttttctacctctaatttccttgatttctgatttttacaataggaaccatacattttcacattcatcatgaataacttgttttcaacaaatgtattaagcagggagttgggatgttcctaaacctgcaagaaattcttaatttttttattcttatcttactcatctttagttggttgtatttgctatatgcattggatttctaccccccactgtgagacagtcagatccattttatgtcataaaataaagccaacatattttgaaccagtgtgaaagttttaatttttaatattttatatttaaatgattaaatgaaatatacatcctattatattgaaattttatttattaatacttgattttaagaaataaagtttttaaagtattacattagcttctaggaaaaactttcctgtcccataaatactatttctactagtacaaatgctcccatgagtgatcccaattgctgagtatgtactgtaccaggtgctgtactactggtagtgacatggattagctcatttaattcacacagcagccacttgagatatgttctgttatcctcattatgtaataggggaaaatagactcaggtaaatgacacagccaggtcccttagtgggtatagcagggaagcttgaacttgaattcaattcagatttaaagtctatctctcgcccacacattctgatatcttcactctattttgttgctgtcaataattaaagagaagctttctgagccactcatattttcccattcattctcctgtttcaagataactttctttttctttcaccagatggaaaataattgagtttgtggagtggtatgtcatcccaagaggagaaaaagcccacagcttccgagtgggtctcctggggctcctgtaaggaagtactacagaccgcgtggctcagaacagcaggcattcattgtttcatagttctgggcggtagaagccaaaatcaaggggccagcaggttggtcctacagcctctgagggagaatccatcccatggccctctcccagcttcagaggctgacagcaatcctggtgttctttggctcctgcggtgctgactcctgtctctgcctctgtcatcgcgtgctattctagatgtgcctgtgtccaaatgttcttcttataaagataacagtcatattggattatggcccaccctaatgatttcatcttaacttgattacgtctgctaagacccaatttccacatatggtcacattaataggcaccagaggtagggacttcaatatctctctttaggggatgtaattccctgaaaagtatcttatccgctgaaaagaagatgtggtacttttggggttttaatcctttgggtggcttcctcagtcagagaaatccatcctctgtgtaaactctagagttttcttcctgtaattctgcttcgaggctcatcactctgcagcctaaaagctgccattgagacacaaagcaaaaattactttgtgtttacatgttaaaaaaaaaaatcctcttcagcatgcatcacgttccagggctctaaaagtcaaaccaaactacaggcctctctgaaaatgttacctgtgagttgttgtttcaataaacagcaacagcaacaaaaatcctatccgttcttcaagcctctttcaaattgtgatctctgtgaagatcacagagatctcccattactctaaaaatgtctctcttgctcctctgctccctagtgggttgtttcctttgtactgttgagctttttatattctcccctataatcctcatgatcaagtatttcttccttattagctcacattttactagttgtaggcggagcaaataatcatatttgtctttttttctcttacatctccaggtatacaatacctttttacatagagggtgctgattaaatgttcagcaaattgacagctataccgtcaaaaatttcagaaaatcttgcatttccacaatgacagttgctacagaaacagtaacaaagagtcttatgtcactctatatctttgagccctgacttacacatctgtaaactgtagataataaaaactactttgcaatcatgtcacaaaaatacagtgaaacgctaggaaagcttctttgtaggatatattggacatggcaaattggatggatatttgttggctgtcaatgtgttaatttcccaattctgcttccgtgtgttaaagccctgaaagctattgaatcttggtgaaaacacataagtgaaaagctatgacatgcatttttgttactttatctttctgggcaatcaatttgggggtacctgggaaaattgcagtgcctgtctgctgtttctgttgggtccagtggttctctattgattaatttatgctctgactcattttgcaaagagtttaagatgcttggatcctcattaagattgaggtcttagctaccatatttcttattcttggtagtaaaaaatcgcttacctaatcacagattggtgcacctgttgaggcagagccaatgtttacttacccaccctaccatacccagcaggtgctcaacaaataatgaactgaattgaactccactcaagtcggtgatttctaatctagtagctccagtccctccttttacaaacaaatattgtatgttgtacctatttgccaatctgaaaaaaaaatttatataactttctcttcacacatattttttaaaaatttaatgccctataatataaaagagcaagaaaaatataattatttaaaaagaatgtgcatctcaatatataaatgatcaagtttgactatcctagaagaaataatagttaactaccttgtaaactatatgttgtaaagttatagaataaactttagaaaaatgggagtgtaattagtgtgaaattagagtcattatgactatgacagttacaaattcaagctgatacatatatgttttattcctattgctatttgtgataagatttttcaaaatggtgaacttttggtaaaattatcaacaaaaatagtatgaccttcttttgatttaatggtaagtgaattccttaaaaaaaaaaaacagtgtatgttaagccatgcaaaaattactttgtgtttccatgtaaaaaaaaaaaaagagagattttattaaaaaatgtttcctttacttgaactagaacaggaattttgaaagtcagagtgtgcacagcaatgacttcttctgtgtgcagaactgtctttcactgtaaaagacatctggatgggggaaggtccttaacctcataaaagccagaagtgcttccttattttcttctagaagtgtctccttgggagtggggagagagaactacctatctaggtgaaagttctttcagatcctacctttggacatgatttcctcacattccaacagcatccacagtgaagtctctaatttccttcacatttctccttcacaagtctcctaagttccattgcttgagaatgcacatcttaacactgtgaccagccagccaaagttcacttaaaggactcatctcactatccaacacaacaaaatgtttggtaacaaacgaacatactcaaagaagagcaaactttccttccttagtcatttccttatgcctaaattcttttgtaaaagactgaatcaattttcacatctgagttctggttcacctactacctagcacatgataggaactcctatgtggcataaaacatggtaatgaggcagtctgcatctgcatggcagctgacaaggaatgcttatacaaatatggtatcacttagtaaaacaggcactttcatgcatgacactaacctgtgaaatgtacacaaattcatatcattatcaataaattagtacaatctactcagctgtttctcacttctgagacactgcagtctagctcagtgaattgagaaggtcgtaatcattgttcctcagtgaccttgtctattcttgtatttaatattaactctaagaggcacctgtcacagtaagtacttccacctgttggaatgtaatttccaacatgtcttttttattcagtaatatatcctcagaacctagaacagggcctggcatatagtagatgctcaaagccaaaaatgtctagaatgaatgaataaacaagtgaatgctgtgtccaatatgtgtgaatgccatgtaagcacaaaggtaaaaaaaagacaaacacctgcccttgcagatttgcagttaaatggaacataatctctctaatattagtgatgtgccaacacatgtctgtgtatattttaggagaatataaaaaacagagaactcatgtttttagtgagtgagtcaattttattcagatgattttattcaaaaggcaggctgtttcactctcaaaactatggatagttggggctgcacaattctttgttgcagagggctttgcgtattgtagaatatgcagtaccagcaagtgtcagtagcaaacctccagcagtgacaacaaaaatatctcagacatttgtgccaagagaatcactggactaaaaaatacgaatttaccagacggacgaatggataaagagaaaaatatgagcttatgaatgacagggtcaggaccatatttatctttgcattctagcaaatagcattagtgctgatcataaaaagaaataattaatgtcttacattgctcttttaatctgtcatgtccattcatacgcatataatccttaaaacaaccttgcaggaaaatagtgttgatattgactcctttattaaataacacaatccggataagcaaaatgaagcacccaaggtcacctttatattttagtggtctttgttcttctcaggacttttcctcaatcgtacttaaagccactaaccactcagatgacttattcttccaattggaaccaggctgcattaaatcacaattgtttaacaactgtcaaacaacaggtttcatccaacgcttactctaggccagatactttgctaaacactgaggcaaaacctccaaacaatttgcttcttttttagaagggcaagtacttgacagtggatgaaagtggaacatttttcccctagagggatcaaattggggtataactctaaaggcaggtttgagggagaaattaaaaagaggtaaaatgcagtatgggacatgaaaatggaaaaccttctcaaataaggccagtaaagtgcaaaacagggtaaaagcaaatatctgaccgaaacagtgagccatataagaaacatgaaactagattaggaactaggaaatctggcctttccttcccacggttccagcatttatcttgttgatcttgggcaagccatttaacctctctgggtctcactttagatggtctccagcccaaaggccagcttaactggcatgcatgtggactatcagtgcggctaccacatcctacctagcaactggattgttgtcatggctgctgcaccatccttgtacaagtgcagcaatcagaaggatctctgaaattacagtgctcaagttctgttaagctttaactctgggaagctatgagtggaactgcatagaaatgacactggaatgtgaatgccaatgcccaaagtaaggtggctctggccagccatgctaacttgtcttgaagtctatttgcacagaagatacagctggaacatgtgctttcctccacttcatctcacctggggtcaagacccggttggccagctgactggccactgacatcccccttgactccatagggagctgcagttgaggtactttccaaatgaatcctgacttacacaggtactctcctcctcctggtagatgctgtcctaactgctaattacccctaaaagataactgattcctttcctattgtttctcccctaaactgcaaaagatgattgcaatgataaaaaaaaaaactgcttttattaaatgaacttttggaagaggaacatatataaataaattagtagtagtccataaaaacctgtccttcatgttcaacctaatgggcatcctagggcaactatttgccagatcatcgatctgttgagaaaggaataaaagcgaagtctcctctttcgtaaaaaaaaaatgcacaaaattttctataagtttcaggtggcttggagatactctgaagcattaagttaaacacagtttaaaaactgccttaaagtgatcatcattttaattatttccaaacccatgatctctcaaagccatttaattgctgtaaaaggcactttcaggaggaaaacaatctcaaattaccttccaccatcctccaccactcaagaagaagaaagatatacatcgtcagtcccccacaactttccaacatcaaaatttcaagcattttatttggccagatgcatgtagatcatttacagtttaatggaaatattgacatatgtctaccaaaatactctagatctattggagaaattttgccgatgttggtgtactctgacttgctaccatggccagcaaatagaggtgtctactcatcctcattcttatacaaggacagaacagcaatagtggcaaaaacatgtgtctataacctcactgacgttccccatccatgtctgttaagctgacctcagagtctgagagtgtcaattgaattttactcatctaataattttgatattcaatttgtgtagttaaaatatacattatagggtgaagtttcaagagttgtctcagacacttcccatcaagcatctatgtgcacacagaggtagactaagtatgtcacatcagctaaatatacatcctttagggatgactggaaaggaaactgctatgcagatggaaaaaaaaaaagctgtaaccatagatataaatatatgtaaatacacacagaagtttcaattttcacaggatgcctgaaacaggaatgcttgatctctttcacgaatattaggtttttagaatttcataaatggtgaggagaaaatataaaatggcacagaaggctgtggtagaagaactcaggtaacatataaagaaaccatcaggacaactcattgtctgattttgattactgtggagcaactgtgatctctatcatgaaaattccttaacaagctagaaaaaaaattaaaagaccatgcagtggcagaataatggaaatgcagaacatgttacattgtacatagggatctttgaaaaggaaaaagcacaaattgtatgtatctggttcataatcatatttgatccctgatacagtttagagatgtgtaattatctacatctctttcccattcattctggttgtaagttttaagttcagcaaatcaactgtgtgattaaagcaactgaattcagcctgaaaatctttgctctgccatctataggatagtctgtctggtagctacttggaggcactacagcattaagcatgtcattcatgcagaagggcccggggtctgacaagcctgtgaggaatggctagaagagctgaacaagcattctcacaaaaccaatcacttggtaattgctgagttgttatcacagcaattaccaagtgattgatcttgtgagggttagagaagtggtaaatccttggcatgttcttaaggacttttgtcaatgtcaagatctattctaactcccacttcttgcacaagaaaaaagagatgccttttgttcttgcctgggcaggaaacactgactctccagttacccaaccccctaactcctttttcctaagcctctctctagtcaattcctacggggctgatttctggaaagataattccactaaaattattaacatgaaaaccatatatcaatatcatagaattataaacacagatagattgtagttaactgcacctacaaataaacattattaatattaaagcttgtgcataatgatgtgggaaaattaatgcttattgtcagaaaatatttttgagtttattaatataaagaacactaagagaaaagctctcacatgttattactattttaaagaaacatgaattaaatggggaaccacaaaaaacaggagtatgatgttgcgtcaaataggaaaagtgagtatagctacccagggttaaatctggggtcttagtcataaatctttatttgacaatttaatgcaccgttctgttaaactaccattttgctttcattgttcctacctcaaatgacacaattaacaaattgtgagtgctgacggtgatatccaataaaaggtggaatatattaaaaaggtttattgaaattactttatcacatcttcagaaaattgttgaaaagtacaggtggatagatgaaaagccctaacatcttttctaccattagcaagggatgattttaaaaatgtaaataaatgcatttgctatatttgaagcataatttctacattgataatttagtttagaataaatgttgctattccaataatgaatgtctcttcatgggtactgctgtcataattacttaagaaaaaaatattaattggtcaccaaaccatctcagcagatggatctattggggaggtgtcaggttagtgttacattttagcacaaaattgttgtgtgttattttatagtattcaaataatcaaaatcatacaactctggacaggaattggcgaagtatactccaaatggaaaattcacacataaaactgaataaatagtatattttttctgggttgtagcctagataagagaacaaaatatttaaatgagaaaatttagaagtataatacatatggacagcaggaaatgtcatccaaaaaggtcatttttgctttatataaaaaattaaccattttatccccttcctaccatcccacacatacacatacatacatcttggcagcttcgaaattttggtttaagaataataagaataataatgcaaacctaaaagattctaattgtaatcatttctgctcttgagggagatttagctatacctttaaaaaaaaattactggcctgttcaggacaaaataaggattgaaatgttttaaaggattaagaaaatgtggcacatatacaccatggaatactatgcagccataaaaaatgatgagttcacgtcctttgcagggacatggatgaagctggaaaccatcattctcagcaaactatcgcaaggacaaaaaaccaaacaccgcatattctcactcataggtgggaattgaacaacgagaacacatggacacaggaaggggaacatcacacaccggggcctgttgtggggtggtgggaagggggagggatagcattaggagatatacctaatgctaaatgacgagttaatgggtgcagcacaccaacatggcacatgtatacatatgtaacaaacctgcatgttgtgcacatgtaccctaaaacttaaagtataataaaaaaaatcatctttacaaatagtttttctcaacattaaaaaggaaatttaaacccacttttcatgccttctatttagaagcaaaaaatacatttttatgagaaaagagtatgggcccttttagttggtatggtgccagttcctttagaaggagactttctaagcccggtttattatcttagttgtttaaaaaaaaaaaaagcagcagttgatataaacttttcatatttaactgaagtttactctgaagagattaaaagagtttctattccatgaaacgacttgctccaagtttctatgactgggtttcttttggctgaatggcccagttcaagctgtttaatgatgtggtagatgaggaaacagcatggctcttaggtcataaccttgctctgttgttcaaaagctgttgcgatcttaggaaaagtaccaatcttatgttttgtcttctagaaaagggggtgtgagggaataataaatacctgtactgcatggttgctgtgaaaattgtatgggataatggacacatgaagagtttgcagagtgcctgataccttgtggttagtatacggtaactatcattttttgttacatctttcactttggattccatgttttatgcccacaacatttggaggtaaattataatttccatcttagagtcggagtcacttaaggcttagaagttcagtgacttgcccgctgtcgtgtatgacagatctgaaagtcttccagttccaaatccagaattaagtttccactcctcatcctatctgggcaatacttagtgccacgtaagtgttacctgctggggatgatgatgctgcacctgtgtgagaaggagcaggcccatgctatttgaaataactcactgggaagacattcccaggggaagaatgacattgacctttggaaacttatagtagccagagtttgtgcccaattccagaaccgaggctgtcttcactcaggcacattccttatgttatttagcctttgcttccccagctatggagaaaaagaggattctcttattgattactctggattccaactctaattcctcagatactgtcacattaattatttaaatcggaataacttcccttcctaaaacagcagtcttttgatattgctgtatttcagctgataatgggagaaaaaagttagattccaagaaagggcaaaaattatgatacgaaataaaaaactaagacatatgtctcctgagaaaacaatgtaaaaaatcaatagtcaaagaaacttcaatcaaccattttaaaggaaaattttaggaaaaaaaatacaatcaatataaatatgaaaggatattaattttgaacatgccagaaaatccttataggctatatataatttttaaataaaagacacaaactttgatttgcacaattaaatgtcctttcttttacctctacattctgagttttaaccagtcaataaatgtgctctttctagacaaaaataaatctgaaaatcaaatttttattgactttaaaatcattattccaggactgagcacccagtgtcattgggcctcactgtcactgtgaaacccttctttttgttttgaatgggattactgattttgagtcttctaataatatgttcacttcaaaacaacaaaaaaataggagacagaattggatttccaaaagtccaaatcatcattaaataaacattgtttgcttgcctgagcattactgtttgcatcttactctcctcattcatatattaaggttctaaccaccagtaccttagaatgtgactttatttggaaataagattattacaggtataattagttaaattaagatgagctcatactggatgagaatatgcccctaatgcaatatgactagcatccttataaaaaggggaaatttacacacacgcacccccccacacacaaacacacaaacacacaatgtcatgtgaacatgaaggaagagactggagagagctgtccacaatccaaggaacaaaagagattgatggcaaacaaccagaatctaggggagaggcatcaaacatattctatttcatatgactgaaaggtaccaaccccactcatgcctagatctcagacttataacctccacaacagtgagacaatagattccaattgcttaatccaaccagtttgggacactttgttatgacagccctcctagcaaactaatacaatgacgttgtttcagcaacatgctgctgagacttagtgttccatttcttagttataaaagctataaaaatatatggaaagagcaaggcaaagtccaaggtactttatttcctttcaaggctgagtggatgattcaaatgtgttaagaggaaaataaatgagaaatttctaggatgtacttatccttccatctgtatcaggacacagtatagaaaaatagattaataaactcataaaactaaaagctttctgtatcttatacataaaaccaccttgggggatggggaagctcttataagcaaagaaacaaaactatatagttttggagtcacactttatggtcatcatctcttccatcaccataaccacgaacttttacagatcactgtagaacttgtagcaactacaaacgttgaacacctagcaccctgtaaacatccaacaactgatagctttcaagatgcccatatatttcttaggaataagctgatgttctgtctaataatgattgagaaacaaaattaattaataaatctacagattccttaagactcaatgtaaatggtggactacaccaagtcaccaagatgtcaccaagatgatgtcacaaatatggcagagtaagagacaagccttcatcccacacacacaaaaagaaaaagcgcagatagctactcacaaatcagataaacccagggaaagctcaagggctcatgaaaaaattggcagcaatacagtagagagaaaaaaaacatagaatattgatacagaaaggatcactggtgggatcagcatacctgagacaccaggagactgctaggaccaaagaagaaaggtggacctatcaatatcagcccatggtctcatctgcagaggatactggcatatcttgccactgaggtaaccaacagccattcttgatggggaacaccagagacaggtatggctgcacagctgtattaagttgcttcaggaaattagctaccacgtctcccaaaccaccatttatctcagtctcagagctgtggtcaatatgcaagtgcccacattacaggcccaggcttggtggctgcgttaagcccactcatgtctcaggcacatggagtgaggacttagctctggggcccacagtgtgaaacatctcattacatgtgcccatgttccaggcactggctcagctgccatagagagctaggccccaccccaacatttaactctcacccatctgtgatctcatttccagatctctttctgctccacaagtatccatgtctcacactatgttaccagcatggtagtggggagtgcctgtaccctgagtatcattgccattactttcccggatcccagagccacagaaactctgtgcatgcctgtacttcaggcctcagatccacaggcaccacacatcagacaccagtgccactgccacttcaagtgaacccacaagccagacccagtgccccaaaggacctgctgagccataacttccccactgtgagaaaagggatcaggaggactttggcagccatcaccaccaaataccctaccagtgctcactaccactatggatagcacagtgttggctgctgaggatccctgcaacatttgccaactctgaccttagctgatagagctatacaaacactacacagcagcacccttactggtgtcagaactgctgcaccacaaccagcaagcattctcacatcccctctctcccataaaggaaggtctttccacagcaagactagccagtagagtctgaaagtggtgaatactccaccaaatacatacacatcaatgtcaataagaagcttgaaaaaccaaagagacataacaccaccaaaagaccataataatctcttagtagctgacacaaagaaatggagatatattaaatgcttaaaaaaattcacaataattgttttaaggaagctcaatgaacttcaagaaaatagagaaacaattcagttaatcaggaaaacaatgaattaccaacacaaaaagtttaacagattaaaattattttaaaaattaatccaattctggagctgaaaaatacagttaatgaaatgaaaatgaaatagagggcatcaacataagaatttatttgtattcaggagataatatctatatactcaaagacaggttatttgaaaatatataatcagaaaagaaaaacaacaaaaaggaataaaggaagcttacaggattcataggtcaacatcaacagagcaaatgtttgagtcctggcagttaagaaaagagagtgataaaaagctggaaagtttattttaaaaaaatagcaaaaactttccaaatccaggaaaaatataaatatccaggtacgagaaggtcaacagattcaatctaaacaagactataccaagacatattgtaaccgatttttcaaaaattggatttctgaaaatttttgaaaatttgaaaaattgtaaccaatttttcaaagacagagaggatactaaaagtaacaagagaaaaaaaagcaaatcatatattagagaatttcaataaggcagcagtgaatttttcatcagaaaccttataggccaggaaaaagtgaaatgatagatttgaagtggtgaagaaaaaaaaaactgtcaaccaagaataccgtatccagcaaatatgtccttcagaaatgaagagaagcagactttttcagacaaacaaaagttgaggaagttcataatcaccagacctgttttacaagaaatagtaaagggagtttctcaagctgaaagaagaagatgctaatgagtaacacaaaaacatctgaaagtacagaactcataaataaaagtaagcagttaatttggagtactctaatactgtaatagtggtgtgtacatcacttatgtctttagtgtgatgactaaaagacaagtattaaaaataccaagagctacaataatatgttaactgatgtacaatataaaaagatgtaaattgtaacatcaaaaagccttatggtaaccacaaagcaaaaaccaatagtagatgcacaaaagataaacagtaaggaatcttggcaaaacactagagaaaaatcacctaatcacaaaggaagatagcaagaaaggaacaaaggatctataaaacaataagacaataacaaaatagcagtggtatttacatatcaataattaccttaaatataaagagattaaattctccaatcaaaagacgtagagtggctgaagcaataaggaaaacgaaacagaacatgatccaacaatatgctgcctacaagagactaacttcacctttaaggaaacacatggactgaaagttaagggatggaaaaaaggattccttgcaaatggaaaccaaaatagagaaattatttcaaataacaaaagaaaattcagaaaattcacaaacatatggaaattaaacaacatgttcctgaacaaccgatcaattaaagaacaaattaaaagcaaaatttaaaaatgtcttgagataaacaaaaatgtaaacacaacttatgaaaatgtatggggtatagtaaaagcagttttaagaagtaaatgtatagcaataaatgcctacatcaagaaaataagaaagctttctaagtgttagatatttgcttactgctttataaatgtttaagtctcacaagctctggggtagacaaaaattacgtcagtttcccagaggaaaaaccagagaagttaataaacacatataatggcttagaacttgtactttgcacagctgggattttggaatgattatatcattatataaaaagtgaatagaacttaagttctacttcatttatgttctgtttcttttgtttttactgaactgtaagttctggtaaagggtttcatcattttatctttcacatttaacacagttcctggcacatagtactcactcaactagttttaaatcaatgagtgaaggagattttgcttctcaaattcctttatattgcaagcaggtaagcaatatttatttcatggttgatatacatgtcaccatagctatggacatttacttatagattttgcagcatccttaggaacaagacaagacagaatgggataaatttgaggcacagaaaaccaatctgtcatcactgatgtgagagaatactgagtcactttttaaaaatgtaacttaagaaatattatgagaaataatagttaactatgatcttgattaattttttctcacactttttgatgtggcataatgtatcacaaagagtgcttttaaaaaatcaatatatttagaggagttccctcctagaattttatctcctcttttatagtggacataatgtttagactatacatgtaaattacactttactaaagctattttgtaatgtgaggaagatagtcccataccactgtttggccatctcccctataagacaatgaatgaagcatacttagccacagaattactgtcaggattagaaagagtccgttttcttaacctcttctcagtctgttccccattggttagtgttaatgtcaattttaattacagagtcaggtgtttggactttccctgggttttctcagactctttgtggcatcagctactatccaccctctgctgataccaagtattgctacatccttcaactttctactatacatcgcatctggatgtctaaactcaaattcaacttagggtatccaaaacacaagtcattatgtttctctccttttctacctctcctcccaccacagagcaaggtgttactgcttccacattttctaggtagttatcagagttatccctccttttattcatccccaatatgaaaccattcatcaaatctcataagtattattgccaaagaatcctctgaaactatcactcccgctttctgttcccacagccatgccttcatttctgattttcatcacccatctttttgaatcactgtacaaccaggtatccatgtctcacattccagtcctttatccactctccagtcccatggagaaatacagttatttctaactataaataaaatctcaccatacccacttaaagacttagccagttccttaattgtttctcacagttcaatgccccatttgtagcatacaaaaatccaacctagtttttcagccttatttcctgccacatgcctcatgcacatgtttttctagtcaatttgaatttttaaaatcatctccaatacatgctgaggctcttttgattgtctgcttatgcacatactattccctgtgcctgacatgcctttccttgacttaacctttatgactcaaataaatttcatctgctctgtgaaacgtttattgctttcctctagagggattaatctctgtctctttgttgtgctttcatagtactttgtttgttctccaaacataagtcagtgggatctttttaaaacataactaagattatatcatattcctgttgaacaccattcaaaggcttgttatcctacttggaataaaatctaaactctttaccctgttctattaacaaatcatcccttagaactgggcagtcaggcctctgttctgcacctaaacttcagcatagtaataccacacccatgatacatttattaaaggagacatgcgtacttctgccacttgagattcaatgttcagtgggggcatagcacaacacagggggtggcaaaccacacctctttgggccagacccagcctgcctatttttgcaaataaagcttttgtattaatctattttcatactgctgataaatacatacccgagactgggtaattgataaggaaaaagaggtttaatggactcacagtcccatgtggctggggaggcctcacaatcatggcagaaagtgaaaggcacatcatacctgacagcagccaagatagaatgagagccaagggaaaagggaaatcccttataaaaccatcacatcttatgagacttattcactaccacgagaacagtataactgcccctatgattcaattatctcccactgggtccctcccacatgtgggaattatgggagctacaattcaggatgagatttgggtggggacacagacaaatcacatcggctttattgaaacacagctatgctcattcatttatacatagtctacagttgcttttgcactacaatgacagagttgggtatttgttacaaatggcccagaaagacaaagctatttggcccatgacagaaaaatttgccagccattgacacagcctataactcttatctgcccttgagactacctacatttaggctcaaagaaacatagttcaacaatcatttacctttgttttcaaagcaaaggctacattttgtccaattggtgcaagagttttcagttcgtgccactaccaacagcagagattaacatttctgtgcttttggtagaaaaaagacacattaattaacttgtcaaatccttctcagagaatatggatgcagtagatacttacataataaaacataatttctccaaagtgctaagtgcccattttcctacttcatggtctcatttgtggttccataaatactcacaatacagcaaattatatgcaatagttgcacatgacaactaagaaacatttcgtaatattaaaagctgtatttttgtcttaaatttaaatatgaataggtctagaaagaacatgagaatcaggatcctacagtgattcaacaatgaataccagaattatattgtttatatatatgtaaaatataatacagatataaatatattataaaactaaaatgaatatatatttatataaaatataatgaaattcttaaaataatttcaatagaattataactagtattctcccttttattgcaataggtaattttgaattttagaaaagtaatgatttagtatattatataaataatttgtttttcaacttttaaaatttgctttgacatatttttatgacatttaaattttatacaatttgaatccaattacattttatttctgaattctttagatcattgctgccaataaaatatggtttatgtgactttttatattagcttaattagtgattttgctaaaatgaaagcagaaaaagtaaattcaaaggagtaatgatataattgtttataaactatgaattttttaatcatattatgaacacaagataactgacccattaacagaatatgaaaaaaataagcaatgataactagattcagtcacctttagtactttgctaaattttagtcataaaaatcttatagtttaatgaatattttacaaattgttatgatgaatgcttatttgtcagcataggaaagaatacatttcagtcaacagtgagtctgattgataactttagctctttacgtgtatggaatatggtctccatttgcagtcctgcctcaggccccacaattggatggagtaattctgctattaataataatattttcttacaagattaatactttaaagtatctcttccctaaccagaatatagttagtatgagaacaaggaccatacctattttttaatactgtattctcagtgaccattatagtatttgaaacatagggagcatgcaataaatatttgttgagtaaatagctatttatggcatgaatagtgcattgtaatcatctgtggccatgaacttatttttgttgacagtaatttcttaatgcataattcagtgctgactgaaaaatatttcttgaataaaggaatagataaataaatgataaataaagtgactgaatacatttaaccactgtaaggaatttattcccaattcaattaatagaatattttagaccttgggttaattcttgaagtgtcttaatttctccaagtgctgaatgttgggatcactttccatcactaagcatactttgttgttaatttgtggaagcctgtgaaattcctccactgataatcacattactttattattgttgtgtctcaaccaccagctcagaacatgtaatttgctaagaacatgttcaaggcagatggacctgaaacctgtgaagcttttattattttcattagcacttgtaacaaaggacatgagtctctataatcaaacattgctacagagaagctaaggctttgtgacagccacagccaccacaacatgtctcctgcttatatggatgtgatggctactgacataagcagagattgtagtcaaataccgaaaaaaggattattttattaacaatctctttgttttctaaggacttccttgacatatacagaaagtgaataacacggaaataaaatctaaacacattctcccacaaagaaggcatctagtttgattttctcagtaatccaactcattttttatcaggtaaggatcaaaagtttgtcttcatatcttcttccctcttgaggaaaagtaatttcttaactttcatcaaggggttttaccttagcccatgaacttaatgaagtgtataattcctattttaaaaaatgaaactggtattttattattaacaaagttgtatatttgcattgtagagagtagacaaatataaagggtaaaaaataaaacaattatattctccccatcactattacctcttagtgtgtcatccccaataaatactcacattaatatgcattttttcaaaataagataatgcaatacctagtttgtaattttctcttcagttaagatgtccatatctccattttaatgagttttttaatgtaatctaataaccagtcttactcaaatttgccctgaaatttcccctactgcttatttttctgagtccaaatccaatgtggtatcacatgttgtttctagttgccatacctcttaactgctttttactctaaaatagtcaacatttctcatgatatcgaattgctcaacagaccaggaatttcatcagtcttaactaaaaaaaaaaaaaatagagatttatgaaaaaagatgactatgtggtcacaagtatatagctccatctcatcaaatctccagtgaaataacaagttttcccaaattgagactgggggctgtatatggtctagaaaataatgatgaggctacttcacataccagaaccaataaagaatgtgctctagacctagagcagattgaatgagattgaagaaggaaatgtcctctgaaagtctagaatgtctaggaggcaagtggaaggacacattgtcacatcatcaactggagcaagataggggaatagtcctcagaacaatactaccaagtgtggcatctctttcctccctgcaagccaatggcctttagaatgcaccaatcacaatgaaagacagaggactcactctcacaatgagtgaccacaccaaccagcaggcaaggtatgtgtctctaaaaggaaaacactgtggctcacatgctttctcaatagccagcttggagtatagttgtataaaaagcaacacagagcactcaaaaataggcaaggacttagaaaatgcaggaactatgcaagtcttctaaataattcaatgaatgagctaggccagaataataaaagattaaagcagggcacagtgactcacgcctgtaatcccagcactttgggaggccgaggcgggtggatcacgtgaggtcagaagttcgaaaccggcatggccaacgtggtgaaaccacgtctctactaaaaatgcaaaacttagccaggcgtggttctgcacgcctgtagccccagctactcaggaggctgaggcaggagaatcactggaacccgggagatggaggttgcagcgagccgagatcgcaccattgcactccagcctgggtgacagagcgagactccatctcaaaaaaacaaaaacaaaaacaaaaaaaaaagaaaagaaagaaagaaaagaaacaaaacaaacaaacaaacaaaacaaaagattaaaaagaatgaataaattgccaaggactaaaatcagttaaatacagaccggcattcctaatttgaaaagctgaaatccaaaatgttccaaaattccaaactttttgagtgccagcataacattcaaaggtcatgctcaaaggaaatgctgattggagcattttgaattttggatttgtggatcacagatgctcaactggtaagtataatatgatgcaaatattcaaaaaaaaaaaaatcccaaatcctaaacatttctggtcccaggcatttctgataagggacactcaacctgtaaagaaataaatctgggcaggtcgtggtggctcacgcctgtaatcccagcactttgggaggctgaggccgggggatcatgaggtcaagagatcgagaccatcctggctaacacagtgaaaccccgtctatactaaaaatacaaaaaaattagccgggcatggtggcgggcgcctgtagtcccagccacgcgggaggctgaggccagagaatggcatgaacccggggggcagagcttgcagtgagccgagatcgcgccactgcacttcagcctgggcaatagagcgagactctgtctcaaaaaaagaagaaatctaaactaaacacgttttacacagttatatcactgcttcacattttttgatagctatcctcaatgttttttaactggtaaatgtttttatcactttaaattacataaataaaaaaggagaaatttaaaaatcagtaaaaatccttgatattgatacaggagttgggggagcagggaagtgctgggtagataagggcagggtccctggcgagggctccaccctcgggcctgtgcccatggacctaagtgaggacaagcacccctgttttcgtgcccaaatgttgcattttccaagaccactctggcccatcacgctcccattctgtgtctaaaaaaacccaagaccctattgggcacgcacacaagtagccagatgtcaagaagaacacaccagcagaagaacacaccaacagaggccagcaggtcattgatggcggaacaatgcggacgcctaggggagttcggctaagggccatgggaggagagcccggcagctgagcagccggactccaggagaagaacaccttcccattccatccccatgctggctccacatccatcggctgagagctacttccaccactcaataaaaccttgcactcattctccaagcccttatgtgacccgatttttccagtacacaagggcaagaacccaggatacagaaagccctctgtccttgctttaaggcagaaggtctaactgagctgattaagacaaaccacttgcagacagtaaaactgaaagagcgcactgtaacacctgcccactggggctttgggagctgtaaacactggactctagatgccgccgtggggcagagccctgccacctgcccgtccacatgttcctcccagaggtttgcgcgtggggcacagaagaaacgagccacagccccatggcacgccctgagaggggaataagggaaaactcctcccatttcaatattccaaaaagacaaaaatagtgggttttactcacttttatagacaaataatgttatatatttaagtatgtatctgatgagtctttgtaaccactggtaacaatgcttatcatggcagactgtatttcccaaaatgaccacgacattttccatcccacgtgctcttctaaaacctggagagtctttgtgattgcctcatgaatagaaggcagaactgacacatgtggcctccagtgcttggtcacagaaggcaatactgtcgagttctgcctgcctctctcttgaaacatttgttcttggaaccaagcactaagctgttgaaaagcctagggcacacggagagatcacatgtaggtgttctggctgaaaacttcactgctgttcacgtaacatcctccatgacttttctgacatatgaagaggcatctgagaactctctagccacaaccactgtctgactgcaaactcatgaatacccaaagcaagaaaggcctagatgagcctagtcaacacccagaaatatgagatacaatgaaaaaaacatttgcttcactccacaaggtttatggtagtttgttatttagcaataggcaattggataacagttaacaacagcagcaaaaagtctatgcaaaaaataagaatggataaaaaattaaaccacagaaagcataaaatataaataaataaccaagaaattgagttgtgccaataaatgcaaatgatttaaacatggctaccaaccggaaaagatactcagatggagttaaaatagaaaactctacttactagcaaataataaatacccaaaataaaattccaaaaaggccaaaaatcaaagactaaaatgtaatatatgaggcattgaaaacaaaaagaaaaaaataaaataagcctaaccaaaaagaatatttaataaatatagcagcaaaaatacgactagtaaaacagaagctaacagttactaagttgatctgaaaaacttctctacaccatactcaaacccttttgtaagtgtaattttcactgactaaaaaagaatgaaaaacaaaactaacatcaaaatgaagaataaaaccattggtgaatatatagaggccattttcaaattataaacaagcaggtaaatgtaaacatttgaatgaaatgaatcatttgaaacaaatttcaatttctccaatttattcaagcagtagaatgcctgaagagaagaaatgtaaaatatcatgccaacttacacaatctgttccatagccaggctattctttaagttgtgaattctttcagaccattatggaatatactctcaatgataagaaaaaatgtgttcagcaatactaaaaaagtgaaagctatctagttttatgcaaaaatattataattttcactaaaaatttgaccaaggtgttgcttaaaaccaacagcatttcctaaattttaatcaaagcagtttttataaaataacatctgcatgaagtaaaaatatgttctctgctaagaagaatttgggaaatttgcttttaaaggtatttgttgctgttgcactatagaatttctgaatctataataaaataatgagggttatgaatctccaagggtatatagatcagtgcttccaaaccttccttactgtaaaatgctttgtattcacataatattattaatgttctataacatagtgaaatgaatgactgtaggacaaaatttagaaaatggtactataaaccaatttctctttggacatagatacaaaatatgtcaaaatcaagaaagtaatattgatatattcctatttataacatctaaacatactaatataaataggtagttctgtaatataagtagttgtgttataaattggtaatgcccctgtaaactgagcactgtgagaggccaagatgggcagactgcctgagttcaggagtttgagaccagcctgggcaacatggcaaaacctcatgtctactcaaaatacaaaaaattagccaggcgtagtggtgcacacctgtaatctcagctacttgggaggctgaggcatgagaattgcttgaacctgggaggcagaggttgcagtgagccaagatcacgccattgcactccagcctgggcaacagaataagactctgtctcaaaaaaaaaaaagttcgcaatgctaaaacattaacccaataacattaaaatcatgaaaaaaagaatgtcttttatgactagtgttttattcagatctgaagatacaggtaatgcaataacatataaaacatgaataagattttcaaatattataaaaggtggataaactggtcagaatttgcagataatatgcctatgtatttccctaaaagcaagagaatcaactaaaaaaaacacttaatatattatgtcaacaatgaagctgacatgtcatgcgatgaactattatgcagcttactggcaataatgtttttaaagaattttttgagacatttccatttaagtaaaataaaattagtaaaccatacttgctataattaaaaggttttttaaagtacacatttaaaaatgaatgacaataaataaaataatgatttgagcaaggaacatttaatttacccagtcacccagattggccgaaggatgttgaagaattacgttagctaaatgaatgataggtttaggaaagaactgatatttaagatgggtcttagaaaagaactaaggtaccaccaggcataaaacttggacagtattttctgtcccagttttatgcctgctggtactttagttcttcacagaaaaaattactgccttatcagaagtcaaagtaaaagctgaagtagggcataaaaatcaaacatctttaatttgagataaagacagacataatagcctttagatgggttcctagtcagagtacactgagctagctgatgaccaacgtaattgaaaacgtaactaaaaaacataagttgtttaatacaacttggggtccttctccaagacagtttttaaaaagaaaattgtttgacctattaaatggaaatttgaaaaaacaaaataatataagtaaaacaatataaatatatattatacttatgggaaaagcataaaaatgaaaataaaaggtagccttaaaataaaggcattttctatagcacgaaattcaaatttgtgtaagtcttttaatgatatagttggctcttaatattcctgggttctgcatctgcagattcaaccaaacatgaacagaagatactttaaaaaataataaaagtaaaaaacaataaagtataacaataatttacaaagtgtgtatattgtgttaggttttgtaagcaatctagagatgatttaaagtatattgaagaatatgcataggctatatgaaaatactatgccattttgtatgagggacatgagcatccctggattttagcattcatagaagttcctggaacaaatcccccacagatactgagagatgactgtatatgaatcctaaaaagaaaattgaatgctaatcattatcataaatatcagatatataatataatgtcactctcttttccacatgaaaatgtttccattaaagaattccaaaaatttaaacccagttctttgttccaaataatattattattgaaataattaatgtctttcagccagcctccacattcatcatcatctattaagcctggatagatttcatgtcaaggagaaaggaagctgtacttctagaagtaaccataatggatatagtgctttcttccaggattatatattactgtaagtgtttataatgtcaacttgtggctcaaagcaaatcattcatatacgatctactgtgctacattcctaggagctcaatcaaatggagcccaatacacttggctcttccaattccaataacttatttcaatcaacaacaatgtccacagggtctttgagtatacaatgacacagtttaaaacactccaagatatttctggtacattggtatccctagagttatgaaaattgattccagaagtataaggaagataacagaaaataacatggtttattttaaaatacaaaaaagagcaaaaaataggatgcacctcatataagcatacatatagtagccttaaaattaaggcattttctatagcacacattgtaaatttgtataattgagtcttttaataatactgtcaatcctcagtatccctggattctgcatctgcagattcaaccaaacatggacagttaatatataactgtccaaacctagacaattgtccaaatgtataatatgttaatgtatattatatatttgtaaatatttattaatatgtaattgtccaaacatggatagttactatgtatataaaatataaaagtcatttttatttgaccaggaatttaccaagttatcaaataacataatgaataaaccattaatcattttaaaaatcattacctatggatatatattctagtaaaagcatatttagacagttcagttttcaacatattccaatccacttttgtgatgtagattttgaatagtggatgtagctcttggctctattttaccatatttcacatatagctagttaagaatgtcagcacaaaataatacacttaagtaatacattaataataacatttggcttaaaatatatcctggttttaagcaggaggttattaacgtatcatgaatccataccaattattatagtagaatgcccagaatttaaaataggaggataattcatagtggtaatattatttttaaaatgaatcttaattcaatatctaataagtgccttactatgtaagtgaagtcctttatcattgttactgtagcatatgattagagaacacattaaaaagctattgctttcctgacatctaatttgcatcaggttcttaattttcaactggatacaaattaggcactcaaaaataaaagaaccagttaaattaccttatcaataacaatacttttcaccaaagacaattaaaagtaaggacattgacaagcatggatttttcagcatcaaatgtatcttattgtttaaattcatgtttataaagctcccattacatatgttactggacccaaataaataacacaatgtttattccctccaataaccttctgaatttccaaatgatacattcaaacagtgtttccaaagttttaacaaggaagtatttctcttcacatacaactctctccttgttcttaggagttctgacggtctttctctaactaagtgataattattattgaatcctagttgtgcttcaattgaaatatctcttgcatctgcagaatccctgtctcctcttaaaacaagagctcccccctttgtacctaggctgtccatgaacctccaggcctctgctgctctctccagtttctccccatcctcacaacccatgcttgaatcatgaaatgtgcctgctcaaaagctgcacagttctccgtggcttacagaaagtaaaaaattgtatttaaagctttccacagtcaggccttagattaccgtctcaccatgtctcctactgcttaccaaccaaatctcttgtctccacctcacttcttaaaactatgtttctggagcatagcagggcttatgaagtcacattttcccccacatcctcatgaacagtagttcgcacaaaacaagcaacatatatgtgatatttggatttatttcaactgataggatcatcaaaaggccatttgggaattgtcaattatttcattttataactatgcgtatttagttgcatggtaaagtaattaagtcacttgtaaatgaccactcagctacagtgaccactcagcttgacaaatcaaaaccaaaattctgcctcatggaaataacacttttttattatttcatattatgcaaataatttagaaacattgataatagtgatgaataggatgtaatgagatgctttctttgctcaataaaaatatattgagcttcccattttctcaactcctaattgggtgattgcacaaaaaaaaagatccacttagtgtgaaaacaagccagtcaaatagagcacttcagtgaccttcccaagagcacgcttcccaaggaaaatcaaattgaccatttaaaaatgcacagtcaggggagacaaaataacaaagaatacaaaggaataaagcatgcctactagatctacaaaaacctcaaaaaggcaaatctagtacttactggccttaaagaggagagacagagagagagagagattagggtggagagtttatttaaaaggatagttacagagaacatctcaaacctagaaaaagttatcaatactcaagtacaagaaggttatagaataccaaacagatttaacccaaataagactaccttaacacatttaataatcaaactcccaaaggtcaaagacaaagaaagaatcccaatgcagcaaaagaaaaaaataaacacataacatacaatagcactccaatacgtctggcagcagacttctcagtggaaaccttacaggacaggagagtggcatgacgtttaaagtgctgaaggaaaaaaatgttaccctagaatagtatatctagagaaaatatcctctgaacatgaaggaaaaataaagactttgcagacaaacaaaagctgagggatttcatcaatctcagacctgtcctataagaaatgctaaaggtagttcttcaatccaaaagaaaatgacattaacaagcaataagaaaacatctgaaataaacaatctcataaacaatctaatgaagtatcttaaagaagaaaagcaagagcaaaccaggctgggcacgatggtgagaggtgacagcgtgctggcagtcctcacagccctcgctcgctctcggcgcctcctctgcctgggctcccactttggcggcacttgaggagcccttcagcccaccgctgcactgtgggagcccctttctgggctggccaaggccagagtcgtcttcctcagcttgcaggtaggtgtggagggagaggcgcgagcgggaaccagggctgcgtacagtgcttgcgggccagctggagttccgggtgggcatgggcttggcgggcctgcactcggagcagacggccggccctgccagccccgggcagtgagcgacttggcacccgggccagcggctgcagagggtgtactgggtcccccagcagtgccagcccaccggcgctgtgctcgatttctcgccgggccttagctgccttcccgcggggcagggctcgggacctgcagcctgccatgcctgagcctcccacccactccatgggctcctgtgcggcccgagcctccccgacgagcaccacccccctgctccaaggtgcccagtcccatcaaccacccaagggctgaggagtgcgagcacagggcgtgggctggcaggcagctccacctgcagccccagtgcaggatccactaggtgaagccagctgggctcctgatctggtggggacgtggagagtctttatgtctagctcgggattgtaaacacaccaatcagcaccctgtgtttagctcaaggtttgtagtgcaccaatcgacactctgtatctagctgctctggtggggcctccgagaacctttatgtctagctcagggattgtaaatacaccaatcggcactttgtatctagctcaaggttcgtaaacacaccaatcagcaccctgtgtttagctcaaggtttgtgagtgcgccaattgacactctgtatctagctgctctggtggggccttggagaacctgtgtgtcaaaactctgtatctaactaatctgttggggacatggagaacctttgtatctagctcagggattgtaaacgcaccaatcagcgccctgtcaaaaaaggccactcggctctaccaatcagcaggatgtgggtggggccagataagagaataaaaggaggctgcccgagccagcattggcaacccgctcgggtccccttccacactgtgaaagctttgttctttcgctctttgcaataaatcttgctactgctcactctttgggtccacgctgcttttatgagctgtaacgctcaccaggaagatctgcagcttcactcctgagcccagcgagaccacaagcccaccgggaggaacgaacaactccagatgctctgccttaagagctgtaacactgaccacaaaggtctgcagcttcactcctgagccagcgagaccacgaacccaccagaaggaagaaactccgaacacatctgaacatcagaaggaacaaactccagacgcgccaccttaagagctgtaacactcactgcgagggtctgcggcttcattcttgaagtcagtgagaccaagaacccaccaattccagacacaacggctcacgcctataatcccagcactttgggaggctgaggtgggtggatcacctggcgggtggaactcctgacctcaggccctgaaactactaaaagaaaacattggggaaattctccaggacattcacctgcacaaagatttcttgagcaataccttaaaagcacaggtaaccagaacaaaaatgaacaaataggatcacatcaaattaaaatgcttctacacagtaatggaaacaatcaacaaagtgaagagacaacccacagaataggagaaaatatttgcaaatgatccatcttacaaaggattaaccagaagatataaggagctcaaacaactcaataagaaaaatttgaataatctgattacaaaatgggcaaaatatcagaatagacatttctcaaaataagacatacaaatgacaaacaggtatatgtaaaggtggtcaatatcattcattgatcagagaaatgcaaatcaaaactacaatgagatatcatctcactctagttaaaatgactaatatccaaaagacagacaataacaaatgccaccaaagatgtggagaaaagggtacccttgtacactgttggtgggaatgtgaattacaacaaccactgtagagaacagtttggaggttcctcaaaaaactaaaaatagaaatcccatatgatccagtaatcccactgataggcatatacccaaaagaaagcaaaacagtatatcaaagagataccttcatttctatgattattgcagtactgttcacaatacccaagatttgaaagcaacctaagtgtccatcatcagatgaatgaagaaaatatgtatatgtacacatttaaattctaacagcaatattttgacaaaggaattgaactaaaccagtgagttttcatggaaaataagacaaatgtggtatatttgtgttaaataaggcatgttttttaaaacaggatttaaatttttcctctgtagactgtagtacaaagacctattttcatatcctattttcatgaataatgccatgaagccgaaactacaacaaaggttaagtccagttggtaactggttctctaaggactgcaatcttgtttgctagaaaacaaaacaaaacaaaacacacacacacacacacacacacataaaaacatcactgaaaggttttctaagctcatctgagggaacaggctgccatcctataactttagcagtgaaataagtcatagtttacaccagcaacaaaatcagccaaagtactttctctctaaatcataggtaaacatcacagaaggagaaaaagatgtttaacaaataaccaaacaagggttatctgctacccttagaagcaagtgtgtgcacatcgtgggtggaaaagtaacagcacgacaaggcagagagaaccagatccagattgcagggcagatttaaacatcatgtctttgtggataagcaaaggaaaaactaccgaagccattttttcattatacatataaatcacagtaaaatgtgtcacagggaagtttcgcttgatgatctgatgcttcagctatcttctggaggatactcaattttagattgatgacagtcatcaatttgcctccaatttgctttatactgttctccccctgtttactatttgttttacttttcctccctcttggtattttttataatcatcacattaagattaaataacagagcaaaaatctttccttcaaaagcaacagtaaactgagatttatcactgtctttcttgggtccatttgtatgagcagtttttccggatgtaatagaaagtgatccgtttacttcttttctgcatcacttctttttccattgatggtagacaactagatacagacacatcctatctttctctactcttcatttctccataggagatacctactgagtaatgatatagtggcagttgtttctgtttttcatcattcaagatgtaactatatagagatctgggcaatcggaataggaggaagtccaattttagtcctgaaaaattgtaatagacgcaatctgctgtgggagtggtgggaattacactctcacgaacagacttactattggcaaaactatcagggctagaacagccgttcccctccaacccccagcatataaaaaagtaaatggaaaatataaatagcaaggactctatttataccaccgcaaaataaggagggaaatcatgaaaattgagaggcagagctcactgctgtgataaagccttacataaggatgcaagtaaatacggtatttgtgaaagaagaacagaaaatcacaaagcaggaaaaggcaatgtataaaggcattataagaggcagagatagaagggggagagaagatggaatttcaggacacaaaattgccattctcattggagatagcaaaaagtagcattaactcttggggaaaattgggtcattgatttacagaacaatctttagaatctttcccagaagttatttaaaatcaataaaaattgattcgtaaacaataaagcagaaaaggatacataaataaataaataaaggatggagggcaaagtatcactctcagaattatgggattcataaggaatcatcaagaacaaaagtagcaattaatagcccaaagaaagaaatatttaactaatagaaatcatttaatacagggccctacaagttcttaacaaatttaatgatagcccttcccaaaattctaccaacactgtcaactaagtaatacaggataagggagtgttatacactgaattttaaggaaaacttttacaactcattaatcttcccacagccaagttgctttaatgtgtgaggaaaacagaaagactattttacataagaaaggactggcagcatattattcatttacgcttttgtaaaaattacctgaagcctcactcaaatgatagaaaaagaaaaacaaagaagttaggaaatagagaaataagagttgtaaattgaggtctcaaaatcaaatgtcttactggaggagggctagtaatataaatgtgtaaattgggcgaagaatggcaatagaaagtggtgatatttgtggcaaactgaagagttcatgccccacctaaaggcactgaaatgcaaatgctgaaaatatatcttacttcttaccgtatctgttgcctccacctagccagaggctggcagatcacttgaggttaacagttcaagaccagcctggccaacatggtgaaaccccatctctaataaaaatacacacatacacaaaaattagccgggtgtggtggcacatacctgtagacccagctactcagcaggctgaggcaggagaatcatttgaacccaggaggcaggggttgcaatgagctgagatcatgccactgcactccagtctgggtgacagagcaaagctccatctcaaaaaaattaataaataaacaaaaattaaataaattgtaataaaagatgatgggcagcacattgttgcagtggtttctgagtctgtccctccccatgcacgcctattccaacatgcagcaggcagcaggccacagccttcaccatatgcttcctgtggaatttaggagcacctttgatgatggattataataatcacaagatttgttctgttccagtggtgccagctaataaagcccaacatttatgtataattgggatcctgtgccaagaaagttaaatttatccaataaaacatatttccccttttgaagctatatagaaagacattattgccaacttcattgcaaggaaatttttcaaaacatataaaatcagtgactcattcattccttaaacctttcattagttgactaaatctttcatgctaactgggaaaaagcaataacaatcaaatggaagatctctctgtcatgtaatttttatatcaaaggcctatgattatacttgcattaacatgtttaaaactctgtatttatagttgaactgtgtaaaaattaatggaaaaacaaagaccaaggccttgatctgagggagatgggggattccctggagctaaggaaagatcttgatgacagctttttccaacagggaaataatagttgtatcattctcaataccaggcatattattctcattcgctccctctctctctgcccttcccaacaaggtctgagacagtttcataaaagaaggaagagctatcttgtctttttgagacaggatcttgctgtgtcacccaggctggtgtggagtacagtggtgtattcatgctcactgcagcttcaacctcctgggcttgagcattcctaacacctcagcctccaagtaggtgggactacaagtgtgcaccaccatacctggcaattttaaaaaattttttttgtagagatggggtctcactatgttgcccaggctggtctcaaacttctggactcaaatcatcctccttcattggcctccaaagtgctaggattataggcatgagccaccacgcccagcagggctattctttatgagctccaggtttacacatttgttcctgggggaaaaatatcgtattctttcacccaactccctacctggcgagcattcttctgaaccatgactctcagatattgacacctggaaaaatacaactattcattaaacaagttttgaattcctaatgtggcaggtgtcatgttagacactggaaacacaactgtaaacaagatagatttagtttacatcttcacaaaatattgaagtaaagggaatacttctaaacattttatgaggccaacattaccctgatataaaagctagaaaacgacactacaagaaaagaaagttacaggccaatatccctgatgaacacagatgcaaaaatcctcaacaaaatatcaccaaaccaaattccacagcacattaaaaagattattcaccatgattaagtgcaatttatcctagggatgtgaacatagttcaacataaaaacatgatccaccatattagtggaatgaaggataaaaaccgtatgatcatctcaacagatgctgaaaaagtacttgaaaaaattcaacattctcttatgataacaattcttaataaattagatatagagagaatgtctcaaaacaaaaaaggctgtatatggcaagctcacagctaacattatcctcagcagggaaaagttgaaagcttttcttctgagatcaggaacaagacaatgatgcccactcttctcagttctattcaacaaagtactggaagtcctaggcagagcaattaggcaagggaaagaaataaaaggcatccaagacagagatgaaaaaattaaatcagccctgtttgcagatgatacattcttaaacattaaaaactctgaagacttcaccagaaaactgttggaactaataatttggtataattgcaaagtacaaaatcaacattcaaaaatcagtagaatttctatatgctaactatgaactatcagaaaaagaaatcaagaaagcaattctgcttacaatagctacaaaaaacttaaaatacaattacctgctgcacaatgaatttggttaatgacagaaaacatacaagacagtggccctataagattataatcaagctgaaaaattcctatcatcttagcacaatgcatttctcatgtgtttgtggtgattctggtgtaaaaaaacctactgtgctgccagtcatctaaaatatgtaacacatgcaattatgtacagcacataatagttgataattataaaaacaactgttatttggcttatggatttactatttatccaactggcttgtggatttactatacattttatcattattttagagtgtactcctaactataatagacaagttaactgtaaaacagcctcaggggagtccttcaggaggtcttccagaagaaggcattgttatcataggagatgacagttccatgcgtgtgattgctcccgaaaactttccagtgggacaagatgtggaagtggaacacagtgatattgaagatcctgaccctgtatatgcctaggctaatatgtttccatcttagttcttaacaaaaacatttaaaaagtaaaaaaagtaaatgaataaattctagaaaaaaccttacagaataagaatataaggaaaaatatttttatagagctgtgcaatgcgtttgtggtctaagctaagtgttattacagaagagtcaaaaatttaaaaataacaaaaattttatgaagtaaaaaagttatagtaagataaggttaattcgttattaaagaaaaatatttatttttaataaatatagtgcaacctatgtgtacagtgattatgaagtctacagtagtatgtcctaggccttcacatccactcaccactcactgacttacccagaacaacttccagtcttgcaagccccgttcatggtaagtgccctaggcaggtgtatcactttttaatcttttataccatattttaatgtaccttttctatgattagatatgtttagatacacaatcacttaacactgtgttacaattgcccacagtattcagtacaggcatatgttgtacaggtttgtggcctagaagcaataggctatgccacatagcgaaggtgtatggtaggctataccatctaggcttctgtaagtattctctgtgatgtttgtacaaagatgaaattgtgtaatgacacatttctcagaacatatccccattgttaagcaacacacaactgttttggggaaaaaatttaaccaaggaggttaaatatttgtacactgaaaaactgtaaaacattgatgaaaaaaattgaagacacaaataaatggaagacacaaataaattgaagacacaaataaatccatgaacatggattggaaaaattaatattgttaaaatgtccatactttccaaagcaatctctatcaaaatgacatttttcacagaaatatccaaaaaaaatcttaagttttttttatggaaccacaaaagaaccctgaataaccaaagaaatattgagcaaaaggaacaaagctggagccatcacattacctgacttcaaagcataccacagagctatagtgattaaaacagcaaagtactatcacatagagtaatagaacagacacatacatcaatggaacagaatatagagcatagaaataaaaccacatatttatagtcaattgaggacaaagatgtcaataacacacaatggggaatgaacagtattttcatacatagtgttggaacaactggatatccacatgcagaaggataaaattatatgcttatctcatgccatatacaaaaattggctcaaaatggaagacttaacctaataaatcttaaacatttgaatgtatgacacaagttataaaccactagaagaaaacatagaaaaaaagctctgtgacattgctccgggcaataacattttggatataaagccaaaagcacaggcaacaaaaacaaaagaagacaaatgggattatatcaaactaaaaagcttctgcacagtaagggaacaatcaacagagtgaagagacagtctgtgaaatgggagaagatatatgtaaatgcatttgataaggggttaatatctaagatacacaaggaactcatatacctcagtagtaacaaaagaatgaaattcttaaaaacaggtaaaggatatgaatagttatctctcaaaaggagatacacatggctaacaggtatatgaaaaatgttcggcatcactaattatcaggaaaatgcaaactaaaatcacaatgagatatcaccacacacctgttattttggtgatcaaaaagatgaaagataacaaatgttggcaaggatgtagaaaacagaaaactcttccactgtgttggaaggaatgtaaatgaatacagcttttatggaagacaatatggaggttcctcaaaaaattaaaaatagaactatcacatgacccagcaatcccactactgggtctgtatccaaaggaaattaaatcactatgtcaaagagatttctgctcttccatgtttactgcagcattgttcacaatagccaaaatatgaaatctacctaagtacccatgaacaaatgaatggattttttaaatgtggtatatatatacaatggagtattattaagccttaaaaacgaaggaaatcttgtgtttgcaacaacatggatgaacctggaagacatttatagtaagtgaaataagtgaggtttagaaaaacaaatactgcatgtcctcattcctatggggaatcttaaaaaataaaagccacagaggttgagagcataataatagtggtttccaggggtacggggtgggggctcagaagattttggtcaaaggacacaaaatttcaattcaatagaaaaaataaattcaagaaatctattgtccaatatggtaactatagttgataactatgtattatattcttgaaaatttcaaaatattttaagaagttctcaccacaaatataagtacacgaggtgatgcagatattaattagcttgatttaaccattccacaatgtatacatatttcaaaacagcgtgatgtacactataaaaatatacagttttatttgtcaactaaaaacaagtcaaacaatacacacaaaaaataaaaaacttacagtctagaggaaagactgataagtaaaagactaaaaagtgtgattataatactatgaatatgtgcaatctgtatcgtaatgcaggatgctacaggactcttacgaagacatctagcccaatgaagcaggtatcaggggaggcttctcatccaactgcactatggaagatgaacagaggggtaggatttgacgctgcagagggatggaagttcatagagacccagcagttggagacaatgtagcacagctatagagagttaaaagctggaggaatggtgagccatgacgttggaaactctcgacgtgtattaagaactcgaacttcattctctcagattaaatgaggaaagctagcaaagagttttaaggaagaatataacatgatcacattcaccttttagaaagagttctacattcatggtgtagagaaagtggcaaggttgaactctgagaaacgtggtggctagaatctgggtaagaagtcctgtggacaatgggaagtagctgtgagaacagtggaggatatagaaatggtcaggaagaaaacccaacagacttggtggttcttcagacagtgttggatttaggttgcagtcagagctgtctctgtcctcctgttcctcagagctgaagtctttgctgatggtcacccagggagcccttaggtagttaattttagtggccagttctattttcaccatcagtctcttccccagagacacacaggatctctgccactggctcctgtcttaccatgctctcgtttttgttaaattctttcttccttagcaccaacttaatgcccttcaaaaatccatgtttaaaatgtatgctttttctacagaatgaaatacagtttactctgaactttcaggaaatcatggaaaaagagagtttgcacattttctttcccagaggaaatcatattaaagttaaaaaataagttattcattgatctattcaataaatatgtatttatttacttttattatttatttatttatctttagagatagaatctcactctgttgcccaggctatccttgaactctgaacttcaagtgatcctcctgcctcaatctcccaaaattctgggattacaggtgtgagctaccatatctagactcaataaatatttattaagtgtcttttatgcgccatgtaccatacatgatactggggcacagcagtgaacaaaacacagagagtctgtgtccatggagctcgttcttcagggaggaaaccgactctgtacatcacaaatactatacgtacacactgactacatatacacacatacatatagatagatgtgtcaacatatattaagtctgatggtgataagagggaaggcattgttacagtgtgccagggaaaaagcctcattatgaagacgacctttgagcaaagacctaaagaatataaaagaggaaacacagatatctgggagaaaagtagtctgcaagcaggatcaataagtggtgccttgcctggcatgtatgagacatggccagtagactgtaatagctggagcagagtgagcaagaggaagaagctgggagatgcattcatgacgcaccgggcaaggatggggtgggagggaagaagatcatacaaacttgcctcctcttttcattgacttgggaagccactggagtgtctgtgtagaggcctgataccatttgacttgagtattaacaggctcatcctcgtttctacttaaagaaaagattgtaggagggtaaggtagaagcaaaaagaccagttagcaagcttttgcatccagaagacgacgatgacttgggctggagttatgcagtggaggtggtgagcagttgtcatgttctggttatgttttgatgaaatgtctacagattttgctgaaagaaccagggtgggtgccggcgacgtcaaggatgattcccaggtttggtgctgcagtttgcttagagaagtcttagacaagccttttagacgagtctgctggggccatcctcaattcctccaaatacgctttctcaccctttgactgctggctctcctgctagccattttctccttttaagatgaggatatttaataatcactctcttgattctctacccatcttcttccaaaaatcaaccatccagtttccaaatgtgtaaaatgtgtgggaaaatcaagctattttcaaaagtgctgtaagtgattacaacctaaaaggataaatgttggtgttttgtctacacagcctctctttctccctccagaactaattgtcaatgtagacagcagaatgaggattagctgggctccagaagagttcatcatgttctgtgggaataatctaatttacccacatttgtgaaaagtacctttattagatttgtcatattgtgccattgaattaaagaccaactaacatttgactctcagcagaaagctatggagactaagcatcactagactacccaggggaagccactaggcaaccaagaccacagaggacttcctccagcaaaagggcaatgacccattcctttgcatgagggatgttgggatgttctaataaatgtatttggcctgaaaccttcttctcacattcaaggacaattagaaacattttaaagagaaggttgaaatagcaggaggcaaaatagtaagtcatgtaaaaaaacaaaccataaaagatacctgaattaatgtacttgagaatgaggaaggcttctccttctatttggctaaagtgaaattgttgcccttcttggccattcattcagccaaagcataatccttaaaccaagtaaaagagagaattgcatcatcttgcctttgggcacaaatcccttgaaactctgagtagatgcctgaggtgtttaagaatgtatcaaaaccttcaggtaaaggaataacactctgattacagggtgtaggcatcaactagtaaggaagacatgttggaggataccaataaatgttcaggacatttaacattttcctttgcctttactctggttgtgatgttttgctcacggccactgaacattcatcgaccttcccactggctttggtcaaaatatccccaatgatattctctatcatttcctgaatctttcacttaatgaaaagattttcatccctgctctttttaaaaaaaaaattgtggccttattatcaattggaatagatactcatcctctgacattttacgagtttaagattgtcattagttatataattatcttatgtattttaatttatttacattactatgacatgtgtttttgtcctccatgtagaactacaaactctttatatctagggataatatctagttggtaaaatgcgccaaaacttttaggtagtgttatgcagacgtctatattaattgagaacattaattataaaaattgtaaaagcaaaagcggaatgagtttccaagtgtaaaattatgattcagatttagtttctataaatggaatcataccaatacagcaatattttgtttcaactaaaatctcttaagtaacaaacatttaaaattagctataattatttaagcagtcaaaacaaacagggaagccaaaaattccatatcaggatgttatgaatttacccattctgacattactatacaggagctgtatttaaaattacctctaagaaattcatgatgcaatttcaaaatggaaaataaaaaaagactaccacattttgtcaacagcactctaaagaggtcctgatgcagatacctgtgaattattgtgaaattctattatctcatagaaggggcttaaggaaaaaaaaaaaaaaaacagtgtacttcagttggcatttgcaaagctctctaacacaactattccttagcattataaaaaaaactctaagccatgtcttctcttgttagcttgtattcattacagaagagaaagcagtgataacataatatagaactggcattctccaaatgactttaatccatcttcccaaagactagttctcattaatttcaataaccagagtcacaaccagaaaatcaacaaccacaacaaaaatggataaacaagtgacttaaatgatgtgttctgaaccctgtaaaatgcaaaactgaaagatacaaaacatgaaaatggggccaacactcggcatgaaaatagacgcgtacattcccatgccttgacaaagtataatattccaaactcaaattaatgggtcatctctaaagagtactttggggccgggcgcggtggctcacgcctgtaatcccagcactttgggaggccgaggcgggcggatcacgaggtcaggagatcgagaccatcccggctaaaacggtgaaaccccgtctctactaaaaatacaaaaaaaaaattagccgggcgtagtggcgggcgcctgtagtcccagctacttgggaggctgaggcaggagaatggcgtgaacccgggaggcggagcttgcagtgagccgagatcccgccactgcactccagcctgggagacagagtgagactccgtctcaaaaaaaagaaaaaaagagtactttggtaactcatttaataatttgaatgaaccaatttttctacacaatcacttgctttggttctttcatccagcttccacaaccatccgtctaacaaagccaagaaacctggagtgttccttgatatctttctatctctccacttcacaactaattcctcagcacattttgtctactctaccttcaaatattttagagctacttacatgaccaccattgctatcaccttggtccaagcttccgtcatcttttatctggatggctgcaaaagcttcatggtctctctgttccatccttgttttccttcagcctattgtcaactctgcagcctttcaaaatctgaggattgaactctgaccgttttttttcttcttgcccagatttctttctaagagggctggggaattatgtcttacaaaccatagtatctcattaagtgttgggtttttttttaaaattaacccaatataacttggcttactttccaacctgactctggtatagcattaaatgacagatagtagacccccttaccttaaacattcctttctactgatgtctcaagtctttagacaaagcttagctctgacaaccaactgccaacgaaagaagctctaaaacccactgacaacttgtaaggccgtgcttcaacatgctttgcctattcaggctgaaccaatgtatacctttcatgtatcgatttatgattttacctgcatttgcaatctccctagaatgtataaaactaaactgtaagccaactgccgcgggcacactttcttgtgctctcttgaaactgtttccacaggtcacagtcactcattgactcagaataaacttctttaaatattttggcagaatttggagttttcattattaaatctaaggcaattggtcatttatttcttcaaaattatgaaactgaagaaatagtgtcccattttgcttaaagtaaaagccaaaatctctatatccttgaaggccctataagattagtctctcttaatctccgagttcatctcctaattctctacttttctctcttgtaactggcctttttttttctcataaattatatctcatctgaagcctttgctcaaggcacctctcatcctggaatgtgcttttctcatattcagaaggtgaagtccctcataattgctaaatgtttacttaatcctatcttcctactgaggcttgccctatttaaaatggaacttcccacacatttcctaacctctaactctgtttctttatttttcttttgcactcatgattttttaacatactctattgtaattattcttgccctactagaatatcaactccattttggtaagatgttttggtctattttgggtcacagtcatatgccccagcacaaaaaactagttactggtaaatatttgttcaaagaaattcaatgaataacagaataaattactattctttctttcatttagcttccttactaacaagacattttttattccatactttcttttccttttataatagagattcagggagaaaccttgtgtgaactactcattaaaatgattagcgttatctgctaatcatttcaggacagagcacacaattaaggtcggttctggcatggagaaataaatactattataacactaatacaaattatacattgtcaaaggaagcaagttgttgaggcaatcacagaaggaaaagaataaaaaccccagcaacaggacgactttaaagatgtatttccagataacttgtattccctcatgatcagcacaagcgaaatgcactgatggagcagagcctccttgtccaggtgtgaattttctcataaacgtggtagatggagtgctttgttaagtgaaataattgtgatactccttactacaaaaagcaaaactgtcagaaatggctccccaaacccttattaatactgattttcaatgcctcctactatcacaagttttggactttattctttaagtgaaaagttcccccacaactcccagcagttatcatttgactgtccctgaaattatcttaggaaatatcattgaccaaatttgaaacagagcaaagttaaacaacggacattaacaaggagtataattggccttagcatttaccacctttcctctgccccctttgtgcaatacacgctctacatacttttttgatcagtaaaattcacttctatttagactaaagctaagtttttctctttctctttccttttttcccccacctcctatgtgtatgtgctggtgggggagggggaggaaggaagagctgagctacaaaattaatcagctccaggtatgtgccaggcattgtacttaatccaagttcattgaatctgaaaacaatcctaaaatgaagattccctcaccccaaatccctcaactggtaaatgctagagaaataacttggtctaagtttagcaatttaaatttttatattatttttctaaatcaatttattgtccctgttataaacaatgggagtgatgtcaaacaattttctggttaattattaagagaataaacagtggaataaacagtgagtaaggcaatatttaacaatggaagacataggccatttcctaatttgatttccagaacaataaaactgatttcactaatttctctgacaatgtattatcctggggagttaataacttatttttattaaggtgagaataaatgtactcaggtacacaggtggcagaaaaagctcatatatccaattacctgcataatgaaaccaatcacttaacttcttctttggctgttggaaagtcagaggtgctaaaaccaaattttctcagtcccttaagatggactgaaaatcctcaagcaaaaatcactctaccttatatatggaggaaaatctgaagacaaaggaataaggcatcttaagttctactccaggaagtttgtttaagttgctgtcttgaaaaccaagcctctgatattttcttagctgtattaaattgtagctaaaaataaatggctatttagcatgtgtttactatccaaggtccatagagcaagcaaaagggcaggctactgcttttaaaacccatgtagggattaattaacagaagggcactagctagcaagttatgctaaatgacaagtcttgattaaaagctaaaaacaatgcttatttcaaacctaacttcctggtctatagttactctcaactttaaatgcaatttgctaatttcaactccaaatacatatatatgcccttggggttaagaagtgcttcggtcatgcctgtaatcccagcacttttggaggccgaggcgggtggatcacaaggtcaggagatagagaccatcctggctaaccaggatagagacggtgaaaccccgtctctactaaaaatacaaaatattagccgggcgtggtggcgggcgcatgtagtcccagctactcgggaggctgaggcaggagactggcgtgaacccgggaggcggagcttgcagtgagccgagatcgagccactgcactccatcctgggcgacagagagagactccgtctcaaaaaaaaagaagtgcttccgaccttattttatcaaagcctttcattttccaaatgagaatttaaggtattttctcaagaaaatttttatgaaacaacaaaaaacccgatgtttttaatctcagaatctgaagatcacctatgctagaaccgctatacagtagacaaagaattagttttttctttcctcatattctgtatttcaggcccaaataatctacccaatttagaaggggaaagatgttcatttttcttaatgtgtgatggaatttcaatatgtacaatcataacttctttgaagatgggctggcacacatagaactgtgcattaggcttttaaaactttccaggattacgtagagtgagtaaaggcgattgacacaggaggcagtctgatgatgtggagtgaattgggaatcacagcattccccacaaactgctcagctgatctttctgtattacctggaagctcctctatgagcctggcttgtagcatttgaggtcaagaaaccagtcattaggacgtaaatttgtcatttgtcagaggaacacagagatccaaaaataatcctgccataatgtagttcattagattagctggtttgggaaataggtcacaggactgatataagttgatgggactggggttaggaaaggtctttgtgtaattcgcaaaattatatactttgatgatccctaaagtgtgaagatctatgcaacctgaagtagcaggcagactgaagtcaagtcagtgaagcatcagggaaggaagaaaagagaagagctgctacaatttaagggtttcctagcaatgggacctggggcaagattcctcatgtgtaccttgcccagaaatagtaaaaaatagactgtaatttcttttttttttttttttttttttgagacagattcttgctctgtcacccaggctggagtgtagtggcgtgatctcggctcattgcaagctctgcctctctggttcccgtcattctcctgcctcagcctccctagtagctgggactacaggcacctgccaccatgcctggcttttttttttttttttttttttgtatttttagtagagtcgggatttcactgtgttagccaggatggtctcgatctcctgacctcgtgatctatccacctcggcctcccaaagtgctgggattacaggcgtgagccaccgcgcccagcccagactgtaattcttaacacagagcctagcacaaagcaggtgacatgcaaaaatagtattagatgttgtctaaattagctttaccaactctgtgccttctctgtgtcagataatacactttttacatttcaactcatttaatacaacaaccatcttacagttaggaaatgaaaattccagaaataagtatagaagatgatatgtatgcagatgtttgcctgattgtaaagctcatggcttttctacttctctatatgtatgtaaaaataattttgagaatgacttatggtggttacttaactttgcatcagttctgtcatttaatattcatatctatcttatgaatttgaaattattatcttatgtaacaggaactacaaccagaaaggttaagtgccaaaatcatactttttagtaagtgggttagtttcctgttcgggttcgtttctctatgatacacaattgagacataggtactcaactgtcaacctgcaatcagtcagagactaagttgctcctgaaattttgtcactttagaaatgctgtagtttaatgaaggccactttaaaaacaatcactgccaagttgggaaaagtaataaaaatggtaactgtgctaagcagagagaattacttattttatattaatgaaaatgaatcttaaagtgtggcacacatcacatgtaacatgtattttttaaaagttcatgttacaatgtaccatttgcataacttagaaatttaatgtaattaagtacaccaaatgcagtgttattttattcatcaagatatggagtaatatttaggtcaaaaataccacattttcaagctttatggtaaaagatacttcactgcaatattttctaactgagaaatcaaagtcaatccataaggtatttgacatatacaattgaaatatacaaatatgtattaaactggaaaaatatatagatttaaaattctataatctaacatttagacatatatatctaatctaataatttttcaaatttgggtactttatattaaattaaaagagacacatgtttgtgtcatacaaactcatatcatagcaaatattatagaaaatgcttgccgtaggtcagatacaaagatgagtacattatacataaagttcttcatctaatcctgaaagttaccgtataaagtaggtacattcttgatccacatattgtagcttaggaaactaaaacacctaaccagaatttggagccaagctgtcaagatttcaaagattgtgcttctgtaaaaggaaagtcaaatcctttctggttcaactttacctgttgaaaatacttctaaaacccagttttctgccatcatagatacagaattcagaatacaatcttaatttcccactggaatgttccagagtgtagggaaaactaagaaccaaggtaatctattttaaatatttgtttgcattcatttgagtctagcgtatattttatgatcacaacacagccagactgtgttctgttaccaattgtttccattctctgaggtcaaggagaaattgtttagctcctatgtaaaaagggtagaaaatgtctagaaatgtattacattctatccagaagagggcactggcaggtattcaacccaatatctgatatttcaaacagagggaagcaaagctccaatgtaacaagtatcttttcagtaagatgggcttccattcatgccctgcagtgtgactataagaagcactaatatacctggataaaatcatgttttggaaactgatgctagtatttttagcagttagctaattttaacagctggcataagattgcacttttagttgatattactgcctaaacgttccacatttttcctaagttttactttcaaggaagtttacattatttagcattcagttatgaaagttctgtcaaccattacacaatgtacgtaagggggctatgaatcaaatgtgcctcatgatattgactttttgagcacaattctgtttcatcaaaacttacaagacatagaaattgaaaagaatcatggttttgatgtctgatttcctgagtggctgagacaagtggtttatcaatcatataatttctgcagatcattttaattagttttctcttacaagcagttcttttctgcactgtgtagctatgaaagtactctttattttgtgtccaaggtttatacttagaaactctctgggaacaactgtcattgtcaggccttgtctttgttattcttgtgttgtgaaattccatttgccatatctgaagcttaaatggcaacagaccctgttgaataattgtcttctagtgttagatgattagctttatatgtgcaaaatggctttttagaaaaactacctagataaaaaggtcaaaatcaaaatggaccaatttgaaaattatcattgcaacaaaaatttgttgtggacacatactcattgaatatatacaacgtatatttactgagactataatatgtgtcagccatttctattacaggcttattgaatttttcaagtaatcgatggcaattaatttgtcacataattgtactacttgcaaaaataatctcctaaaattaatgactttgtctcctgtgctactattcgaaggcagagtggaaatggcttttaggttatagaaaagaggcagagtgagttctctcactagctgtgtcttaggtaagttccaggtctctgcagtcaatcgccatatctataaaatgaagatgatattactacctggaaatgttgtgtttacaacctttatcagagtagtttactgctgtagaagctcgaccactggtaaccattgtgtttaagtttaattttcactaaaagcccaggctctgactgtaatggtcactcagagttgtgccactgaaagggcacagatggcagtggtcaagtaggccacgtcctctgcgtgcctttttcgctttcagaagtagggctacgaagctgaggacagccagaatgactgctgagattcacatttccattaatgcctgtccattccaaaaaaagatcagtgtatgccaacggcgagatgccttcctcaatgaagtcagaatctaacagcgatgagatcctttgtgtttacaagccttgaagctgagatcagatggcattgccattgagtcggctaggagccagtagtctaaagtctaagtatatattatactgtctgaatcaacttagtggctctcagttctatcatatttgaaactcatttttataataaatatttgttaatgtctcttttgctattccaaaatgaaattgctaactccctctaagaataatcttaaatcaatgtaatatgttaatagtgacataaaagacaatagtaagagattaacacatacaaatagagtactaatagtataatatgcaaatgcttaggtacaattataccagatgatgtggttataatgggtaactctggatttaggaagtgtaaaacaatagccaaatgtgccagttatttactctttgtctctcggttctaaacttgcacttctatgctctgctttatgctgctggggctgagaccctgcaaactacattctgcttgccaagattctctctgttaggatctgccactaggagcaccagagacttcaaagctggatgaggtggaagaaacttgccccttcctgtgtccctctaggggagctccttggctgcttgtggatcttgtgagcatcactctacgatgcttcagtcaccccccaccaacagcagagcctccttgtggcagcagctgaatacagtttgcaattttgttcaacacttggagaaccaggttaattgtctccttcttccctcaaataccagccggccattggtcctcctcagaggtctggattccagcttcatgagtctttcctctgagctcagagatactagcaccagccgagccacgccttgcttacaggtctgagtttgagtttcactagaccttccctcgaagttttttgttttcctttttttccccacaattctgggggtgggaagcagctgcttcctgaagttgctacttccacaataccttagagtttctttttctaccctttaagttaccagctgacaactttttactaattaagaagtgtttgtattaaatcttctctgttcaaatagctggtatcatttctgcctccagagtggactctgaccactacctctactgaatattgtcaacattatttctttcctgagatgaacattttattggacatttgaaataaggcctggtgataagtttatatatatgcataaaatcataataaatgcaacagctactggtactgactgatgtggggatgacacattggtggctgggaagccactagcagcattgccattgctaggttcaaaaatgatgaacaactcttgatctcttgatgatgtactagacagaaactacaatctgccctgatttgtagtgcagttccattcctgggaaagttagcacacactaaaatgggggaaaatacactttgtgtttttatgtaaaatatagccatgccatacaagatatgaaaatattcattgttcaggacagtcttatgcattgctgtttgtctaaaaactctcactcttacccactaagtgccattgcacttatcccaattacgggtgaccaaaactgtgcccacatcatgtcttagagtaatgtcatatctgttcagaataaaataaggcagaggcagaagaggccatttcctttatgaatttagttgaggataagtcatcccatgggtcttccacactgaaagggcatctcctcatgcttctttccacttggcaaaagtctcaaagtctaagttataatgaagatagtttttatgaaaaggataatatcctaaaagaaattcttagcccctataaacacattttacaatcaatatatgttaattttaacatgaaagaaataaaactagtacaggtaataacaatagtaatatttgtgcataatcatattataatacataaatgcctaggcacaactacattagatacacagggtgaacacaattatcagtctagttaccctggagcaccctaacacaagacaccagagcggcctttaaggtttgagaagaaaagggaaaaagacagaaaatgattctaaaaatcaataaaaatgttatacagcaaaggttttatgaagaagaaggcagcatgaagcataaggttaggattagagggccctcaagattaagctgaagttaggggagaaagtacacatgcgtggttgatatacatgtgtatttttattcgggaaacctgttggtgtggacacatatatatacagacaacccttgaacaacacggtttgaactgtacacatctatttctatgtagaatgttttcaataaatgtattagaaaaatttgtggagatttgtgaaaatttgcaaaaacatgcagagaaaccatgtggcttagaaatatattaaaaaaaattcttaggtgtgccatgaatacataaaatatatgtcaatacaagcctatttgatgatttgctaccataaaatttacacaaatctattgtaaaaaggtaaattgtatcaaaatttatgtatatacttactgaccaaacatggcatcactgcagttgagagaattataaacacacataaagatgcagtattaaattataactgcacaaaattaactgtagcacatactatactactataatttcatagccacctcctgttgctattgtagtgagctcaagtgtcaaaagtatccacttaaaatgccatgtaatgctaatcatctctgcatgagcaggtcataaccctggtaaattacatatcacaataaaaagtgatctctcatgtttctggtgtatttttttaaacatgttttaatgcaatagcataaaccttgaataacatatgagacccatacaaactgccactagtgatgctggaaatgctcttaagaagcagagaaaagtcatgacattacaagaaacagttaaattgcttggtatgtattacagattgaggtctgcagctgtggtttcatttcaagataaatgaatcctgtgtaaggatcattgtttaaaaaaaaaaaaaaaggaaggagagaggagaggagataagactcatgaagccactgctgcagctatgccagcaggcatgaacatcttggactttttgcaaaatacctttttatcttgaattgaaaatgcagcttttatgtagatacagaattgctataagaaaggcatatctataaactctaatatgattcaagaaaaagcaaagtcatggtatgacaacttaataaaggaaggtgaaggatctaaagctaaaaaaggaaggagaggagaggagagaagactcatgaagccactgctgcagctatgccagcaggcatgaacatcttggactttttgcaaaatacctttttatcttgaattgaaaatgcagcttttatgtagatacagaattgctataagaaaggcatatttataaactctaatatgattcaagaaaaagcaaagtcatggtatgacaacttaataaaggaaggtgaaggatctaaagctgaagaacttaataccagcaaaggatggtttgataattttaggaagagatttgttttaaaaatatgaagataacaagagaagctgtatctgccaaacaagaagcagcagatgatttcccagacaccattaagaaaatcactgagaaaaaatgggtatctacctgaacaggtttttaatgcagacaaaagtgctctattctggagggggcagggaatccacaaaggacatttcttagtaatgaagataagcaagcactaggatacaaggaaggaagggataggttacccctactgttttgcacaaatgcaattggatttatgattaggactgccctttttatacagctgctaactcccaagccttgaagggaaaaggtaaacagcagctgccagtcttttggctgtacaagaagaagagctggacaatgagaaccctttttctggattgattccatcagtgactttgtccctgaagtcaggaagtacctcatcaataagggactgcctttttaaagttcttttaataccggacaatgctccggccacctagaaccccatagttcaacaatgaacacattgaagcagtctactcacccccaaacacaatgtccctaattcagcctttaagtcagggggtcctaaggatttttcagactcattatgcatggtactttatggaaggggttatcaacactatggaagagagctcaaatagagaaacatcatgaaagcctggaaggatcataccattggagataccgtcattgttatagaaaatgccctgaaagccatcgatccagaaaccataaattcctgccggaggaaactgtgtccagatgttgtgcataacttcacaggaattatgacagaatctatcaaggaaattatttaaaatattgtggatattggggaaaaaaagtcaggatgaagggtttctgaaatggatcttggaaaaattcaagagctaatggaccgccagagtagagaaattaacagaagatgacttgatggagacgactgcttctgaatccgtgccagacagtcatcagtttggcagaagggttccaattatccgagattccttttgacttcttttacgacataggcccctctatgagacaggaggcccatgaaaacaaagcaaatggtgaaagaaggattggtacttacagaaacatttttagagaaatgaaaaagcaaaaagttatacagaaattacaatgtattttcataaagttgcactaaatgtgcctgcctctcctgccttcttttccacttcttccacctctccatctctgtcacctataagacagcaagaccagcccctcctcattctcctcccccttagcctactcaatgtgaagacaccaggatgaagacctttatgatgatccacttccacttaatgaagagcaagtatgttttctattcttataattttcttaatagcattttcttttctctatcttaccttacagtaagactacagtatacaaaacatatacaaaatatgagttaatcaactgttgatattaacagtaagccttctcaatcaacagttagtagttaaggttttggagagtcaaaagttatatatgaattttctactgtgagtgggtcagcaccccaaaccttcatgttgttcatcaatcaactgtacatatttaaatacaatttgtgtgtgtgtgtgtgtgtgtgtgtatatatatatatataatatatttctttatttgacataaagaggacattgttttgtatcttattcaaagttattagagttgggatacattgccttatatatacagtatatcaaagaaaagttattaggttaaaatagaaataatgaccttttagcaaaggtcactcaataaatatctgtacaattaggaatgaacaataagttatagagtgaggagagtgaactaaaaagaaacaaaattataaatgctgatgatgctgatgtccagatgatgagcagaattaactagtggtgaagctctaatctcatttactcattagaattgaggactagtcctccttgaaaaatggtgaccaatgtcctggtatgccaaggacagtctgacttatgcctgttgtcctggtctttattaatactttactctttaattaaaaaaaaaacacaccactaatttggataatggttaagaaaacttaggaaaactgataagaacaagtaacattcactgaaaacttaatatgcgctatgatgatattttcatgtttttatatgtgattgtatttacttattgtaacaaccaagaaaggcgattatatttaccctgttttacatcttaggattcccagagactcagagagggtacttgaatttttcaagcacgtgcagtttccaactgtcagaggcaggatttcaacccacagctatcagatttcaagctgccattaaacatgcctgggatatcccttctgagaggagagtaggcacaaaatacaactaaccaggaaacagattccttatgcagtcaggaagaaaaagaaactgggccatatataagctaggaccttgcttgaacaatgggaaatttaaaaaataagaagaagaaattatccacaagacatgttttcagccagactaatttatgaccactgtcagccactgtaattgcctatttgtacatagtctgtactcatataaattcccatacttgcaatgaaataactgtctgcttcaggcaaatgactggaggacttttttttttttttaagcactgtagtgtggggtcataagaaaacacaaaaacaaaaacctatattcttgaaaaaatccctcccaggtagaactaaaaaatcctaggtggttatcacaagatgcctaagacaaactttcatcacttcacaattttgactatgttaaaactctaattggttagcatgttgctttcaaaatatattcatgtgcctcctattctaaaatgacttaaggcttttagagcagaaagatccagaattcaacattttcccaaatttccagaaagggcagtacttataaaagcatttggtcagagacagcgttagaaatatactatcccttggtgaagctgtctgggacaaatagttttccaatatgcttttagacaaatttatggtttaatgaagtattttgcctacttgatcacagtaacaaatcagacatatttatcaccttcccttttaacaggcagcaattctgtctcccaagtagacttggctgacactttgccatattcttcatggtccaagtgattaaagagtccaaaatcttagactgacgcagtaacactcagacgcacaaaagtaactttggagctgagggccaaactggggacacaaaaaccctctggtgggtataagatgactgaacgagtttgtcatttttccattttcaaattgccaacctcgcccccttcacacacaggaaaattgtatttttcccagagcacatctgtcagacaatactctgaggagtgtttgaagccactctgtgtaaacagagcagagacgatcagaaaataacaactgccacgtgtgtaaagctccctgctgatatctgtgagagcacatgggtgtcaaaaccatgagctaagagccctgctcccattcgtcaccatcagcagtcaacccgagaaaaactgctgagcctcagcccaagtctggagacctgctgctcactggaatgcactagggctcaccatgcagcccaaatggcctcatcacagtcatgtgtggctttccctcttcaggtgtagactgagtcccatctccagcattacctgtacacctgtgattggacctgccctaattctgcacatttgatgaaactgtctcaagacccccaccagccagttctgcatatcaccatcagcaacaagagtttcctttctacctccagcaccctgcatctatgcagaaaacagacaatctgtcagtagtttgcttttttatttagcactccatttctagaaagtcgtgtccctagatatttataatcagaatgatgatttagctgatatacccaggtgtaatacctagacgatctcttaagatttgtatcttacaaaggatctatcatttttttgtgagtaaaatataagtatcaacttttttattattcatatactttttatgtttttatgctaaggcagtgtgtgacagtttaaggaagatgttctatttacagctattaataatttactcttgcaacttttgttaaaatatttatacaaataagttgtgcatgataattgccttgattacatttagatactgagctgtgaaataagcaagcatttgttcagaaagcaggagaggttaaaatgttattagaaatggctgagactagaggaggtcagaactgggatgaactaagtcctgaggtctgtgtgctttgggtgtgcccctactccttcattttggagaggacctatcaggggacattgactagtgcgcttttaggacagaaaaggctcccctgcaaccaggtaacctccaatgggcctgttgcctaaaatgattttaactagaggtaaagtcttttatattaaacttagacttcaaaatgtaaacaccccaagaagagaaaacagattgacttgaatctaccttaagatgtaaaggacagaaaactattttctctcagttttcctagaagtgggaaggaaactatagactgccatatgtgaagcaggcaggaaggaagcctctagaaaaagaaaaggatataacagtgaggggcagggctctggagggggccacctcacagctttgccaagggggagggtcattcccgtttcctcctgctccccatcccttctcagctgagggtcttctccaattgaccatacaccatatttatatgggcctaaaagtcatagtttttcagggagaagaatggacacagagagaagataaatggatggaaaaaggcaagcaatgcatattttacaagggccaaaattagtggaaagaggacagaaataacagagtgcttgcaaaatggggtatttacgtgcagagaaacagcgtgctcttgcaccgctaagcactgttctttaaacgtctctctgcatcccactttctaaaatcctcaaccaactgcctcttaaccacacaagggttcttagagccagattgtcaatgataaaaacaaaataggaccaatttattaagcatccattattgagcagacactgcacaaggaagtttatgcagttatatcacctaattcttataaccatctgctggccccattttttttttcagttcaaaaaaggctcaaagtcatataataagcaactagcaagtaggaatttaaacccaacttgccctggctccaaagcccaagctctctccaattcattataaatacctcaaaaacatctcttatttgttaataagatgcactatttattattaaattatttgttaataaatgcatgtgtatattagtatttatttaataaaattcttaataattatttgtcagtaatattaataaaataataatgactatgatatatagttaggtttagtagggccctagcaatgggatatttgatattcaggtacattcagggtaattcttttccctggaatatttattcacagctatggatttatttaggtgtggaggagtcttctgaagaaagcaaaaattagactcatgtcttaaattgaggcttagacaactatagacatgcttgatgaattgggatgaggctaggagaagataaaagctaggtttttcttattccatgaaagacaattcatcatgagacaaaagtacggtatgatgcctggatgcagttccagggtctaagaatcaaatcaaatgatatattcaggtggaaaatgacaaatgccttgaaaccctcgagacctagccatgaaagcagaatatatattccaagagtcaaagaaaaattatatatgcaaaccaaaaaagctgcctttcaagatctgcagattgggttccaagcaatgctgctgtggaaccctccctacaagagcataccacaaggagagagccatttccttcccaaccttcagcaaaatgccacgccctcctagcaataccagacaaggagttaattgcttgaggctgacctgcaatagcagcagattcctggctttgcagaacagaaggaggtgcttccggaccgcttgtccagccagcatgtcaggtgcacagacaaggcttgtcagtagtaacagtgatatcagtgaccaatgatcagaactatctgtctgagcactagtaacaagctgcttgctacttggggatactttgttgagactgggcaagacacaagttggttcttggaagcagaatgatttagcctcctgttgagagcaagctcatttgtgcatacacagcatgggagccactatactggataccttacacacattcatttgttacattctgcaacaatttgttaagaacagtacattattcatatcttaaagataaataacctgaagcttaaaaaggtaaagtgaggctgggcacggtggctcacgcctgtaatcccaacactttgggaggctgagacgggcagatcacctgaggtcaggagtttgagatcagcctggccaacatggtgaaactctgtctttacaaaaatacaaaaattagccaggcatgatggtgggtgcctgtaatcccagttacttgggaggctgaggcggaagatttgctggaacccgggaggcggaggttgcagtgagctgagatcacaccattgtactccagcctgggtgacagagcgagactccgtctcccgcaaccccaggaaaaaaaaaaaaaaggtaaagtgacttgccccaaatcacacagctttagtgttcacattctttctactatatcctgtgctttttcatgaccctttacttatctcctcatattcctcagactaagtcccagatattctagcaatgaccttttattcagaaaaattgttatttgggaacattatgaaatatttcataaatttaactatttacagttacatacatacctgggccttcccctataattattttgtaattcaacagaatatgatatagtaaccagagaatttcctttgaatgtagagaaacccaaaggtaaagatgagcaagcagataattcatgggtatacctcacaaaaagagatgtcagccaaatttatcatttatgtcctttttaattgtctgctggacataattatggtacaacttttaaaaggcaataaagtgtacccattctttatctcaaatacactttgcattcatcccaaagcaaagtgcagttccaaagagtctaaaaacttgtagagaagagtcaggtgtacaacatatactcttaggagtactaatgaatgctcaacattctatcagttccccccaactttttttttttctttgagatggagtctcactttattgcccaggctggagtacagtggcatgatcttggctcactgcaacatccacctcccaggttcaagcgattcccctgcctcagcttcctgagtagctggaattacagatgcacgccaccacaccattaatttttgcatttttagtagagatggggtttcactatgttggccgggctggtcttgaactcctgacctcaggtgatccacctgtctcggcctcccaaagtgctgggattacaggcgtgagccaccacacccagcctagttttcctttatgaactacaccctgcaagagaaggaagttgcctaatacttatcctactcagcattccttcaaggaacaaaagacaaactctaatgaaaactgatccaatacagttggtatgagtgattaactttgcacaaatgatcatatatgtatcaggcattttccaagtgctctcagctaaaccattttaagagagctctaacccagtagtagcaagaacaaggtgtaagaagaaatggcaatgaaaggcagtttcttgtcgaaagtcaccaagaaatcatgagtttagaagtgggttccttaccattctggatggttcttgacttgatgggtaataaactgcctgtggtagtccaacaagcaatggcaatgtaagtcagaaaaatggaagtgctgtttttggagaattgtattgccagcttaatacagaaagtagaaaagctcatgatgcttatttgttgtaaccagcagagttggggagtaggagcttttgcccaacctcctcatcagggaaaagcttgaggggcagaaggccactattttaccaatgacttgatcagcactgaacatccatcaagactccatggtgccctgccctgccactgaatatcacaataattcagacaagtcagtgggtgacagaatctcccatgtaactcaaataccactactgatagtttgaatatgtattcataaactttcatatgcatttttcatggtatccttctaaccttctgtgtaactaaaacaggtatgattccattttgcagatagggtaactgatggtcaaagagtaacacaaaagcacaaaagtaacttacattcaagtaaaggactctgtctctttaaaatctcaaatacagcaacctttctccccgcagtatactcagggattcttgggccagcttccaagcctgcaaatcctcgttctagtacacggccaggaggaaagaattccagggaaagatctaaattacaagagaatctgtgacatctgcctggcaaaatattatttcttcaaaaagtccattttttcagaaatgacattgaaggtctaacaacttgccatccttcaaaacctgatgaaatttgctgagggagagagagaaaaacaagaggtgaggacagaaagaataagtaaaggttcctgattaaactctgtagaacaaccaagtaggagaatgaataccaatggtaagtcacaggctcacaggctaaaagtaaaagctgcccaggaagaaagagaaagttctggaagcaaagaaatctcaagtttctcagtgggtaatgaaaataactgtgtcattttagatcacacaccttacagaatagaaagaaaaaaacttatcttaagatacactcaagttttttgactattttcctgaaaccaaggcgatggtactctgatactctgctaggatataaataagattttgttttttatgaactgagcccctgattttttttgtctaatggtacagtgcacctcaggttataagtaaaattatattcctattcttttccagatgttattttcctcgtattaacaagccattgatgtttacaggaataaccagcaaaaatgaagcaacatcacatgtaacttgctacaaatgcaaagcatcaaagcccaacaagatctcctcaataataatgtgcattttaacaaggtctccaggcagtctatttgcacactgagtagcactgttttagaggtcctttacctgagcaggttttattttaggtcctggccccaccctgctttggactctttctcccgttctctgccatagagtaatgcagaagtcactgaccatcaagaaatccaggatgataagcgccagagggtccttcttcattatcaaaacctggggacattggccatggtcatccaccaggttagttgcagaggctgaggctcagtcttatttctccaacttcctgcttcagggaccttctcacttcccactgtgtttttgctgtttgccatccctgcaatgccccttccctcacttacgcactccctaaaaaaggatatcgagcaggcgtgacctaagtcaaaactgtcaagtagtacatttatcttcagtaaccccgaggactaaggatccttttggttctgttctttcccctaaaccagccatcagcaccagtactgtcattatactcaccaacttgtactgaagttgcaaagaagttttgataacaataacagtaatagcaaccaacatctattaaacatgcatgacttgccaggcactgtgctaagcaccttgcccattcatttctgacaatatcttcagaacaatgacccaccataacacaaaattctatcattaattcattttgtacataagaacactggaggtagaaaaccacagtataacttgccataggtcacacaattagtggcatttatttacttatcttccgctataaataatcaatgatttaagaactctcactgccaaaggtatttgcattctacaaggcacagtgtctcttgcctgtaatcccaaaaccttggaaggctgagacaggtggatcactggagcccaggagttggagaccagcctgggtaacatggcaaaacctcatctctacaaaaaatacacacacacacacaaattacccaggcatggtggtgcatgcctgtagtcccagctactctggaggctaaggtaggaggatcacttgagccttataggtaaaggctgcagtgagctgtgatcttgccactgcactccagcctggacaacagaacgagaccctatctaaaaacaaaacaaaacaaaaagtcttaggagaagaggagctacctggtaaaatttcagcagccactggcatgaaggttttcctttgcccctgaaatcaccatccttgcagtagtgccctatgtacaaagacataggggtatttagagattaaattaagaataaaacacatttccagaatccagattacgctgtagcaaggactgtgtccagaaaccaaatccaggatacacagcaaaatatgacttatgcaaaggaaaatatcaattttctaatgtaaggaggttctgctccaaccaaacacttgccccactattgtgatggagaggacatttactaaaaaacagaaaaatgaggctagttggctcttttcttaatgtcagtaaactaatgattgtgttctgaaggcagtgtattatgatctgctgatggaggttagagtttcacattgtgactgaaagtatttttccattgtttcaggcaaaaatccttatttttttaagagaaaagaagaaaactgctgccagtattaagtaggtctagagaaataattaggcatttttccctgattatttaattgaccatggttgacctctatcggtgacaattatatttttttcatgaggaaacactgacctattttattccatttgccttccaatatttgaaaaaatgggggaaaaatctagcttgaatgtaaatgtttataaatccctaatcatggaaattcggaggcatctctgggcatttttatcactgataatcattaccttcaatggagagttttctgcattattggagagtagatttctaaaagcgtgaaatattacaatgttaaatatagctaagtgggacatgaaaactgtttcatttattttgttattccaatagggcttagctgacacactgttcttgtaatatagtcagtgattcagaaccagtagcttattaagcggaaaaaattaaataggaactgcctgtcattttgtaaactcaattttcagagcatttcagcacattcaaccaatgagttaggtaatcagaatctcaggagatattggattcaatgcataatgtgtttgttttaaattatcaatggcattatctattaattattatcaattgccaacatacatttcaacatattgcaatcaatattttgcatacttaataaatatttatgaaagatggtggtggattacagactgtaataaatatatcattgattacagggtttccacctatagcatttacattcaaaaagatcaacatatttttacattggaccacagaaaggagatctaagatggttcagctagaaaaaatattattcccagataaacatatttattttataaaataaaatttagtttgaatatttttatgtgcagtaagtcaatgtagtgctgagtgattgctactaaggtatccacactaatttgcatgtactttgctttaaatataaaagatgtaacagtaattcactcttactaactgaaaagccttggccaggcgcagtgcctcacgcctgtaatcccagcattttgggaggccgaggtgggtgaatcacttgaggtcaggagttcgagaccagcctggctaacatggtgaaaccctgcctctactaaaaatacaaaataaattagccaggcacggtggtggatgcctgtaatcccagttatttgggaggctgaggcaggagaattgcttgaacccagggaggcggaggttgcagtgagccaagatcgcaccattgcactccagcctaggtgacaacagtgaaactctgtcgaaaaagagggagggagggagggagggagggagagagaaaaagaaagaaagagagagagagaaagaaagaaaagaaaagaaaaagaactgaaaagcctttacccccaaaggacatgatcacaaggtagacatttgtgtgcaaatatttctgtttgtgtttataaacagtatcttcacatatttctaagaaggctggttaagagaaaatatgcttacatgctttcctgagaacataggggaaatacattatggcttgtagtttataaataaaagttaactgcatactcatttcatctttacttaaactaaataatattccattagagtaaatgtggtttgtgagtgaggaaaattaatcaggtggtccacacctggactgaggcaacagtccgatagctcacggaagcatttcaagaaaaccatttagagtgtggactgtttcagaatgtgaacaacacacattaatgtcctgttgattttctttgatgtttgggcttatttgaacttcagtttgatgactactagccatattttatatgagatgtggtttagagacaacttttataaaaaccagtttgccttgtattcctaaacctatttttttaaaaaaacgaattaaacagagttcagtatagaaatttggcaactgtcttagttgctgaccccttagaaatctggttccaagtactgttgacaggttgttatggaatttaaatgagtgccacagtatttaaagctcaggtcagaagtaataaaaacatattgaagaagcaggctttaattctaaggaaagacagctggaaatctggcaagtctcttttgagtcgattaacccaattgcatcttgacagttgtacttttcatagtgagtaaaatttgattcaactcaatgtacattaggagcatggtgagatattcaaaggtgaaaaaaaagagactggcccctgaggaagtggaggagaataaaaacaagaaaaatgccagtatttattgagctcttactaatccttagacactattccaagcactagtcatgatggaatgcataaagagagatgtaactggtcatgtgtgtttgcatgtagctggtgcagagggagcagcaatgatgtcaaaatgaagtaactggcattggaaaatttcttaagatggcatgattcagaagtcagagaagaaaaggatggcattctgggcagatggaatcgcatgagcaaaggcacacttgcagcagaaactgcaagacatactcagaaaacagaaagtcatatggcttgactctatcataggcgtgctggatacagagggaacttttgccttccttagcaatagagatagtacgttatgtagttttcacaaagatatttaatctcatttggaaattcatactatgtaaaatattctcatggttctaatgaattatgtgaatatattttacagcatttcttcaggacatttataaattatttagactaaataatggcattaaattgaattatatttaataacttatgaaatagtcattaaataggagtttagtaaatatgattacatagtttatgctattttttcatctttgaaaatgatcaaaattatctttgtgctctagattaatttttgatcttatctattgtatcaattttggagaaaatcagtacaatttttaaaattttctttccatgccattaaccctgtgttgcaagtgtaattttgctctttatgaaccacccacattttcctacttattacttctcagtgattttccccagaagactggatcttgcatatgttcgtattcctaacgctatacctgaaagacacagaattacatagtagtagatatcggtcaaacaagcaaagggttagaaatgtctcctacggggagacgtgtttaaaaagtcaaatctagaattagattggatctctgtgaaacatgttaagatattgtgtgagctctttctaaagattcttagcctctgaagacaggttttatgtcttaatctccccaaaggttaggtgtatatttaaacctatgtgtatatacaggtggatatgcatagatgcaagggtgtgtatataagttcatgtatagaaataggtatggataattgcacatttaattgaacagcccttgttcatagatgtgaagtttttccattcttaaagggctaatttaattttactataacctatctggtttaccatataacaaacaggataaaaggattttaaagaaaagcccctcgttggctttaaataatacttatgagactcagaacatgtcacacaataagatgtttcaacttaacacatattgtccttatgttacttcatcttttatacgtataatgtcaaagacctctcaatctgacttatcttttagatcactaacaaggaaaaaaccagaggctttcagctaggtttcatgatggtcatgaatcccttgaaattgtatatatgcatgtacacataaacatataagtaaagtaacatgtgtgtgcatgcatgtgcaaacatatttctagagaggtctttcatcacattttcaaaaatatcacagtccccagaagtttgcttctgagtgtgaccctaaatagctttgattcgaactcaattataattaaagttaaaatcataagattttcaggaaaatctcatggaagcagagtagactggtaattaccagggattggctggggggtggtcctggggaggttttggtcaaaggatatgacatttcaggtagacaggaggaataagttcaacatatccattgtaaagcatgactgtagtaataacaacgttttgtatacttgaaaattgccaagagaatagagtttaagtgttcttaccacacacaaaacactatgtgagttaatgcacatgtaattagtttgattttgccattctataatgtgtatatatatcaaaacaccatgttgtataccataaatatatacaattataatttgtcaataaaaaataatataatcactattttttgtaatttttagcaggaactttaagaatgcttgataagttttttgtttgtttgtttgtttgtttttgagattgagtcttgctctgtcacctaggctggagagcagtggcgcgattttggttcactgcaacatcgcctcccaggttcaagaggttctcctgcctcagcctcctgagtagctgggactacaggcacctgccacaacgcccaggtaatttttgtatttttagtagagatgggctttcaccatgttggccaggctggtctcgaactcccgacctcaggtgatctgcctgcctcggccttccaaagtgctaagattacaggcatgagccaccacagccagatggtaagtattctttagagattgcaaaacactgcattattaattaaagattaagatacatagatactggaaagagacaaatagattaaagataaatcgattcaatggatgtggatcagaatccataatgttctaacttgaactgttgtttttctgtattccgtaatcataaaattgaggttttctcttaagtctacttgctaagataaagatatttcctattaatattaaaatttataatagcttcaaaagacttgttttagagctttaatgtgatgagatttgttataaaaaatgacatttaatggaatgtttctggtagaaagcagtgtttttttccccaaagctgtgcacagtgtttgccatcaggggttgctcttctgtcacactttgtgacactctcctcacaattacctgcttgatctagtgataataaatcccatcaccaaaaaacgatgcacagctacatttatagaaaggaatacatttgcaggatctccagtggtctgcagaccacagaccacaggctgactatggccgcaacttgtttttgtaaggaacgttttactggagtgtaccctcacccattccttcaggatttgtctgtggctgctttgcggctgggatcacagcattgaagagttccaacagaacaacagaaccacatgtttcacagagccacagatattttctaaccagcatttacagaacaagtgtgccaatcctcactctagacattcattgatttctcaatgtctgtcatacacgcctgttacgtgatcctcagctttcagccccctcgccccttagatctcacagtcaccaagccttctagggaaagaatttcaagcgcccctccatcttcttcatttattcgctggctcagttcctctctaccctgcaattgtttccttttttgcctctcctgcctcatttcttcccacttgaaaataataatttacttttctggaaataccattacctgctactcttgctataaactgacaaaggttcccattagccttaagaaaatggttagaatctttatcctgacagaggcggccttgaagaatctgttcctgagaccttcatttacagaatcctcttacagacagccctctgcccaagactgcctcttctaccacctaagtcctgcccacccctgcttcaggttgccccataatgcctcactgtcagtcaggcctttcacagcctcctccacctgcaggcaccactgcttcctccacacccctcagccatcaccacctctcatctatacatgaaacggaatatccccttccattggtggatgctgggtttgagtttccctttctacctcttctactagagttaagctcaccaaagcaagaactcttttatatctcttgacagcctcaaaacttagcctagtgctttgggcagagttaagtttaaaatatattctcatgtgtggttaaggatagctgcaatactagcaattgttgactgtttactacatatcaagattgtctcatgggttaggcatggtggctcatgcctgtaatcccaacactttgggaggccaaggcaggtagattgctagagcacaggagttcgagaacagccagagcaacatggcaaaatcctgtctctacaaaaaaatacaaaaattagccgggtgtagtggcacaagcctggagttccagctactcgggaggctgaggcaggaggattgcttgagtccaggaggtggaggctgcagtgagccaagactgtgccactgtactctagcctgggcaacagagcaagattctgtctaaaaaagaaaaaaaaaaaaagatagtctcatgtacaaagaattttgtaggccaaccatcaaacaaaaaaaaaaaaaaccaaagcaaaacaaaaacaaacaaaataaatccagtccttcaggagcttatggtcatactctgaccttattcttaccaactttgtagtttattgtctcctgtgacatgcaagaactgaaattttctttagaaatagttcctatactttttaaaatttaatttgtattttccccacttaattctcatgttatcctcagtttggtaagttagtctacatatctagcatcatagctcaaataaagtctaacatactttaaacccaattaataattattattagcatttattaagcatttgtttattaaacaccagtattattctagtacttcatacttattatctcacttaatctctcaaaactctgagcgaggtattatttttagagatgaggacacagaggtggtgaggtaatctgacccagagaatagaataggtcaggcttcgagcccaggtagtccatctcataagctcaggctggtcaggactgcaccgtgctaccgcagctagacatgaatctacgcaggtggggcaggggtgagaagctcaggtcccccgccttctccacacctgccaccccccagcccaaagagctgtccaaccagctcagtgtttaaaatccgagtcacttctcacgcatggaattctcacacaccacccgcaagttttgtattgattttttttcctgaagatttttaaatcatttgaaaggtatatttactctctttcaaaacccatgttttgaattaaccatttattcattcattgaatcaacatttaccgaaagtcttctgtgctccaggcatttggaataaataaataaaaccacagctcaaattatcttggggcatgatatgattaaatagttaatggttctgggatatcttaatgaaatccttaatagtaatgacaataaattaatttatcaaattatttgattttaaaacatgtgcagcactttatagtttctgcactctacactttaatttctgagcctcataataactctgcagggtaggtatgtaacattccttacagatgagaatatagtttcatcaagcttgagcaattttctcatggctctctcaagactgaagtcttccaagtttgggttcagtattccaaagattggggacataatgcactctaagacatagttcttgtactcttgaaaaagtaggtcatatttctacagaaaaggtcagatatttagctatacactttactgacatctacttaaatcagaagttgatcttcatggagtacaattagtttggtttttacctgtgaattcaattagcagtatgaacagatctaaagacaaatatttcaccatgtacttactttaagatctaagttctattaacaagcatgcttctctgttgaaagctgtactacagataaactgaattggatttgctggtataacagttaaaagatcagaatcagtttgcaagaggaaccaccttcctgattgatttggattctgtattcattaggatcctagaccagggcttctctcttcatccctttctttttctctgcttcctaacctgtccctctgtggtgtgtgtacatccttcagggataggacatcgatcaaaccatgcagcaatcccagaaggtggcatagcagaatacaacacccttctttaaaccacaaagatccctggggactatttactgtaaaatacaactacatggaaagtatcttaattataacataattcagttgtcaatatatctatattctacattgactccacctaaaactttgagttagaattacttttggagctttttcaaaatgcacacatcaaggactatccccagacccaccagttccaaatctctttacagtatttgttacagcctaatggacggtgctgctgtgtagctacatttgagaaccactggtcaaagggttgggacatgacccttccacccctttaccctcagagtcataaacagaagatgctgatgttaaaattaagatgtgtttacactgaagaaaactattttagtttatatatcttccaatttcacaagtagtaaaaggaataaaattatggggaaaatcattactacttaggctaccacactccaagaaacagaaattcaagaaaaggcatcaaggccaccatgttggggctcacctcactgtggagacggctgattttacctcaaggtgagacaggaacctagtccagtcctaacaagatccaatccttcaaccatcaagaggcaaaagaaaatatcacaagattggattggtcattagatcaaactacaagggaaggagagtggtgcaaataatctagtccaaggaggaaaatgaaactaaaagagtgtcttgtttgcatttcttggatgattagtgacattgggcattttacatatacctattgattactgtatgtctttctgaagaaatatcgagttctttgcctgttttctaagtgggttattcatttttgggtactattgagttgtaggaatttcttatatattttagagatcaaccctttatcagatacatgattagcaaatattttctcccataccgtatgatgccttttcactcagttgactgtgtcctttcctgtgcagaagcttttgagtttgatgtagtcccacggtttatttttgtttttgttacttgagcttttggtgtcaattccaagataattgaaataagaatctggaagagatatctgcattgttatgttcattgcaacattattcacagtagccaagatgtagaaacaacataaatgtccatcaacatttatgttgtcataaacataaatcaacagaggaatggataaagtgtggtgcacatatacaatggaataccattcggctttaagaaaatcctctgatatgtgacaacatggatgagccttgagaacattatggtaagcaatataactcagtcatggaaatacaaacactgcacaactccactcatctgagatatctaaaacagtcaaattcatagaatcagggagtggaatgatggttaccaggggctgagggaagggggagaggagaagttactaatcaagaggcataaagtttcagtcaagatgaatagctccagagattgggggtacaacattgtacctatagtcaataattatatattgaacactcacaaattagttaagagcatattacatgctcttacagtaaaataaaataaacatttcattgtatagccttttaaaaggctgaattggacagatgggaccaatggtaaaggataatatttgagaaatgagagtggagaacccctgcccaccaggtaaatgatttagagggctgcttcttccttgattctcatggtgatgacagcacagttgcttatgcatgaatgggatcaatagaagccttcttgttagaggttaccctgggggaacaggttttgtcacagaggtaacacagaagcacagctgtccccatggttctccttcccttccccgcttgtccccaccctctctgtgcttacaacaggaaggctttatcatatccataccactgcagtcttatcacaatcatcagacacaagaccactgctcaaaaatgagcaattattattttaatggtcattttaatggtagccattctgactggtgtgaaatggtatctcattgtcattttaatttgtatttctctgatgattagtgatgatgagcatttcttcatgtcattgctgaccacatgtagggcttcttttaataagtgtctgttcatgtcctttgcccatttgttaacggggttgttttttgcctgctgatttctttaagtttcctatggattccggacaggagctaaacattgaatccacatggacacaaagatagaaacagcagacactgagaactgcttgagtggagagggtcagggagcatgggttggaaggctacctatcgagtattttgctcaataccttggtgacaagatcacttgtacaccaatcctcagcgacacacgatttacccatgtaacaaatgaaccaaaaataaagtagaaaaaaacagcagggtgtggcggctcatgcctgtaatctcagcactttgggaagccaaggcaggtggatcacctgaggccgggagttcaagaccagctgaccaacatggagaaaccccatctctactaaaaatacaaaattagccgggcttggtgacgcatgcctgtaattccagctaccaaggaggctgaggcaggagaattgcttgaacccaggaggcagaagttgcggtgagccgagatcaagccactagactccagcctgggcaacaagagcgaaattccatctcaaataaacaaacaaacaaacaaacagaataaaacacaatccaccacttcatatcactaggatggctattataataatttaaaaaaggaaaaatagcaagtgctgctgtggatgtggataaattataatccttgtgcattgctggtaggaatgtgaagtgatgtagtcattatggaaaacagtttgagagttcctcaaaatatgaaacatggaattgccatatgatcagtaattttactcctaggggtgtgtgtgtgcgtagtatagtgtgtgtgtgcatgtgtatatatgcacgtataggagtatattctatatacaataaattatattttataatcatatgtataacatatacaatagaatgttattcttccacaaagaaaaaataaatttctgatgttatgtcacaacatagatgggtcttgaaaatattatattaagtaaaataagccaggcaagaaaggacaaatcttgtatgatttgatttatgtgaagtgccagaatgggcaaattaataaagacctaaagtatatcagagggcgccaggaacaggggcatgagggaatggagaattattgcttaatggatacagagtttgtttgagatgataaaaaagttttagaaacacatagtggagatggttgccaaatattccaaatgtaactaatgccactgaattttaaaggtaagagtggttaaaatggtaaatattatgttatacatacaagtattttattacagtaggaaaagaaaagcccagttaagctcctcttaggtccacacggccctaccttacctcccagcaccaacactgaatgatcagcccacttggggtcatggccttcgctgcagaatgcagtctacccctcactccacctgcagacaggctcccactcccctgtccttgggaacctcatgccagccaggtaggggtcactcactttctgagcacctgagcctacgttttgcctccgatccccaggtccttttcagctgttccgagcttcttgtctgcttttctccttacctagcttgcctttttggtttctataatattttttctggtgctggtggttggcccagtctttgcagggactattcagctctctgtatttggcttttccaaatgtcttgtctgtttacttggcttctgccctttatctgtcctcatcctcccacctcacatagcccaactctagtctgctcccgtcctgacttgctcctgtcctgacttgctccatgttctgggcctgtcatacctgaaacacaaacttctttgtggttctaagcacctgacttttaagtgagccaattcacaatcctaagtttattccaggaagcctcaactcggcttcgtagaggaatcacttggagagctttgaaaaatactggtaatcaaggtagaaatttaccctgaagacatatctctagaagtacaaaatactataaggcacaaggaggcattgtttataataggagaagccaggaaacaactcaagggttcatcccgagggtactggtagaataaacagtggcacacccatccactatgcagccagagaagaggatgaacaaagagagcggtgttggaatgatcccaaggataagtcgttttaaaagaaaaaatactgtgtagaatgatatatatggtgtgcaacatttggtaaggacagggaaaaataagaaaaatatgtgtaagtttacgtatgtgtatttgtttattttttcaaaaagaaacagtggcagtataaatcagaagctgacacaaatggttactaagtagaaagaaaaatgggcagagaggctagggaaagaaataattttttgtgtgaacctttttatttaatttcaattttgagccatgtagatattttacctattttaaataaaaaactacaataaatgaatataactgtatgccaaattggtacccaatcacaagagaacataattatttcaagtggctttttaacacagaactctgtgtatatactcaagacaaaggaaaatctaatgtgaaattttgacagtagttttgttagtactaatgttgaaatattaattttgaaattattatattcattgtataggataaataaatatattgtatacgataaataattttgacatcattgtagttatatacgtatgggataaataaatatattgttattaggaaccaagcttgttaatgttaaaaagagagagaaaaataatttaagaaaaccctataatattaaatattaaattttgatttaaaaataatttttttaaactttgacaacggaccaagaaaataataccccagtgacaataaaagcctctatcacccaaatattggttactacagactattttatactcaaaggatcttgcgttgcttagataaatggtggtccatctatgttagaacaatttcaagatgagcctgagacatattgtgccagaaaccaaataactgatcagacattaacagtaggttttcagaataactcatgaatgaacttatggggactcccactttgcaagtttggaaaaaaaattcactatatttccttctttttatgattgaatagtattctatcatatatgtatatatacttcaaaatatcatgtgcatattaaatacatacaattttatgtcacttaaaaaataaatctgaagatatttcatatttgtttacaaagcataaataagtatatgaattcacacttacaccaaaaaattaaattaaatttactagatataattgttatacaattcttactctgaaaaaaatggtggtcaaatgacaatgattatgcctttacctttacgttgctggagtaagagtagttcattcccagctaataaatttagaagaatgatagactcctacaacccctaatgaattcagtaaaactgttgattcagccaaacatcatcactggatgctaggatctttataacagggggatctgtctaacatcaacttgagtatcaataatagtgacctcatgggcctctagtgtgttgcaatatgaagtctacagcatcatctatgaggtatccttgccaaaatgagtaagctgaatctcatcaagcatttacgcttaccttccttattccagagaaaataacacagagaaacaaactagccaatactttgaaaaatcactcagatctatcctgaacacaggtactctacaagacaactggctgagtcttccaaacagactatatcgtggggagagggtaactagggagattgttctagattgggagagactaatgacacacaataaccaatgcaatgcaataaccttgattggatcctggataagaaaattactagggatgacaaaacaggaaatctgaatatgaacagaatactaaacgaggctaagaaagtattttttaatattctaaggagaataatggtatgtgactatgtcagtggaagtccttattcttagaggtgaggtaaaatgatgtctgcagcttcccttcaaatggtttagatggaaataaataatatatatgtatgtctgtgtgcatatatatattctatattcacgcacacataaaagtatgttatatatgtatgtatgtgcacacacgtgtgttcccctgcatttgtgcatgcacaccaaatataacaaactgttaacaatcattgaagctggatagtgaataaggatgtttattgttccagtttttaaatgtttccgtatgtttgaacacttttatcacaaaaatcagaaaaagtacagagagcaggatccacccagagagattcagatgagccaggatggggcttgggcatcagtactcttaataaactcccatgtgatactgatctacagccagtgttgaacattgccctcacccatcatgccccaccatcctgccacccaacctcactagattctggcatctcctggccctacagacacctcctcagagctcttgatgcctcgttgagccccttgagtcaagactcctggggagctctttcttcaactcactatacaggcctttttggacggccaaacaaaatcccaccaggaagacattcatcaaaaagagaggtgtcatggaaaactgcaaaggcagacaaatgtgaaccataggggaagatatgggcctaatatgggaagcagcaacactaaacaaagccgtaaacaactcaatgaaaagacctagggaaaaaagcaaagaaagtggaaagctatactgatgagagtcccaaaagtaccgctaagccatgaggtcatgcttaggatttattcatgtcagcgtcatgagtagtgttaaatgaggagagctatcagagagacctttgtttcagggattcaaaagctgggacccagggacacaggacataagtagataggcctaggccactaccagtgttttcactagaagagaaagtaattttggaagcagcacagatgtgtgtccccagctgctctgcctccccttcccctcacaaagacgtcatccagaaccctggtgaaatgcagctttccaaaaaaatggtccacaacctgtaagagatttgacagtacaacacagcatagccttgcggctcatctaccatagaaaagtgattttttttttttttttttcgagacagagtctccttttgccgcccaggctggagtgcagtgacacgatctcagctcactgcaaccaccaccttccaggctcaagcgattctcctgcctcagcctcccaagtagctgggattataggcgcctgccaccacacccagctaatttttgtatttttagtagagacggggtttcaccgtgttggccaggctgctctcaaactcctgatctcaggtgatccgcctgcctcggcctcccaaagtgctgggattacaggcatgagccaccgcgcccggccgaaaagtgatctttaaattagggactgagtacttccgagcatacacactttccaaggtactcaggccagaatgatttcaggatcagattccaaatcgttagtccctatttttccacaactgacctgcttgagccagcacctgctgtgggggttgcatgcctgtttggaatctgcttgcccacaacttccttccacaaatgggcttctcacttcacaaaggaaagccatacttctcagtggtcaggaatcttactgtggggcattgcctacaggtggaaaatcttatcaaagggaagttcaaaatatttgtgttggcaaaatctcctttgcccaagggaccatactcttcaccattttttatcccatccatctccagaagagatgtgtaccttagaaaattagtttttatagttaacaattactaaatattttgaataaaaaaatctatttgattcatcatttactactaataagcatagtaaaactaaatgcagaagaaaaagtttaaccctgggaaccttatgtcccatgaaaattatttaattaagtttttatttgtaatcatattttgttgccaataactatgtgttatagacttgatccaagtggaaatgtttacttatattaatttatacacccttgtattttgctgtaaaaatagtctaaagtatatatgttgtacatacccaaatgcttccgtaagacttgaaagcgtgtctttgaaattgaggacgggaatgtcagggaacagcttctgctatatcgagtgtgttctgaacaaagttaatggagtgtaaattcatcaggctcctaatcaaaggtttgtctcatctggcttaaaggcaattaaacataaaatccaagatgtctaacataagcaaaaagaacagtttagcttttttggagtagcctaagaaaacggctttctgctgaagaaaccttattctggcatttaaaagttaggtttcaatggaatgaaatcaaacgtaaattgacaaagacaaaataagaaaccatcaatgattgaaatattgtttgtgattacacaaattcatgggatatactagagtcatgagttttgttctcctgggatgtatttgcaattaaaagcaacagattaaaaagcaacttaatttattcacaaactcacccaagaaaaatgccatccaacacactgaagatttctattcattcaggaatttgctaatttccctgtagtatatgaggctggtatttttatactcagcccacatattagtaacaggacttctgatcctagctgaaattctcttttattatccaaaggctcgtcaaactggattatctcgaaatcctaatcacatctcatccctccactccacctctgactttcagcagatatcttgacctttcatctcacagcttcctgctaacaagcccctagcccatatgtgcccacaaatatcatttccccttgcatagatattatgacagcgggagtagctcatcatatagagcgctctccccaaaataaccagtcttcatcttgttgttaaagccagtgagtatctttcagttgttatatgactgccaaatgactctttggcagcattttacacttctgaaaatcaaaatgcaactttttataagcattttgattttaatagaactatttagttacatgccctacatggcattttctctagcaggaaaatgaacagtttggtcttagaaagatttttgatataaatatttcaaaaataaatgatagcaaatacttattgaggatgtaaatattccaatatttattttaaatacttcatatttattaaagcatttgatcccccagataactctgtaagatgggtatttatactctctccattttacagatgctgaagagaaagtgtaaaaaaattgctccaagtcgcagaggtggcaagtgtttgatctcaagttgccttagcctgccctttacctaccaaatgctgccaagttacctgtaaaattcacttgaccagacacatcgagcaatcagattaattgagatttgattttaagatgggcagcattacaaagaatttatagacaggtagtgagatacctagaaagacagacggatggtaagaatgagctgattaagaagacacctccatgtgaagtagctatcagttggtataccaaaaccaaatcacagaaagattaaagaacttggaggttatcaaatcaagcctggaacagaattttctaggtcatatgcagccaacaatgtttcctactagactgagaagaagctacattttcttttaagcactttgctaagtaaaattacaaagatggtagaaagaagaatgcaaggttaatcaataattaagttagaaaatgaagttttgcttaagatattagataaaagcattcaagcaattaattgaaatgcatataatgctgctgctatagaaatttaggtaacaggcagattaagtaaaaattgatttttcttgcaagacactaacacccagaatatcaaggggtggacaaaaaagaaatagtactaaacaaatttttttgaacccaggtgatcaaaatgttatacagttttccaaattcaaacactatgaagctgtccttagataatggccctaccattttcccattactttgcaactttcatattgctctacatcttcaaagtttttctattagagatagcggatatcactagtagctttaaaataagtgattcttgacccccatccggatattaagtgttttgcatgttcagactcatgttaggtttaatttaaagagctagtggttaggcactccatagaataagtgtgaaacaatagtcatttacgtgaattaaatgtttgacattagaagtgttttgagcctagaaacagacacataaatgatcgtagttaatggaaatactgccatgcttaagatcattcagcacttctccagaatgcaaagtatatttagaattagatgcagatttacatgtgaataaaagattttctccagccttactctccaacatccagagtaacaacagaacagcaatgagaaagagaaagtgacatgaaaataatttgaaggcaaaaagcaagaatgagaaatgttcatgctcaggtaaattctgagaacaaggtagtgctataaagaggggaaagaatagaaagaagtattaattaatagtcactaaaaattaaaaagctgtcccacttgaaagtattaactgggttattaagagaaaagaggaaaaattactgtggactgtgcggtgtggatctgggacaaaaggtagtataggaaagcataatttatggaatagaaagctatatggagttttaaaaataagcagtaattttgaccaccaaaatagagatgattatactcttaagaggaaaatgttgagttgtagccatagtggggttctgttacagcaaaagtacaagacaatggaatatgcagctattaaaaattagaagagacaaggccaattttctgtagtactggaaggttttggtattcactaaaattaaagatttaaacaaaaggaaagtcatcaaatgtcttttacccttagaatgcaccagtatggatacagttctggaaatgtactgtacaggcatgagttcaagtcctctgatgggccagatggatttttatctcctcatccaggagcaggagggccagcacatttcttgcttttaatgatctgaggcttccaatgttttccttttgtctttctctagcatctctggcttgttcttgagcctatttactcttgtttcatcttcctgttatttatatatattcatagcaaacattcttctgcattcattttaggaacaaaagcttatgatggtatataaaattcttatctttaccttccttctctctatattgaaaaataattcctttaccttttattcttagaaatactatttcactactctagtattcagaacatacctcaatttctccaggttaagtttctgaagttcagcaaactacatggaattccaataattcaaagtagaataaccatatggtttcacaacacactgttattgttttttgtttatctcttttgaaaaactttaaactgtggattgcttcatcttttggtaagctaaactcacagatattattgtttaatatgtacacttgatcaacttttcccatattgcatttctattgaaaatttattttgctaaggttatcaagctagttctccaatttgttagtcaattatatttttggttttgacaagtaagaaagcttttattgaattttcttattacacatgcatttatattatttaaaaatacatattcatagaaaaaagaaaacatagaaaaccgtaagagtcactcaaaatatctcaacttgcagataaccattgttaacattctgctatgcatcatcatttagaatcatagagccaattctcaaagagtaatagacacaacgcttcacctactgttgtataaaaactggcccatgaattaacatagaaagaaaatgctggttcatgataactattgctgtatgtgtgtctccatcaaccactggatactacctattcttctggggatatgggatgaaatattctctctcaggaagacacctggatagcagggcagaaaagccattttacattcagcctttttgacaaagaagtaagcacttgaaaaattattgactttttctgttttattttctagtatagcattcaattgatttgaactgtttctttttaaaatatattttgcatagtgtgtcatggtgtaaaacacacaaccattatttcaacaaatattcattgtctaactttccttttggcaactgatgctgtggatatagtcgatgaaattttaactttaaataaaagctctgtcatatcttaagaactctaaagctatacaattttaaaattctcaaatttcaggggaaagcttgcatggagattggattatttacttctcacccaaaccagctcttctctctcaattccctgtgtccatggttaccagcatcattcacttgcttatctaagctaaagaggccttggatcttttctctcccttcatcccaaccattataaagtatacagttcagtggcattaattatattcagaacattgtacaaccatcaccactactttttccaaaactttattcatcatcccaaacagaaactaccgcacccattaagcaagaactcccatttcctccctctcctttgctactgatcatctctaatctactttaggtctctatgaatttccctattctaggaacttcacgcatgtggaatcatacaatatgtgtcctattgtgtctggtttatttcactgagcataatgttttcaaggttcattcatgttgtagaacttcactcatgcatcagaacgtcatttctcaaatattctattgtatgtagataccacattttgtttattcattcatctgttgatggacatttagtttctgtccaccatttggctactgtgaataatgctgcaatcaacactggagaacaagtatctgttttcgtccctcctttcagttcctttgggtatatacctcggagtggaattattggtcagtatggtaatttcatatttttttgagaaactgtaaaattgttttaaaacatatttgcaaccatacttcaattttatatcacaatttaatagttaaataccaacagtaatcttttaataaaagtacctaactcttatggatcatttcctgtatgccagcatctcatctaatttttctcaatgattctgtgcagtaattaccatcattagccacattctaccaagaagaaaactgggactaacaaaaatcaagccatttgtcccatctggtggtagacgggattggcaggtaattctgtctgtataaaatacctaaagaagatttaactgttgtcattttacaggtagaatcagggccacaatggctagaacaatttgctttgaggtaacaagctgagtaagtaactgcagggtcactagaactgcagagttacactagaactcacttcttaatgacttgcccagctcttccattgcaccaggatgcctgcctcactcatattatatatatatacatatatgtaaaagataatattgtgatcattgtatagctacacattcatatttactcttaaactgaagtccatttgtctcataagtaaaaagagagaaaaaactggagaccaagattattacaattataataaacctgaagtatttatggaataatgcatttgtactaagcatcacaccaaatgttttacacacattatcttaacttcacaataaatctatgagctaagtgttattatcacttcctctttctgtatgaggtataaagtagatatcagaaaaaccaatgaacttggaaaagtgtacacaaccactaagttgtaacgcaaggcttcaactctcagtgcacccaaagtcaaagcccatgatgttaactcttcttattctgtaagagttatctatcataaggaagaaaatcagatgcaaagaggatttgtataacttttactcacacttaaaaccataagaaaccctaactcagagaatcatgaatgcttatgattttattatttaaaatttttatgtcttaatgttctattctttttgttacaagtgttaaattcataaaatgttggttgatcctagattccttctaggaaaggcaaaatgggagaaattcctcaccactgagcaatgccaatgacttgaatgaagtgactaaaataaattaacacgagtggtgttcacaatgagattgttagaagtgctacatattttttaacaatgattcttttgcatcatgttagctatggagtctcagctggcagctatcagctgtctctagctgtaaatgacagcacaagtgagcagggctcacctacacttgctctgctcccactgatccctccatccccatctcgcagcggtggggaagcacctgccccttccaggaaagagaacacctttctgaacactgcctgccccagctctcacagagaggcagtgggttcagtgtcataatgcggtcttcactccacatcccggatatccaatcctgactacaccccttactaacaagggaaccttggacacgttgcttaacttctctgtgcctcggctttctcatctataaaaaagatgatgatagaagcatttaatccataaggctgttgagagggtggatccttcaaatagtagcccatactaggagctcagtagctgtcggctaatatcattacttttatcattaacactatctcccaggaaaggttagccattcaggaactccagccccagtaagaaggtggacaaatatgcctgtggctgacaagtggattggccaagtagaggtaggaggtccccgcggtgttactgttaacagaaagctgaagttgattctgtaattcccatttggctctgaacccacattctattgaaaggaagtttaaacttgttctagcaaatcaaacttactgggcttttaaccacatgactcaccccaatgtgagtgctaattctgaaaaactccaccctcacttccccatgaacacatgttatcactctagagtcactgaaaacagacaaagggaaatgaagcatgaagctcattctaggtcactggcaaacgtatgtgaaaaagtgctgtcttctgaagagaagtgatttatgttggaaaaggttaatggcattctctttgacataggcaggcttttcagtaatactgagttctcttaaaatttaaaaattaggctgggcaaggtgactcatgcatgtaatcccagcactttgggaggctaaggcaggcggatcacttgaggtcaggagttcgagaccagcctgactaacacggtgaaaccctgtctctaccaaaaatacaaaaattagcctggcattgtggcaggcgcctgtaatctcagatagttgggaggctgaggcaggagaatcgcttgaaccagggaggtggaagttgcagaagttgcactctagcctgggcaacaagagtcaaactgtgtctcaaaataaataaattaattaaaaaatacaaaacttagccgggtgtagtggagtgcacttctggtcccagatactcaggaggctgaggcaggagaatcacttgaactcgggaagcagaagctgtagtgagctgaaagcacaccactgcactccagcctgagtgacagagtgagactccatctcaaaaaaaagaaagaaagaaagaaagaaattaaaacttccctttaaggattttttttcactccatgttgaactgattactgaggacattgactaaactttgaagcagagcagttcattaataaatttgatgtgatacagttttacatgtttagaagaattccacagagtggacgagcgttgaacctggcatcaattctctcctttagcaaaacttggaaaaatattgatattaaaactctgttactattggaagagatttctgtctctatttgacacgaataaagaaatgtatattacatgagtatttcccttcctcaattccttacaatgtgtacacactagttctctttgggaagaaacaagccaagcacaagtttcaaaaaattcttactgataatgcacacaggaaggggaacatcacacaccggggcctattgtgggatgggggtaggggggagggatagcattaggagatatacctaatgtaaatgatgagttaatgggtgcagcacaccaacatggcacatgtatacatatgtaacaaacctgcacattgtacacatgtaccctaaaagtataataataaaaaaaaagaattaagagccaacctggtaaattaaagttctccattgcagatctattctattgggtaataaaatgtgctttccttgggccaaaatcagcaatagagtgttacattagtttcctgttgctcctgtaacaaatcaccacaaatgtagcagcttaaaactacataaatttattatcttacagttctagtatctcatatttaaggttttagagaaagtagaaccttgaatagtagtccatactaggaactcagtagttgttggctaatattattactattgtcattaacattaacacttactatctcacaaaaatggttagccattcaggaactccagcccggggaagaagctgaacaaatatgcccatgtctgacaaaaggactggcaaagtggaggtaaatgagtccaaaatgggtctcactgatcaatagtcaaggcagggctgtgttctttctggtggctccagggaagctgggtctacctgctttttcctgcgtctagaggttgcctgcattctttggctggtggcccctcctccatctttgcccgaaatgatgggttgaacctttcacgtatcacatccctctaagctcctcttctgcctcccttctccaattttaaagacctttgtgattacattgggtccacctggataatgcaggctcatttccctagtttcaagccagcagtctggcaaataaattcaatatgcaaattaataccccctttgtcagataactgaacatatttataggtttctggaattagcctgtggacacattttggcaatgacggttctacctatcacaggtagaaaataaaaaacaagaaaaataaagtaaaaagagagcgtacaagggaaagccaaatgccctaggatgacactttcaaacatcacatccacctgtcttaatctaggttgttgaagtgaacaaacagctgagggcatggtatatttaagcttctgtgagggaaggacaggcctccctcagcccaggactgaaatccactatacccgaaggctataataacagatcaaatgctcagattttactctgaagggctgttcatagtgtaaatgttgcccaagagccattaaatacatttgcccccactttttgcttaaatggaaattccaccaagtgaataaatgcatagcaaaactaggtgcattcttgcattgtggacagtcaacacacctaaagagtgtgactcaaaactaattgaaattaaaagcaaaattctccaattgatgtgtttctggtgtcccctcatagacatgaattccctcctttgcctctcccttatgtttctgcctaaagcagcaggcaatgaaggctaaacctctgaaagtgagcagctgaaaaattgggatatattgctggcgtacttgctacttgtgaaatatctcctgtgccaataatgaaatccatcatgtgaccagctgtctttgcaaaccaaagaggtagagcaagttaaatttctatttcaactgatgctttttataaagaaaccacagcagctctcattgtttatttaaaattagtgcaaatgaaagcttttaattgtctctgtgatgtggcttccttcctgcttaagatgagctcatggtgcctcctccatgatcctctcccctccccagcctggtctgctgtctcagccgtatgcgcaactcattctcatctccatggtgtcactcatgttatctggcctgaaattgtgccttttctctaagccatttcaatagaataaattggaatactattttctatatgaagctttggtcaaatactacaactcagattaatataaaacactccaaaatcctatagtatttaatgccacggagattgctacctaatttgtttatgttttctttttaatcttctaagatgttctaggctttatttgactgcatcccacatcttgtttcgtaattttcttaggatttaaggcagaacctaatgttcaaactcactggtaatcacggaaacacaaattacaacagtaagaaatgatcaaataacgtgagattcatcgaaatagcagaaataggaaagtcaatattaccaactgtgactaaagataggaggaattaagtactcttacgtccttgtaaagttgtgcagccattctggatcagattggaaggacttgggaaaataagttttttttgttttgttttgttttggttttttttgccttaagacacaatacactctctcctgaatatcccagagatattctcacaacatccatcagcagacacaaatgggaatgttttccatggtctcctatgtgggaatggggagttggcgaccaccccagggtccatcaggggagaggaattgtgaaatatactggaaacacactgcagaatagtgtgcggcagagagagacaacacggggagatcttacacacataacattaaaagaagaaagaaaatacaaaatattttctaccacagtactacttttgtaaatttaagacatatacacataaaacattacatattggtacattttaagacataattaactcaatctgaggtccaaactaaagcagctaatgacagacagatgtggacatacagaatctagcaatgtcatgtgaaagtcataggcagttttctgtctcgtctcttaaaaggcatacttttctttctttctttctttttttttttttttgagacagagtgcccaggcctgagtgcagtggcatgatctcagctcactgcaacctctgcctcctgggttcaagcaattctgccacaggtaattcttctgctgcagcctctcaagtagctgggactataggtgtgcatcaccacatcacttggctaattttttgcatttttagtagagacaaggtttcaccatgttggccaggctggcctcgaactcctgacctcaagcaatccacccgcctcagcctcccaaagttctgggattacagctgtgagcccctgcacccggcccttaagtgggtttacttttgactaaagataacattacttatcctttaattaaatccaaaagtgagcaatgaaacagtgagcggagttgttaaaaagattttcaggtgttctgttgaacctgaatgcatttccatttgagcacttgcatttatctctgaaaacatagccaccagggagctttagaacatctgctatcaaaaccatcaaaactgaaagcctttctattccatctcctacaattatattgaaatggattgttgaccattattttctatcttcaacacatttattttcatcagcgatttcccaccagcacagcagtatgacatttaatggaatagctattgtgaaataattatgtttaccattataattctaggtctgcactgattttaatcaaactattccaaatagctttttgatcatagttattatatacaatttagaataatctgatcaggttggaatagcttctcctaattaaacaagtgtgtacataaaaggtgtatatgaatggctgtttacattttaaggaataaaagaaaatcagacttacgaatgtcttattaaaatgaacaataatttggattgtgttaaatcagttctctataacatgtgtgcatttaagtatgtatatatattatagaagtgtgtatatgtatcatagaagactaaatatatggtaaagatttctatagagcataatatgtaaagtaagagacttatatagaaatggaaattcagaaggtaaaatttcccaaggaaaaatattcattctaatatatcaatcatgatttactaagttgcaaatctttttaaaacagtcccaacattttagatcaattgttaaccgacaattggcttacacgaggtggattaattagttactagcttcatttgtgctttccaaaagcatgttttagcttttatttgtcatacaacagagttaagcatgggctaccttgtttagaattccctcgttgctgcatgtggaggttaatactcatgtcatgagcaccaaaagtctggtcagtgtgcatggggaatggactattaacattgtttcttccctgctgtttcttctaggaaaactgacacgcttcacttttcttgatctctttctacaaaacacacaaattaagcaaatatctgaacacaccaacaaacaaaagcaataaacaaacacttcattttgtcatctttatttttatgtagtgtttattacattaaaacacatatgttatatgtatgtcttgaacaaggcactgggctagacactgagtattgaacagacaaataagttatagtccctgcctgtaagaagactaaaatctcttcagaaaagtgcaggtgtcatgcattctaatgaaggacatggtaggaaaaaagcctgtgagagagaagtgtgttcagtcaggctctaggttatttcagtcccgtctttcatggctccttattcttcccattgcttaggaaaaaaaatccctaagcagtgttgcttgaccagacctgtgtgcttgtccccaatatgctcaagagaatgatacaggtacttttctgcccaccttgagataatcaattgtcctgaatggaaaatcagtgctatgattggcagccccatacaggcaagcatgtatgttatacctccacgggaatcagtaatgaaagtaatgatgggcatcaaatattatgtagcctgtcttagcatttgtgcctttgcacacaatagagttaatatgaatcattttggtgtagaaattgtgagaacaaggtcactgtgtaaactgacaaagagctttcctctcaagtgacaagttggactaattgcctggggccccatgctgaaactcaacaatataatgaccagcgtgttccttatagtgactgatatggcatctgagatggaggaattcaaaattgagtatttgttcgttatcattttacaaagtagcttaaattaaggattttttaattaaacaacaaaaatctctgttgatacaaatgtttcctggtcccttctagattcttaaaccaaactttttcaatgtagcctcgggccaaatttctttgaactaaaaatcagccaggttcagtggctcatgcctataatcccagcaatctgggaggccgaagtagagggattgcttgagtctaggagttcaagaccagtctgggtaacatagggagaccccgtgtccacacacacacacacacacacacacacacacacacacacacacaaatccgcgtggtggtgtgcaccaataatactagttacttggaaggcggaggcaagaagatgacttaaacccacgacttcaaggctatagtaagctatgatcgcaccatcgcactccagcctgggtgacagagcaagaccctatctcaaacaaacaaacaaagaaaaagacaggataaaagtcacagaaatggtctacacactaggaaaaaatgtgacaattttttcatgaacacagcattgtctcctcttcaaagccctccatgtgccccagctaacatctggtatcaagtcaattacgtggaacaaagtctgcttgcaccatgagaaagctcagcagcatttagtttctacaagccatacgaacaaatagcacatttacaggaatgcaattacaaaaaagctttatctgagttaaacttggaattctcattaaaatttttttaattggttgtttttattacaaatagtacagagttaaaaatgataagatactaggactttggttaacagctctgtaatggagtttataatatttggaaaactgcctgtaaacagaatttctctacatgtgggatttgaagtgcaattgcaatgaaatattgtttgtttttgggacggagtctcgctctattgctcaggctggagtgcagtggcaccacctcagcttactgcaacctctgcctcccagattcaagtgattctcctacctcagcctcccgagtagctgggactacaagcatgcatcaccacgcccggctaatttttgtattttgagtagagatagggtttcgccatgttggccaggatgctctctaaatcctgacctcaagtgatctactcaccttggcctcccaaagtgttgggattatagacatgagccaccacgcccggcccccgttaaattttaaataagaattttgctctaaatctttttacttaatttacatatcttgatgcatttgcttggagagctatattccctaaaagaagtaagatcttcagcagtaatatatcatattgtgacccagaactctttagcttaatgataatgataggattttaaaatttaatgctccattctatgtcattttacaccttaacaataaaaatattattcatatctagaatgcaaacactgatagttgatatttatcgtgaacttattagatgccaagtactagtttaccaattatatgtgttttaaatcttggaacccttacagcaatcctgtgaagtaagtgttatcatcataattattacctgtgttttagagatgaggaaactgaggcatggaaagtttagagggcatgtccaagatcacacgttaagtggcagagccaccgactggactcaggtagtcttattacacatttgagctcatgcctcccataacaacaacaacaaatcaacagaaaataatcagctccaacacacccacagcattgcttagaaaatgggctccctgattcaaatggctttaattgcaaaaggcactatagcaaccacaatgatcctcttggaagagttagttcttctaggatcaacataggcagcaagcctagctgtaaagcagcccacagattaaataaattctatgggaaaaaaaaaaaaaaaacctgagactgataaagttagtccataggtttgaaccatgaaataatccaaagtaagtatgactgatctgaatatggaaatgtactgtgttcagttagcaaaataaaagtggcatattcttctccatgtttatcttaactagctcatatgtatttgatgtatgccagataaaaagaaaacaatgatccagagctatgccctgcctctctcccatacttggctaatggaccagtcatggagtttttatcaagacggggagaaaacctgggacattagattacttagtcgaacaatatttacgaactttgtgacagtgataagagcctgaaactaggccatactgctctttatattttagaaacagcaatgaggtcacttttaaactatgctaaagtttggctactaatgtggtgtggttgcttcattatgctcttaaacagccacaccagccattccttcagcactgtctattgggcactctataaaaatcccaacttttgtttttccagtgatcacaatatattcatgctgaagcaacctcatttcagacatctatccctcttggcaaccaaaacaagataactgacaaggattaaaagccaaaatttatgactaaatagtgtttattgactttgcacaactaactgcaaacttatctcatagagatatactccggacaagcaaataaaattacttgagcaaaagtatctcgaaactacacatagttgtccaggctgtagattattccataataaaatatatgcaaccaagttgtttggtcatatgcctgatgtgtcccaaataagtctggactctggtaatttttaaacttagatgaggaatccctacaaagaaatggacttaagcttggtgcaacccaaggaacttgttctggactgtcaacaccttgaatttgtaggtgaaacatacatcctagttcttgtttactttccaggcataataattaataactcctcattttactctcaaaatgtctttgtttgaatgaattgtagtcatgacacatcagtacccttcaagtctgataacacaaaccttgtgaaatttatagatcttgtactattgtgttattgtcttttagggccataagttagatcacatccttcaagtgggtaaggctttgtctgaaaagaatgatggtctcattgccaatcaatgaaaaggatgagccttgagataaaacatggtgacacaggaggtgggcctcagtccagggtgatggaggagaaaagcgctcagcctaggactgggatttcaggtggcctcagacactgaagttctgagaagtccttgtgagggaaagtggaccgtcccagctgaaatcccagtcctaggctgagtacttttctcctccatcgccctggcctgaggcccacctcctgtgtcaccatgttttatctcgggactcatccttttcattgattggcaatgagaccatcattcttttcagacaaagccttacccacttgaaggatgtgatctaacttatggccctaagacaataacacaatagtacaatttctatgacagtccagaacaagttgcctgggaaacatggaaaacagtgcagagctggatcctgccatccaaggccagagtggcaacacaggagtggcccacagggagaggcagtgtggtgaggtgtcagtccatccaatgcctcagccaccgaggaggccctcagtgtcctgaacaggctcatccttttcattgattggcaatgagaccatcattcttttcagacaaagccttacccacttgaaggatgtgatctaacttatggccctaagacaataacacaatagtacaatttctatgacagtccagaacaagttgcctgggaaacatggaaaacagtgcagagctggatcctgccatccaaggccagagtggcaacacaggagtggcccacagggagaggcagtgtggtgaggtgtcagtccatccaatgcctcagccaccgaggaggccctcagtgtcctgaacaggacagaggagaggacaccaggtacttcctcctgaacagaaggagctgggcaaattaaagggtgctcatttctagcaataaatgtgccattaagtgaagcaaagttattgtgcaacatgggagttgttcacaaattgttagcagcttacataactgatcacaactggtattgttttcatacagtaaaaccgtgttttagtgtttcagttcttactttataattgctttgggatctatgatcaaatgtaaaagctatgagttttctgagtactgtgtactttttatttatcactatgcacattttaaagcaaaagtggtttgtattgcctaatatgtaaaattccctttgatggtcttgctacaagttccatgtaaacaatgtattccaacatccctgtggtcttttttgaaggcagagatggttgcccttgtcaagatagtataatccctgtgatcaacagatctgagtgtgaatcttgggtcttccacattggagctcggaagagtttgaaagctcataactcatctgagtctcagttttctcatctatgaaatagaaaataccactagccaggcgtggtagcacgtgcctgtaatcccagttaatcgggaggctgaggcacaaaaatcactcgaacccaggaggcagaggttacagtgaggcaaaatcatgctactgcactccagcctgggtggtagagtgagaccctatctcaagaaagaaaaaaaaaatagagaaatggaaaataacatatatcttgcaggattagtataatgattaatgataaaatatgtaaaatgcttagcaaaagagattagctaatgataatattattattaatccaaagaatgtgtccccattcatcgcctcatatgtcctatgagcaatgctccacggatgactgctgtggagggggggatggcatggaagagataatgctagttaaggatggaaggagagggacttagaataggctcttaattcctagaatcagagggcactgggcagaggagtgagaaaatcaaagagtagtcagttatgtgaagaaacgaggaaagaccaagatgtttctatcccaagaagctttcagcagctttcagcagcttgatgctgcaggctggagagctatgggaacaaattcacccactcaacccctcccctgccagcctgctacaaaccaagccagggcaggaacggcatgccttccaggggtgcctgatataccagatattttcattgtcatgtaattgttttgcatgaaacacagtggattgaaaatatcacataaatgtcattacgtacaagccttcgtgtaacatcaagtttatggtggcagctttaggtcaaactcttcaagacccccccccccccttacagcagtaagtcatccgtgtttggtgctttggtggaaaatggtgacagagtagtaagatttggagaatcttattagttgtgtggccttgggcaagccctccatctgtgctcatttataatggggataataatggggtctttgaaaagttgttcaaaaaagttgtaaaagttaaaacttgtactagacataaataaaatgactacccaatacagtatctggtatatagcagatactcaataatgttaactaattttgctattatatttaaccaaaacagactcagtgctttctgtgtactaggcacaatgtttgatgttggatcatttcagatgcaaaagaaatgtgtgcctaagccacccagggattttcatatttttctccccaacttttacttcaaaaagaaacaaagtgtatcattccattattttagagataaaaggctgaaaactacctgtaaaaggtaacagactgctatgaaggaagtccagtgtgcatgtgatttatcattacctatgctgataaggggagtgagaaaataggaaaatccaaggtatttaaagaaagacagctgatacctctaaatagggataaagtagcagaacctgaacttaataaaacctcaagatgaatatgaaagaggtcacaattttttgaggagactccctgaccctttagcagaaactctgcccccagtactcaatctataaactgggttatgagaaaattcaagaatagaaactgacaacatgccttgttgtattgtcgtattacttcggcaaaaagtgatagaaactaaactcaaacccaaattaacctaagcatactaagaatgtattgtgttaccaaatccaaggatgaattaaatgaccaaaaaaagaaaagtggggttataggaagagcagacagctgcatcctcacaacagaaaccagaggcattaatgccaccaaaattttctttcccattcttaactcaccaccaacatttgacagtaaacatggctaccaatagtttttcagaaaatatattgtagggcttcctctactagaaatagacctactctctttatcagcactagtttcagaaatcccaggggaggattctagttggcttggtttggacagggagtctattcctggcccaatcaactttggtcacccaggaaaatggacgtgttgaatgaaggcagtgactgtttcagagacacgaaacagaactggttgtacacccagtagatgttcagtggagccatgagttcaagagccatttctatctgggccttttctatgagggtcagttactgctacgttaaacaagacagttttctctttcatgtagctttctagtgatacttatcagtacaaaaacaagaaacagtttatgaacgaatgcagcaatttagaagagtttttaaaacagatttcaagacgagaaaatgcatttgtggaaaatgtacttactttttctcaaagaataacagcattttgctggacaaaaggaacctgaaaatcatgaggagttatactattgtaatttcagaagtttctctagctagataactgctagggttatttctccaatacataattgtgatgcatttggaaaacatattaagctcaattacataggatttttctttaagtataggtatgagttaacactatttagttatttggatgctgaatcataatgtaccgaaagaaaaaaagaggcagctttctctgacttactgcataaatttatgcatctaccactagagggcacaaataaggctgttttctgggaaaaggttttgaaaatgacaaaattccatattttggaacggtgactgagttaagatatgtagatatgcatgttttctttaaatctgagaagaaaaatcaaaacatactcatacttcaccgtgtaccattttgttctcttccctctttctctcaaaaataaagtacacatgcatgagggaaataagaaatatcaatggttcataagattttagacacaaataataaaaattaaatggctaccaagaaatagactagcacataaaaatactgctacagcaacatggcaaaatgccacaaattagcaaaagtattcatatttgtctacaccacacttacaatctttggagtgattttctcctaaatcatcaagcacaatacagttcacaaaactgatcccaaatcttgcaaatattagatatatattgcatcttttcttaacaaatgtagcactgtggtaaaaataggatatgatttggttgcattttcacacaatactgtgcttgagtcatgctcgcagaatacctccatctgcaacagctgttttactccttaaaaaaaaaaatggaaaaggaaaaaacccaacttctccagaataagcaaacagtccctaatcttgtcaccctggatgtctgacaagtactaataactatgactaggttttgataacttccttgatttgttttcagggttattattattttgctggaaaagggccttgtgagagccaatgattgtattggaaataaagccaaaacaaagttcaaagcttgctgagatgcctctaaggtagaaagggtagcaaggtgaatggcatgatgaggaaagtgaaaatgctgtcgcaaattggataaaagtgatgagttggtagcttccatacctttcacaccttgatgtttcccatcactaattcacagtagcatcaagaatgtatcaaaatgtagcttgtcttcactttattaaaatttctctaaaacacaaattttgaatgttataaacaaggagttaatagatgttcattcaatcactcagcttagtcccttccaatgtttcctttaaaaacaacatacgcttttattctctttttaaaaaatgctctactaaaatctacacaccttctgcaccttctataaacattttgctctagtccaatcctgtttcctttcctgcttcaggttttgtcattttcctcctgatgccaacttgagattccaccatggtttatccccatacatggctgaatccacagaaaatggcaattatgacacagatacccacttatcctcccagtgatggtcatgcatgtagcaataagaatcctttttaagaaacagcacgtctcaatctgagccagagggtagagtttcctctacaaaatactttcaaatgctttgtcctctagaatttcttgattattaatggttttcacaagtatggggggttaggtgggccacaaactgcttccaggtggcaaaataactattaacccttctactcagatttaaaaaaaaatgtgtgtgtgtttatgcatgctatgtgcttatgtaatatattaaatgcaaatatgtattagtacatataaaacttcctaattaacaccaacaaagccttcaagagtaaaactgaggggtatggtgaacattttgaaactaattatgaccctctactaaaatattgccaattcattctccctgaggggaaaaaaatacacacttgtttttcgtcttgtgcattaatagtctaagaaattgacctattgagtagaaatcaaaggaagtttatatctgcccagtaatttctggatttgagaatcagttattcaagctttaacccatgtttctactgacttgatagagtcaaattgacttcaaaattaatttaaccccgaagacactatgtttcagacctctatctaaaatacatatataaagaaatacacaaattaaaaccgttgcttccttttggtggagtggatcttccagagcctgggggatgtttgtacctcctctctcttggctgtcacaccttgagcatttgagtttacagattccatagaatcacttaggtcctctaagttaccaatattattatacagtttcctacaaagtagaagtggtccagattatcatgagaaatgccctcaaattttaaagccaaaatatgacacagcacgcatattattttacttattttagagacagggtttctctctgttgccccggctggaatgcagtggtgcaattatagctcactatagccttaacctcctgggctccagtggtcctcccacctcagcctactgagtagctggaaatacaagtgcacaccactgtacctggctaatatatatctatggcatgagctactgtatctggcccgccatgcatagtaagattaaaaaatttttaaaaatccacaccaagcatatgttacaacctaatctctgaacagttctactgcttccatcttctccatgattttccttcaaaaacttttgattagatcaggatttttacactgaactgcttatccaaaagaaataaatggaagtacataaaaatgattacagtaaaatcaatgatttactttataaatagctatcatatatacatttacatcaaatttatattaaatgtattatagtatatgatagctatttataaagtaaattattgatttaatataagtgtgttatatatgatagttatatataaataaaagagaatagagtccatatttacacaaaactttgaaataattatagtccttctgtcattctcctagcttatttatgtagtacatctgagttgtagagaattggaaaaatcatgaatcattcaaataattgtgaatggtaattgaacagttttccttgcaatattcttgaattgcattgatcccagagtccaagagaagactgacaggagcttgatgccatgcaacacaaagcttaagtcatcaaaagtacatgtatttcaaataattttcatctaaaagaacatcacataaacacaaatgcaacagattctaaaactatgatctaaatcagaaaaggtaaatcattttaaaaatgaatacgtttctatttatctgcccacttatatatttatttttaagcaaaatgaatatataaagactaccaggtaattcttccgtaatatttgaaaaataaatccctaaataaacatccctggattttgttatgctatctgactaatgtgatgggtgatttgggttgccaacagttattattttctttcttcaattttaacagaacctcgatgttgttcaaagtattgtgggtaggcatatgaatcctccatttggaggaggttgagccctccttagcacttctatgtgatttctaattaagttatgacaatcatggcaattgggtttttttggcaatgattgatttagaaatcggcatgagactcaattctagccaatgaactatataagttctactagaaaaggagggtgttttgggcattgttgggtgacgtctggatctgctaaagctgtcttgcacccatagggctgaagccaacatacccatggtggcagagtggtaagatggaaaaaacagaacctagatgaatgtcattatgctgctgaattaaccaacactagaatttcccttcctccaggcttttaatttatatttaagaacattttagctgggttttctggtttctcgtactgacttatgttaaatcatataatccatgcctattttaaatatgcactttccttcagtgtaccagttacacctgttaatgatagtctttatattgcaaaatcactgtagttgttatgctgcatagcaatagcaaaagtgatatatatgccttttccccaacagctatgttaggcccccaaaccaccttaggaaatatcagtagattaataaaattaaccagtgcattggttatctttatgcatttagcacagaaatcctcctacagggagagagagtatttagagaagtatataaacattattttatttgagtgcaagagatatgaaatccatttactatgaaagaaacaaaccagactacatccttgcaaaatcattcctatttatttttcaatagcattctacttaagctccaaagattgtgcattaggagaaaacagtgagtatatcagagaagagcagatccaacctattagcactctgataagcaaagcaaattactgaggacaattacccaggaacttttatattctgcaagccttgttcttgtgattcataaaactcttcctggttgcttgtacaaagtcacttcacaatgactatcagtgtcagttggggaaaaaaagttttgttctattttacccttctcagtgtaacatgtaatttacacgcagtacatgttaccttagattgatgctagtggctcttggtaggaccttgaagaagtcactagctgatgaaggtcagtgttgattttggtggctgacaaattattttgtgggatgagcaacaaagtcacattcattttaaggtaagcattagtatagcatgacaatgtcattagctcatgggtttacagaaataaaagtggcccctttttatgtttgacatgtgcaagagaacttaaatacagcaatatgtcattactttcctaattcgttcaaccaatacttttgaagctgcctttataacaatattacagagtaataaataccgtagctagaagacactcttttccatggtctttgtaagtgggaaaatggaagcccaatgagataaagaaatttacactagtacaggtatttagtgtcagcaacagaactcaattctgaatctcttaacatctaggccaccactctttcaactacatcatgatacttagataatataaaaatcctccaaaaaactgcctgtgtttaattaaaccaagaaaaagcatgagtttcaaacgataaaaatatacattttttccaaccagccctggtaatcagacacattcatgaagaccactaatgagaacgaattgtatgaaacacagggaagacatcacataaaataacagggcccatgagggaaaagaataaagtctgaagtgctgatagaaacttagtgatcaatccttggttccattttagcttctgccagtggctggcagcctatattatgacatcaaaagagttatcagtgatgctcattgatggaagctcttttaataaataaatagcatccactagtagccccacagaatatattatggtacaatttagtggttataaagtattttgttgaattattttaggccacccttggaaaaatatttattgaaaatatttatagaaagaaccttacttgtgtctagtcaagaccctttgctagcagatggggaaagtgagaatcagactgaagtgactgacccagggagcctggaagcaattgataggattcaaattctggttttctgaactctttgtccaaattgattctgtcctgaatttgaccaggtaagattcatgggcttgttacgaaggcagtccaggccttctgaatatgcaggtgtatgtgttcatagtgcaggccatttattcagcatttccatatgcctgacactggtggagaatgcaatgcacagatgaataaagcatgcctactttccaagagcttatgtgacacaaggaaggcagacaaacatatttcattgtcatgtgttaaatattgtgacagtgcagagatacaaaagattactaaaaggacaacttttaaaagccatctctcttgtacatgtcaaaaatgtcatcaaaatgccactttctggtactacctatttagacctttgaaatgcaaatatttcagcacagaagcccagagtccttggggaggaggtggatggtctgcctgcttcactaaaaggggagtggtagaaaaggggctgaaaggactaaaaaagctgaacttgagttaatttaccttcctgtcagtgatctcaagtttgtctcataggaaggttttgcatgccaaaaatggttcttttgtttaatctcaatagggaaaaactgtgcaggttttagtttattctgtatgccaggccatgcatttagagaacttcttatgcacacacacataagtaataattactcttcaaaatttggcaaatgtccaaaatgtagcaatttcccatacctggaaggtatgtaattttttagcaaaatctttttttaataaatctgaattaaaatgttttgccaagcatagagcctccaaggctataagagataatgtgtcaacggtccctgcatcgaaaatgaaagtttcatcctacatgagaagctcatttatcttctgtgcagttactctctaaaatcttatcttatatttaaattcaatgtaacttggggggaaaaaaagtcattttgaaactccaaactaagaaactgattgagcactcagaattattttttgcagaaataattataaaatcactttaattgttgtattgattatatacaagaatttttgagcctgattttttaaaatgatactttcttactatatattttaattgtcttataatttggttcaatattgcccttttaaaaaatgaaaaaatcatcacatcatatagagtgagggatcaagtttgtgttaggaatagagttttaagccaaagtttcctgaggttcaatttactctgtataaaatacattcgatggccaggcgcagtggctcacacctgtaatgccagcactttgggaggtctagccaggcagattgcctgagctcagtagctcgcgaccagcctgggcaacagggtgaaaccccgtctctaccaaaatacaaaaaattagccatgcatggcggcatgcaactgtagtcccagctactcaggagcttgaacccaggaggtggacgttgcagtgagccgagatcgcaccactgcactccagcctgggcaacagggcgagactcagtctcaaaaaaataattaattaatttaatttaatacattccattatttgaaaaaaatccacactcattggttatctggactggattctaaattgggagatagatggtgagcctctttgtgatcactgaccagcgcgtacctggaatatacaatgtgtgctgcagtgccgcacatgtatacacacaaacacacttttatacatattaggatatgcatacatttgtcagggagacatagaaaactgcaactttttattagtaatagcccacatttatctagtacttactatgtgttaagctatatgctaagtgctttacctgcatgggtcaaaacagaaatatctaaggcagcatgtcattaattaaagtaatatgaataattaaaataatatcattattttaaaataactataattgctttttatatttattaaaataattataaataaatgtttggaacactcattgatataaaatggcctctcttatggcgaattctaagaaacactaggttctttgactgcaaacaggtgttacttaaaaaaagaaaggttaagtaagtttaaggaaggataagataaaataagtcaacaggcttctgtaccatagcacttcttaaagcctttattatacaactacacacagtactgtgagagagagacagagactgaagaccctgacatcacactcatgcaaggacacacgacatcttagagcccatctccgacctgatatacacagagtacaccttggaaaacattaatacaaagactcaaagtgcaacctcatggaagagtcaggtaggtggaaaatgctcataaaggagattagatgtgacatttgtttgaaaggagactttccacttgactgattggtggggaggggaagctgaagttggggggagtaatagggacaaaggcacagagcccagacagggcgacgaagtcgagggacatcaggcagcaagagcagcccagggcagagctccggaagccttgtaaggggagttaacgaattgggtaatacagggagccctacttggacatgattgttcctttaaaccatctcttctttcctttactagggagaatagacaatcacaggcccctgttctaaagcctctacttagctatgacagcacagtttttattcaagagaagcttgtcaacaaattcgaagacaaaaatcattatatatttatatatatgtattagaaccatgtataggaaccaggatctttagggcatgtcttagaatgtgagttgaggggaaaatgctaccccagttgaagcggagtaagacagtggaaagagcattgatcagggaactgagaaatttttctggtctcagttccaccagctccatgactgcagtcaagtcccttagcatctttgaatctcgacctcagagattatcagtaaaggcagagatgtggctggacgatctaaaatctatgaagccctaaatgtctacattctctagagtggtttctgtgtatttgtgtttttaggttttttttttttcttaaataacagaagtaaacattgtgacatagagtggggatgataatatcaacctgacagagctgatataagagtttaatataaaagactaacaacataaatgtaaattgttacattatttctctaaggcatggccacttttgcaatgggttcttcatgtgcccaccattctcacttacgttattccaagtcacacctctcactccatgctttgtggtcgttatttgtcctatgattcccgattctatttgcctcctttaaacatgacaagccaaggagtaaaaagataaggaagataaggaccaaagggtgaaggcagaggtttttctcatttgagcatcagcctgctcatctcattctcacactcttgcctggaattcctcaaaacatctttctcttggtgtagaccagtggttctcaaatgcaggtgattttgcctgccagggaatatttggcaatctggagacatttttggttgtcagctaagggtctaggaggtctactggtatgttgtagatagagatctgggtgctgccaatcaccttgcaaagcataggacagcccctacaattaatcatctagccccaaatatcagcagagctgaggctgagaaactggcccaactgaagtagggagtttagcaaagaaaagtatgtgttgggaatgcaaagaaaatggatacactagcagtagataatggggttatgaagattacgcttttttaaagcacttttgcattttaacagttttcaatgaacttaggttacttttaatttttccccagctatctggtggagcagaggaagaaatgctattggaaaacttcattgtgtttgaggttttattatagtacaaagccaagagacaggtcagcagggggctaacttattttaagttcttttattcttttataccataatgaggtatatgccatggagaaattgctaaatcctaatggaagtagcagctgtgtgccatgttgattatgtgatgctgggggtatccagcgtaccccaagtaagacccaaagtacccaaagtaagtgatgcctgttttttctcacctatcctggtaggcttccatcatcttcttacgccttattttaaaagccccctactcccaaaacgagagtacttaacatctatactaatgtcaaatcgtatgctgaggatgagataccttcagttcctttttgtttgtttgttttttgagacagagtttcactcttgttgtccagctggagtgcaatggtgggatcttggctcaatgcaacctcctcctcctgggttcaagtgattgtcctgccttagcctccagagtagctgggattacaggcacctgccaccatgcccggctaattttttgtgtgtttttagtagagacgggatttcaccatgtgggcaaggctggtctcgaactgctgagctcaggtgatccacctcagcctcccaacgtactaggattacaggcatgagccaccatacccgacctccatttttaccttcaagtaaacagtccatgtaaaataatgactcacattagtagataatacttacataatatttatatttatgtaactctatagcttgtaataacctagtatttcataaatgttagctcaattattccccacaacaagattacaatgcattattagcccattttactgctgaggagatttccaggaagttgatgttcacaaggctcacagggtgttcaagcccctgactgccaagtggtggcttttcattctacccaatacgaagcacggatatttatggtatttcatcacaccccacactcaggaacacaaatactggttttctatacctgaaagtgaaaatggtggttttctttatcaaggctaattttttgctactgatgacaacctctcatcatgatttcattagaaatttaagacttggtaaagctcctaaacatcaaagcaaaggcttcactggtcatgttagtttgctagggttcccataacaaagtaccacagattgggttgcttaaagagcagaaattactttctcacaaatgagaagttagagtccaagatcaaggttgaggtcttctgaagcttccctccttggtttgtagacaccattttctccctgggtcttcacatggtcttccctctgtgtgtgtctgtgtcatgatctcttctcataaggatacaagtcagattggattaaagcctacgctggtgacctaattttgacttaatacctatctccgaatacagttgcattttggagtatagggagtgaggacttcaacctatgaattttagggggacgcaattcatcccacaatactggtgtcagggaatttgctagagctcagatctgggatccataagtaactgaaaccacaatgcccaaacagaaagatctttttggagttatgccatgttccgctttacctataatttttacatgttaaaaaatatatctaaacactgcattttattcttagagcttacctttgtgcagtgatgtggaagatgtattgacatgttaatgaactaatgtttcaagttctgctgaacatttaattttaaaagatgtgagggggccgtttaagaggtctgtttttggctgcttgggaaaccactttttgactttctatgtgacttcattctccctcctacaccgtggcaggcccaggtccttgctagcatcaggctgtgcacagcttgggtggagctgctgggagctgcaaggctgctgctctcctcctttccaggtgcattaacctgaattcgcctatagagtgaagcgattaaccgaattcaaaattatctcaaataggacagagcttttgtagacatacctgacatttttatatttcaagggaggctggaggagaaagaacatcatagacaacagaactaactgccaagattagctgctgctctgttgttctgttgagagagaaagaaaaagaactagaatttttatatgtagatgcccctgatacgcatacatatttttctctgaaataaagatgatggcaattgatctagagaataacagcatgtatagaaatagaaagaacttgattcttggctcatgaagtctggcttatatcagcaaatctggtatttgcttcttgcacgcccttgagcaaattgctcccctctgagatttattttccatatgcaataggatgggcatcatctcagtgaagcctatttattttacagttttatatggatcaaatgagatacagtacatgaaatgtaagtaaacaattaccattttgagaattttgtttattttatttttattgaggtaaaaaatgtatacaatttaccctatttatcatttttaaatgtacagttcagtagtagcaagtgcattatattatttttcttcttcagttctccctccctccttgccttcccagcctctggtaaccaccattctactctcagagttagcaatgtatttctattctctctagttggaaatccatctaatctcagagaatgagagagaaggacgaatcacaagtaatcacagatgcaatgaaaataatatttaataacctcttactacacctgggcagtatattaagcaatttataaaggtggtcttatctaattctcacaaaatcctttgagataggcattgttcttctctctattgtagcttcaaggaaatcaatatttaaagaggttaagagtcaaaggcagactttgtctctgggttatccaacttcagtatctctgagtttagctcgtattctatatggtatccacgagaataacaacaatgtaaatatagttaaatctttgaactcccaatctagcaaggcaggccaacattcaaattcaggaaatacagagaatgccacaaagatactccccgagaagagcaactccaagacacataattgtcagattcaccaaagttgaaatgaaggaaaaaatgttaaaagcagccagagagaaaagttgggttacccacaaagggaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttacagacaagtaaatgctgagagattttgtcaccaccaggcctgccctaaaagagctcctgaaggaagtactaaacatggaaaggaacaaccggtaccagccactgcaaaaacatgccaaattgtaaagatcatcgaggctaggaagaaactgcatcaactaacgagcaaaataaccagctaacatcataatgacaggatcaaattcacacataacaatattaaccttaaacgtaaatgggctaaatgctccaattaaaagacacagactggcaaattggataaagagtcaagacccatcagtgtactgtattcaggaaatccatctcacatgcagacacgcataggctcaaaataaagggatggagaaagatctaccaagcaaatggaaaaaaaaaaggcaggggttgcaatcctagtctctgataaaacagactttaaaccaacaaagatcaaaagagacaaagaaggccattacataatggtaaaaggatcaattcaacaagaagagctaactatcctaaatatatatgcaccaaatacaggagcatacagattcataaagccagtccttagagacctataaagagacttagactcccacacaataataatgggagactttaacaccccactgtcaacattagacagatcaatgagacagaaagttaacaaggatatccaggaattgaactcagctctgcaccaagcagacctaatagacaactacagtactctccatcccaaatcaacagaatatacattcttttcagcaccacactacacctattccaaaattgaccacataggtggaagtaaagcactcctcagcaaatgtcaaaggatagaaattataacaaactgtctctcagaccacagtgcaatcaaactagaactcaggattaagaaactcactcagaaccactcaattacatggaaactgaacaacctgctctgaatgactactgggtacataacgaaatgaaggcagaaataaagatgttctttgaaaccaatgagaacaaagacacaacataccagaatctctgggacacattcaaaggagtgtgtagagggaaatttatagcactaaatgcccacaagagaaagcaggaaagatctaaaattgacaccctaacatcacaattaaaagaactagaaaagcaagagcaaacacattcaaaagctagcagaaggcaagaaataactaagatcagagcagaactgaaggagatagagacagaaaaacccttcaaaaaatcaatgaatccaggagctggtttttttaaaagatcaacaaaattgatagaccactagtaagactaatgaagaaaagagagaagaatcaaatagatgcaataaaaaatgataaaggggatatcaccaccgatcccacagaaatacaaactaccatcagagaatactataaacacctctacacaaataaactagaaaatctagaagaaatggatacattcctcgacacatacactctcccaagactaaaccaggaagaagttgaatctctgaatagaccaataataggctctgaaattgaggtaataattaatagcttaccaatcaaaaagagtccaggaccagatggattcacagctgaattctaccagaggtacaaggaggagctggtaccattctttctgaaactattccaatcaacagaaaaagagggaatcctccctaactcattttatgaggccagcatcatcctgataccaaagccgggcagagacacaacaaaaaaaagagaattttagaccaatatccctgatgaacatcaatgcaaaaatcctcaataaaatactggcaaaccgaatccagcagcacatcaaaaagcttatccaccatgatcaagtgggcttcatccctgggatgcaaggctggttcaacacacaaaaatcaataaatgtaatccagcatataaacagaaccaatgacaaaaaccacatgattatctcaacagatgcagaaaaagcctttgacaaaattcaacagcccttcatgctaaaaactctcaataaattaggtattgatgggacatatctcaaaatcataagagctatttatgacaaacccacagccaatatcatactgaatgaacaaaaactggaagcattccctttgaaaactggcacaagacagggaggccctctctcaccactcctattcaacatagtgttggaagttctggccagggcaattaggcaggagaaggaaataaatggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtgcaaaaatcacaagcattcttatacaccaataacagaaaaatagccaaatcatgagtgaactcccattcacaactgcttcaaagagaataaaatacttaggaatccaacttacaagggatgtgaaggacctcttcaaggagaactacaaaccactgctgaatgaaataaaagatgacacaaacaaatggaagaacattccatgctcatgggtaggaagaatcaatatgacgaaaatggccatactgcccaaggtcatttacagattcaatgccatccccatcaagctaccaatgactttcttcacagaattggaaaaaactactttaaagttcatatggaaccaaaaaagagcccacatttccaagtcaatcctaagccaaaagaacaaagctggaggcatcatgctacctgacttcaaactatactacaacgctacagtaaccaaagcagcatggtactggtaccaaaacagagatatagaccaatggaacagaacagaggcctcagaaataatgccacatatttacaactatctgatctttgacaaacctgacaaaaacaagaaatggggagagaattccctatttaataaatggtgctgggaaaactggctagccatatgtagaaagctgaaactggatctcttccttacaccttatacaaaaattaattcaagatgtattaaagacttaaatgttagatctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaaaaattaaactaaagagcttctgttcagagtgaataggcaacctacagaaagggagaaagtttttgcaatctactcatctgacaaagggctaatatccagaatctacaaagaactcaaacaaatttacaagaaaagaacaaacaaccccatcaaaaagtgggagaagatatgaacagacacttctccaaagaagacatttatgcagccaaaagacacatgaaaaaatgctcatcatcactggccatcagaaaaatgcaaatcaaaaccataatgagataccatctcacaccagttagaatggcaatcattaaaaagtcaggaaaaagcaggtgctggagaggatgtggagaaataggaatacttttacactgttggtgggactgtaaactagttcaaccattgtggaagtcagtgtggcgattcctcagggatctagaactagaaatgccatttgacccagcaatcccttactgggtatatacccaaaggattataaatcatgctgctgtaaagacacatgcacacgtatgtttattgcggcactattcacaatagcaaagacttggaaccaacccaaatgtccaacaatcatagactggattaagaaaatgtggcacatgtacaccatggaatactatgcagccataaaaaatgatgagttcacgtcctttgcagggacatggatgaagctggaaaccatcattctcagcaaactatcacaaggacaaaaaaccaaacaccatatgttctcactcataggtgggaattgaacaatgagaacacatggacacaggaaggggaacatcacacactggggcctgttgtggggtgggggtagcgggggggggatacattaggagatatacctaatgttaaatgatgagttaatgggtgcagcacaccaacgtggcacatgtatacatacgtaacagacctgcacattgtgcacatgtaccctaaaacttaaagtataataaaaaaaaaaatctttgaactgatccaatggcttcattttgaaaattctaaaattagatctggagatctacaaactggtttataatttttgcactgtgaaatcagagggaatagaccaggaaactactataaattatataacaggaatcacaattgtactattatttgccactattaacaacattcggccaggtgcagtggctcatgcctgtaatctcagcactttgggaggccgaggcaggtggaccacttgaggtcaggagttcgagaccagcctgaccaacatggtgaaacaccgtctctactaaaaatacaaaaattagcctggttatggtggcatgcacctgtaatcccagctactcgggaggccgaggcaggagaatcacttgaacccaggggatggaggttgcagagagccaagatcatgccattgcactccagcatgggtaagagagccagactctgtctcaaaaaaaaaaaaaaaaaagaaaagaaaagaaaattcaaggggttcaccttctgtttttacatgaacatatgaaaaactagctgtaatagaatatggcaaatgtaatcattagtgatatgaacaaatgattataaaggaaaaaggaaggcattaatttaacctgctgccacccagcaaagcttcatagcattgacattttagttgggcctcaaagatgaatcggttttctccaaatggggagatgggatagcaaacacggcatcagtacagagtacaaaagtggaagacagatgatagaattcctcattaattgtagcttacatagttcccaaaggaaaatgccaactcttctccactgttattaaatgggctttcagaaaaccacacctccagtgtggcttttcgaagacatctcaacaagaaagtcggaggcagagctcatcgtgcactcttctgttgtcccacctatcaaactgtagcataattgtgtgcttattgccttatgagatcctatcttatttatttttgtatgccaagcatcctgcatggtacctgacccacagtagaatttaacatgcatttgattaagtgccaaattacaacatacagttagtattggctgaatttctagtgatgctttatttcctctttcaaattttctctgtaagaaatcttacaatttaaagttatctgggtcagatactaagaaaattagcatttgtaaccagtgtatttaagtatctcatctcagtgaggtatgccactgaaaaatagttttattttttccaatcagcactcctaaatatgctatgtcaaatccttttttcctgctgggtagaatatttcattgtgaaaacttagtataggtccatttacagcttcagtctcatctcttattcaaggctgtctcctctctgcacggaatgctctgccctggcacaccttcctccatctcactctcctaggctccaatatggggggctctaagaagggaaggaaataagggtacgtttttggttctttccttgttgttccttgaaggtaatcaaagacagcacatgatgtggaagaccctggtgcctccctagcatcctccacgcttcctcagattctgcctcctgtggcccatccaactgtttctggatgctggtctcttcccccagggacaaccccctagatactgtcatagtaggatggctcaagcccagctatgttctacatcatccagtccaccccccagaaacagcagcctcatcaaaccacctgtggcaggaaagggctgctacgtccactactgtgtcttctctaagcctgatcttctcacacacccggctctctgccccgacccttcgtctcagagaaacttaggaacacatgagcaaatcttagccttatctgatgtccaactaaaaaacaagatataatttccccctcttggcagatatcgtatgcctgacaatagcttctcttggaacaccactcagtcggctttgggaagataaaaacatgttccacagaaaacagagggactgccctttcacaaaaaatgctagaatatcctcaagatcagcaaaccaaaagtccctagaataggataaaggagaattccagagatagtagggcttggagaagaagactgaatgctcacggttggccacatctatttttggtggcaaaaaaaaacagtgcttataaagtggtaaaacaatgaatgaagctcctcatccaacttttccattcagtttcagctcaaaatgtagtgttgaattacaactcaacggaagaactcacaactgaacctcagcacttcagttagtcttcaaagccacttcaagtcatgcgtgcatttctgcttagaggatattaaaagtcatattgatagttcaaatcaatatggaaaaaatagagaggaaaataaacaaagtattcctaagagagagaaagaaacaatggaggaaggcagaatgtaaaggaaaactgtttctcataaaatttacatggatcattaatgtgaaaatatctacaatgtatcaggtactaagtaaacatcttgaagagatgaatgcataagtacaacaaaaaataaattaaggagaaagaaagagaggaaaaaaggaagagcggttgtcagaatttcaggtccatgttctgtggaagattttcctccctctaaacaatgaattattatcattctcaagggaaaaataatcctgccgttccagttgccactggagtaactgtggctgtcttgtcaccactgtatccctagtgtctgctggctaaagagatgagaaaacagaaaatatttctttccagagagcaaatgacagcaatcgtcagtcagtgtaagcttgcctttgcaaatgaaggaaaactcttatcttagttgtaaaatatcaatattctctatgcaaccaactttctgtgaagaaagaaagaagaagaagaagaagaagaagaagaagaagaagaagaagaagaagaagaagaagaagaagaagaagaagaagaagaagaagaagaagaagaagaagaagaagaagaagaagaagaagaagaagaagaagaagaagaagaagaagaagaatagaaatgtgtttaagaattcctcaataagactaagctctatgtgggcaggaactgcttaattcatcattgcgttcccaatatagtgcgcctagaagataattaaaaaaaaaaaaaaacctggagaatgagtgaatgacattgctcactatatggacctaaatttaatctctttatcaaggaaaattataactgttttcttttttttatcctaaaggtaagcagtagggtttcaagaaacacctccatgagcctttctgatgtgttaatattactctataacttagaatataaatggaacaacaaaaatctgacacttgggagacattttgtcagttaacaagcttttttaggagttatctcctgttttttaaaagatgctaagaggagggactagaacaagtttctgaaacttgcagctaactgggaggcggttggcactatgcttccaaatgatgctctctcaatggcaactgaagtctcagcaaactcagaatctctcggtcaaaggctgaacaaagcctgctattttaggcatttggtaataaattataagaatggatcacaggaatacatttactgaaaagcaattgaagagaaagcttttagaaaaacagatttttggcaaaagcggccatgagctattctggtctttggtattatgaagcccacagagcaaatttccaaagcaattaatataaatgaacatcacatttaaaaaatcaattcttttatatgagatgcaaaaagatagagactaatatccaggcttacaaataggcactttgcatcattaaaagtatcacaaaggtttgaaccaaaagggcctaaagtatcaagtttataatattactactatcatatgcattactaggcagacgtcctgatcttaaaaatataacacagtttatggaatgcttcaatgtaacaaaagacttcattatgtgttgagagtgaaatttggtttataaatggaataatagagacagtaagctacacaagaagccatagctgtttctctgggcctctccagtgagttgaatgctgtggaaaatgtaccccagccttgtgttgaaatgagctgccaggttttttctattgtatgtgcagtgaagcctttttgggaggatactagaagtctggtagctctttctctggtcactggcagtggttagcagcgtccccctcatttgtatgtaggttagtagcaccgacactaagggagaaaatgaatgatggttctaattcttggagaaacctatctgattggaaaatgcctctaaacaagcatgctgtaaaaatacatccacatatttcatatagagggattcatacgtttcctcaaagatacaatatatttgattttctgttttaaaaagctccagtgcttccaaacatagccagactctcaataatgtaaatacttgtaaacattttctgtccaattccattaataacctgtcatagatgaattatacctgtggtgacaaataaatgcttactgtatagtttagggctatcatagcccttgtgcctttattttgtaaattatcctctagcacagaggtattagaaaccacatgccatgccttgtgtaatatggtctaccggaagaggggttttcctacttctcttccatagaggaaggatttattaagcaccagctgtgacaggcaccatactaagctccagggttataaaggtgaggaaagcagtgttgaggctctgccatcgaggaagtttagagcaagtggaaggaaggccgtgtaaacccatgaatacgatgaacttaagaaatgctctataacaagagttgtgtaccgtgtcttagagaagcaccaactaggattgaaatctctggggggttctcagaggtcactttgatctgggtggatggttatcagggaccagtattcgaggaggtgatctggctggctgcaaaggcaattgaggaacacaaaagtatagggtgtagggtggggaagtgaccaagggagcctggattgggaagattcgcagggaccatgtttaggagtttaggcatttcatacacagaatgggaagtctctgaaggctttagttcaaggtaaagaaataatcagacttgccccccccagaaaacattctggaggccacttaaagtctggaacaaagtgaagcatggaaagatgggttaatgaagccattccagacatgaaaaagaaatagtgaaaacctaacttaaaaatctgattcccgttgtagattatcacgttttaccaaatgtcctcatgtccttcatgcaggaagaccatgtcctttctccctgttgacctcagcagtgaccaggcatattgctttgtccagtgtaatgtcacttacaggtagaagttttcagaggctgataaatcagccaaggtcctggaataacagagctgtagccaagtcacaatgccataggaccacaggacacgagcaagaaataaatctttctctttgtatgttgctgagatttggggatctttctgttcctagccaagcctgacttctaaaatctccaaagcagtgtgcattttatttttcctgttttcttgtggtgaaaagcactgctgacaatcaatgaatacatatttattaggcctctacttgaatattagacactgtgtttactgatgaccagcttttttctcccttagagaccttgcgaccatgccaggaagagatgacattaaacaaacaatatctttgggaattcagaaagcacagaaatttcttctgcctgaatgggatggatcatggatggtttcccacagggtggaatgagaatagagaaaaatgaaacaggcaggcaattaagaccaggatggggaacaagaagagggtaaagtcatagagacaaaggcaagaaaggagaaattcctacataatctttgggacagaatgagctaactattcttaatcggtagttaatgtctgtgctgtccaatagattagctggttcctcagtttgactagtcacggttcaagtgttcaccagctgtgtacagctagctcagtgcagacagagagcatctcatcattgcagaaagttctattggacagtgctggtctaggaaaagatataaaataagaaaatataaagaaccagagagtttttgaatgttgggatattttcttttacttaaaagttcaaaagttaagatgcatagtgacaatatgaaagtaattgaaaagattagtattagcaagaagggagaattaatgagacatggctggagaggagaatagtgaggggatttttcagcaaccaatgagtgacctagatcaaaatggtgatgggaagaatagaaaggaaggaaaaaatgctcatcactggccatcagagaaatgcaaattaaaaccacaatgagataccatctcacaccagttagaatggcaatcattaaaaagtcaggaaaaaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattataaatcatgctgctataaaggcacatgcacacgtatgtttattgcagcactattcacaatagcaaagacgtggaaccaacccaaatgtccaacaattatagactgggttaagaaaatgtggcacatatacaccatggaatactatgcagccataaaaaatgatgagttcatgtcctttgcagggacatggatgaagctggaaaccatcattctcagcaaactatcgcaaggacaaaaaaccaaacaccacgaattctcactcataggtgggaattgaacaatgagaacacgtggacacaggaaggggaacatcacatactggggcctgttgtgggtggggggaggggggagggatagcattaggagatatacctaatgctaaatgacgagttaatgggtgcagcacaccaacatggcacatgtatacgtatgtaacctacacgttgtgcacatgtaccctaaaacttaaagtataataataataataataataataaaagaaagtagattcctggttgccagaggctggaggaaagggaaacaggaggaatgaggatacttataagtatggttttcttttcctttaaaaaaaaaatgtgattacaggtaaaatttttcattttaaccattcttaaatgcacagttctgtgggaataagtacattcactttgttgtccagccatcaccatcgtccatctccagaatgttttcatcttcccaaccagaaactctgcatccattgaacactccctattctcccctccccaagctcctggcaaccaccattccactttctgtctctctagatttgactactctaggtatgtaagtaaaagcatacaacatttaaaaaaaaaaagaaaagaaaaaagaaagaatacagtctattctcataatttgtgaagtttgtatttgcaaatttgccattcactttattttattttatatttagttttattactttacgaaatttataaatttcgtaaagtaatctattaaatagatttattttacaatttatattataaccccaaaatcaatacttgcgggactttctccgtcattaacagacaagtgcagcatagaggaaaatgccagtcgtctagcagatgcgtgcattcccagctgaagtccaacatggcaacgctctgccttcttgtttcagctctcataccgtgcacaagtgtcctttttgagttcatttagtgccatattttttgagtttttggagttggtgatgttgctgtttaaaacggcctccaagcatagtgtttaagcgctttctgccatttctaagtgcaacagagccgtgctgtcccttacagggaaaatacgtgggtttgatatgtttcattcagacatgagttacaatgtcgctggtcatgagttcaatgctaatgaatcaacaataggtactaaaataaggcgtcttccaatagaaacacatattaaacaaggttctgtgttgaggggctgaggaaaatgttgtgaccggagattcacaagaacctagccgtgtatttcctcttgaaacagaggttcagtatttgctaattcactgttttcagtgactttatagaacataactaccatgaatatcaagaattggctgtttggggaagaggtattgcaaacagagataaaacagaagctgggcacgaagaggctaataaagacaaagcgaattggcagggtgcagtggttcacctgtaatcccagcactttgggaggccgaggcaggtggatcacctgaggtcaggagttcgagaccagcctggccaacatggtgaaacccaatctctactaaaaatacaaggctttcacaaactaaaaaatttttgtaaaaatacaaaaatttgctggacatggtggcatgcccctataatcccatctactcaggagtctgaggcaggagaatcgtgtgaaccctgaaggcagaggttgcagtgagccgagattgcaccattgcactccatctcaaaaaaaaaaaaaaaaaaaaaaggaaattgttacctcaggttgcgtctattgagacaacatggtaccaagttccagaccagaattttattttaattaaagcataagatttgctcatagtcactggaaagaagccacctctgcctggattttctggcttgcttactcagactatttccttttaatttaatgaaaatccaagcaatacttttaatagtttacttaaaaaaaacccactgggtataggaagtataggagttctaatttctgtgtctctatgtgaatcattccacctagattaattttcactgttttgctacctgaatagttggcaaataggaagtctgaaaagtaagtaataacactgaacctgttgagtcaagaacagtatacaagtgggattttttagtttctgaaagccttgagatttgaaaaatccattagagaatcctcattaagatattagaaactggcatgctagctctttttttttttttttaagaaatatcgtttgaaagatgctaaacatatttaagggggagtcaattcataagagaaaaatataatgtaacctttaggtgatggatcaataaaaacaaataaagagccaggtatacgcacacacaaacatacacacacacatctctaatttaactttctcgccctctatgtcatggctttttatgtagtcgctgactctcctttagtgaaattatagcttcaaaaacctaaaaccacatatttttgtttttctcacacagaccatgggtgaaacaaatcactgacagccattccttaaaccttcactacttttcattaaacatgaaaatttatgtttgcatagtttgcatagtgctgctgattatggcattaatagaaaccacgtgctttgacagtgtaaacatttcctgaagaatgaagaaaaaggtgcgtatgatggggagggcaggcaaagacgtcagatcctcagcgcctaatcaaattgcactcccacatggctgggacaataggcacacaccaccatccctggctaatttttgtagttttttgtagagatggggtttctccatgttgcccaagctggtcttgaactcctgacctcaggtgatctgcccacctcggcctcccagagtgctgagattacaggcatgagccactgcacctagcctaattcttttcttggtactacattaatacaaagactccactgaccctaaacaatgggttttagagcagggctaccctttgattaatgtggtgttaacactctgtaggaactgaaaaatgctttaagaaatagccttgtataaatccaatgcatgtagcagaataatcactggattccttattttgaacttcttataataaaccataggcacaaatgtcacttcttgaaaatacgctaatattttattgctggggaaatctgacataaaactgatttgggcaggaatgtactaccacatatttatttttctcaggccatgataatgttcttcagaggtggaattcctcctcgaactgttttagtcaacaaacacacactgaagatctgccttgtggcaagcaggatagggagcattgtaaaatactgattcctgagtttaagatattacgataatatcatggagaaaataacatggagaattagagcacagttagatgctaaattatatccagaacagggagacagagaagaaaaaaaaagaacactcacagtttactcttccatcctctgagactagagcactgattctgtcattgatcccagatcctaccttaggatatatgaagctttgtaagattcgtaagctttaggcaactagattacactaaagggcctacacttttaagtcagcaaggctgctctcatttataggctcggcttttcacagcctcacctgtggagccctttggccttacttgtgcttccccacattttcctaatatcttcaatccaaaagctctcgatttccacgcggtttccaattccccactcaccccttccacctaacacctggttatcccccgtggttccctagacacctgtacttggtcaggcagccaatttctttcatgcccctgaggacaggacccagactagaacctcagacaaagttttgtgtgtttctgaaccatgtgtaaaagaaataagaaactccagatgagaagtgatcaaaggagaggtaatcattattataattccctaagacattcaagaaaggaaaagtaatacaacaaaagccactctgcaaggaaaaacaaataattcaattatttaaagttacagaaccatatttgcaaatttacaggactgtatgaagatgcgcacatgttaaagaagtggggttttttttgtttcctgttaactgatctaaatctgcttaaaacctccactcaaaagcaatttaattggataacctttattccaattattgaaagttctttcaggaattcagtctccacgtggaagttgctgaccagtaggcttggcaatgatgggcaagttctatagctacaccacccagtccagcagccactgggcacatgtaactattgagcacttgaaatgtggctactgagactgaagggctgaagtttttttcagttttatgttaactgatttaaatttcaatttaaatagccacatttggctagtggctgtggaattgaaacccataactataaatgacagatgctcctatgagtttgtggcagaaacagtgaggaagacaggaaaggggcaaagtccttgtcttcattcatcttatcatagtggctgggttggaggtaaggcctggctttccatcccttctttggggcttacagtcttccagcgtggggcatacaggaaaactctgagatgtggctggctcctggtatgttaaaagaggaggtaagggtatttagatactaatcgttttctgtttcaatagatcctagctttcaagtctattaatctccatgagggcacaaaaatcctattataggaaatatcaactctcctttttgcctcttcttctccctgtcctcctcctcctttttcctcttcttgcacttcttcctcctcttcgtccttctccttctttaatagcaaggctattacttctgccctacacccaagcagatggctgacctggtctaacttagagagaaagtcatttacagacgaatgcaacagaagcacagcgtgacatttctaagtgcatctcccatcacagaagcacgcattttacaatcagttcagtgctgcagtttggtgaaaggccgacaatgaccaaggacacaaggcagcttttgtgctcataaaactataggtgggccgagatgtccctcagcaatgttttgttttaacaacattgaaaaacatgaaaaaacaaaacaaaaaacctccaatgacatttcagctacccagcactatattcttccaaaccatggaaaccaaaggtaaacccttttcatggcagaaggtagggactgtttttcttctatgttcttaatagtgaatttatacctgcatctaataatatatttttcagttctaacttctgggttattttcatctacattttcaaccacttctggtgcaaaatggttcatgtcaatatctcacaaagcatagtgagttacaaaaaacaatgtaaagcattgctttaaaatctttaacaatgaaagcttaaaaatgaaaacaggaatttaaagaagtgattgactttgttaaagttattttagcaaaaatgaaactataggataatatcaatttaaaccgtcctgtaaaaaaagtcaaaaactggagatataaacatataatatttgaggcaatatagacacaaccatgttaaaaaatacttgcacaaagatttaacgtattgatcgatcccgcatttttagaccagtgtttatcatgtgctgtttctatgtcagtcctaaacaaggagtccactgtcagctgtgagaaagacacttacaacttcccaagaacagtaatgagttggtcaacaaatgattgcatgaggaagcattcaggaaatagatttcataataatgtcttcaaaaaatcctgatgcttacatgcttaccatcattagaaatgacaaatgataatgtagcttttaagattagattcttcatctaggtataaaaggaagtctctccctttgggttaatttttttcttatttgggaaatccttcaggaagagacaaaaagcctatctttcttttttagcaaatgaataaatagaagaaaataaaacaacaagacttaatgtctttctcacttaaatcttctggaaaaattattctttgtgtgaaaaataagtaaaatcattgcaagcaacaagttgtttatcaaatgacagtgcattctttttttctgaaaataattatttgttctttaattgaaaaatggtaaagatttatgttgtcagtcagtaaaacatttttaatgccagtatttttatgagagctgttatcctcttaagaaacactacaagataccaagatacactcatgagttggacattgcccaccttccagttattcttcagtaaataaaaacacaaaatctttaaatattctaggtttttttttttttgctgttctgtatatttttaaagacatttcaaaagaaattttgcaaaaaaagatatgcacttaccatgtatttatttatttatttatttatttatttatttatttagtagggacggagtctcactatgttgcttaggctggtcttgaactcctgagctcacgtgatcctcctccctcgacctcccaaagtgctgggattacagatatgaccccctacacctggccctcttcaccttttaaacttaaacctgtatgtttctaggacataccataaaatactgatatcaaatctcagggagaagaaagtaaacattaaatcaattcttaccagtgatttaaaacaactctattccacacaaataagccagcctttccccagtccagtttggaattaccttccttcgacaattttattagcatgccaatgatgacaaacccttagaaagttgtgggggcagaaggaaaggttggggacaagaccaaaaaggcaggacttaacatagacttggggcattttgctgcagaaaagaaggagaatttagagtaacttagtctagtcagtaatgtagtgacatacatttacactccactcatacctgaatctgaatcagaatcattctagaaaaagtgttcagaaacctcctaatatgactgcacttagtcttttggggagactgtactctccccttgaattacctcatctcttaagaatgtgactgtgatcagcatgagctctgtgatgccaccattctcactcagcactctcttcatacctcgttcaaatgttttgagcccacaatgaagagcattagccttaaaggcccttgtctgctcacacaagaaaaatattttctccatcaatacttcttgtatttttcacctggagctggagatcatcttgctaatatgggacagaattagagaggtggggagccccaggtgcacacctggttaacctaccacatgatactgaagtgtcaatggacaagtttcttggactcttgttaagccagctaccaaattaagtgagattctatatgtttaataacagtttgacacagaaaccaaacagtctgtttggctggctgtgaagtatcaggatggccaaatgggcatatcagcttataaactaacagaatgaaaaggtaacatatgaaactggaatatttgcaaaccatatagctgataagaggctaatatccaaaatatattaacaacttctacaattccatagcaaaaataaaaaataataaactgacttaaaaatgggcaaaggactggaatagatatctctctgaagacatacagatagccaacagacacatgaaaaggtgctcaatggttttactattcatgcaaatcaaaagtaatgaggagatatcaccatgcacctgttaagatgactgtcataaaaaaaagataaaaagcattggtgaggacacggagaaattggaactcttatacactgttagtaggaatgtaaaatggtgcagccactgtcgaaaacagcacagagcttcctcaaaaaatcaaaaatagaactgccatgggattgagcagtcccactattgagtattaatccagaggtactgaaatcagtatcttgaagagatatctgcactctcatgttcactgcagcatgattctcaacagccaagatgtggaaacaacccaaatgtccatcaacgggtgaataaagaaaatgtgacatatacatacaatggaatatttttcagctttatgaaagaatgaaattctgtcatttgttagggcatagttaggttggaagacattatgctaagtgaaataaaccaatcaaaggacaaatacagcatgatttcactttgatgagttatctaaaatagtcaaactgatagaagcagagactagaatggtgattatcaaaagctgagggtaggggtaggggggtatgggaagttgttcaatgggtatgaagttttagttacacctggaagaagaaaaggatgctcactctcaccaatgctattcagtatagtactgaaagtcctagccagagcaatcaggcaagagaaagaataaaaggcatccaaattggaaaggaggagaatgtcaaattatctctatatgctgatgacatgatcttatacctaggaaactctaaagattcctccaaaagactcctaaacttgataaacaacttcaatatagtttcaggatacgaaacaaaacatgcaaaagatcagcatttctttttttttttttttttgaaatggagtctcactctgttgcccaggctggaatgcagtggcgcgatctcggctcactgcaacctctgtctcccaggttcaagcaattctcctacctcagtctcccgagtagctgggattacaggagcatgccaacatgcccagctagttttttcttttctttctttctttttttttttatttttgtatttttagtacagacaaggtttcacttgctggccaggctggtctggaactcctgacctcagatgacccacccacctcagcctcccaaagtgctgggattacaggaatgagccaccgtgcccagccagttacatttctatatatcaacaacactcaaactgagaaccaaatcaaaaactcaattccatttacaatagccacacacaaaaataaaatatccaggaatacatttaaccaaggagatataaaatctctacaaggagaactacaaagcactgatgaaagaaatcgtggataatggagatcataattctaagcaaattaacacaggaacagaaaagcaaacaccacatgttcttacttacaagtgggagctaagcattgagcacacatggacataaataggggaacaaaacacactgtggactactagagggtgaggggagggggagtggattaaaaaactacctatcaagtattatgctcactaccagggtggcaggatctgtacttcagacctcagcatcacacaatattctcatgtaataaatctgtgcatgtactgccagtatctaaaataaaagttgaaattaaaaaaaaaagaaattgtaactggcacgaataagtggagaaacattccaagctcatagacaggaagaatcaatattgttaaaatgtccatactgcccaaagcaatctgcagattcaacacgatttttatcaaattaccaatgtcatagaaatagaaaaacaattctaaaattcctgtagaaccaaaaaacagccttgaatagctaaagcaatcctaagcaaaaagaacaaaactggagcatcacattatgtgactttaagttatactacaaggctatagtaaccaaaacagcatggtactggtacaaaatagacacatagatcagtggatcagaatagagaacctagaaacaaagccacctacctacagccaactgatctttggaaaagttgacaaaataaacaacggagaaagacaccctattaaataaatggtgctgggaaaactagctagctatacatagaagaacaaaactggactcctatctcaccatatacaaaaattaactcaaaacagattaaaggtttaaatgttaagacctataaaaactcctggaatgaaacctaggaaaaactcttggcccagcaaagaatttaggactatatcctcaaaagcaaatgttaacaaaaacaaaaatcgacaaatggagtttcattaaatgaaagggcacctgcacagcacaacagaataaacagacagcctgcagaatgggagaaaatgtttgcaaactatgcatccaacaaagaaataagatctataatatgtaaggaactcaaacagataaaagagaaaaaagcccaaataacctcattaaagagttgacaaagaatatgaaagacccttctcaaaagaaaacatacaagtgtccaacaaacatgaaaaaaatgtttaatatcactaatcatcagagaaatgcaaattaaaaccacaatgagataccacctcacaccagtcagaatggctattattaaaaggtcaaaaaataatagatgttggcgaggatgtggagaaaaggaaatgcttatacattgtcggtgggaatgtaaattagtacaacccccacggaaaacagtatagagatttctccaagaactaaaaacagaactaccacttcatccagcaatcccactactggatatctacccaaaggaaaagaaattgttatatcaaaaagacatgtgcactcatatgtttatcgctgcactgttcacaatagcaaagccatgaagtcaacctaaatgtttaccactggtctattgggtaaagaaaatgtggtatttatacatcataaaatactatgcagccacaaagaagaatgaaatcatgtcttttgtagcaacatggatggaactggaggctattatcccaagtgaaataactcagaaacagaaaaccaaataccgtatgtcctcacttataagtgagagctaaacaatgggtacacatgaatagaaagacggaaataattgacactggtaactccaaagctgaggagagtagaagagggttgtagggtgaaaaattgcctattggttacaatgttcactatttgagtggtaggttcgctagaagcacaaacctcaccattacacaatacatccatgcaataaacctacacatatacccacttaatctgtaataaaataacaaataataatagtaataaaatttcagttccacaaaatgagtaagttcatgagatctggggtatctgtggttaacaataatgtattgcacaattaaaaatttgctaaaaggatagatatcatgctaagtgttcctaccataatagaaaaacacaaagaaaaaacaaagaggcacaaggaaattttagaggtgagggacatgtctattaccttgatcatggtgatggtttcatgcgtaaatgcatttggccaaattcattaaattgtaaacattaaacgtgtggtttttttgtatgtcaattacactttaatcaagttgtttaaaaaatacttgcacaaacctgtagtatactagttgtccctcattattagatcagtgcttaccatatgctatgtcagttttaaaaaacaggagtcagctgtagctaagtcctttactacttcataaaaacatcaatcaaccaaacaatggttcagatagtgaaagaacgactgcacagtgaagcatgctcaagtgcttggatctacttcactcaaatacaacacacgttcattgatgcttacagcctgatcccatgtgaaatacgtcttcatagagcttagcattcagtaactaaacaactattaatttggaagatatgaattttctagaaaactgatttttctctcattcattcagagtggagaaaagatagccagagtttgagtctgggtaagccagatccctctggaagctacacagtgtctgctaggaaccaagctaaattcaaagacagtgacttcagatgttttcagccctagtgtcctttaaactgtgtgctggtgtgcctctcacttctttagattgtaaactcctcattttacttatagaaaaacactcagtgcttctttctttctttccaaggaaaatcatcagctttttcaattaatatgtgccacagtgtctgttacttttcagaaataccattccttttctgcattgcctatttccaattttgcatctgctgatgtctgggtgccaaatctatcctataatgttttgtcagcaagttattcccagaaaaataatgcaaaactcttaaagtctgcttgagtgatttctcaggaaccttatggctcatggaaatcctgtattcatccaaagggaagtctattaccaagagctatttaaggcaagtgtgacatggaagaaattataaaggaaaaaaaaaacctccatctcaaaaagtaatcttcattttatgatttttacatgaaagttggtatcactatactcttttaaatgtgttgttagagaaaatatgcaaatcctgaattatatcttcaataagtatatatgaaaatatcacaagccatgatatcaattcatcattcagcacatagcacatgtctctctcagttcatgccccaaacctcccctgaccacagcaccgcagcaactcacagcaacatcccaaacagaaatcctccagcatcacaccctcacctccagcacaaacatagcactaacgtctcttcgaccagctccctcatatcccagtgccctgccccacttcagcagcttgaagagaaaatacaatgaaggttggggaagagaaggagacctaagccactgacaacagtgggaattacagaaacaccattatggctcaggaggttgcaaaaccaaaactttccaaagtgaatcgtaattttcacgtcctggaaaatgtgaccccaatggctactaaaaactgactttgctgacttaggtcaccagtttcactcaaatcacctagatctctaatataactcttgaatattcaccattaattattttattttttatttgcattaatacaaggggtaaaagtatagttttatttcatggatataatgcataagggtgaagtctggacttttaatgtaaccatcgcccaaatagtggacactgtacccattaagtaattttttgtctgtcatccccctcccacccttccaagtttctaatgcctattattctatattctatgtccacgtgtacacgttatttagctcccacttctaagcaagaacgtgtggtattttactatttgtttcggagttatttcacttaagatgatggtctccagttccatccatgttgctgcaaaagccatgatttcattcttttttgtggctgagtagtaatctatcgtatgtgtgtgtgttgtgtataaatacatctcacaaaagttgtgagatatatatatgtgtgtgtgtatatatataccaaaaattttaaattttaaattgtacttaccactgtactttaaactcaaatgcaaatattttatctattcacttttgtaatcatggagctatatacatccattggggaacctgatattgtacaaacagtaagcagtgatgaggaagagatactgaggaaatcagggaataaggacattaaaaaagtaaaaagagaaatgaaggaatgaaaactaaaagtaatgtcaagtgtcgtctgcagaacgggattcagtcatgcagcccatggcagtagcatagccacagaccaaacagcagagaagcgagtcgtaacaggaagtctccactttttcttgggcttcctgcagcaagtggtaaagaaataggtgagtaccatgaaaaatcacccagtttttcccaagaatcatggctatcccagtgtcagcagagcatggccctgtctctgcctctaccaccacctcacatgcttcatcccagaaatggtcccagacctgaacccctcttcagtcacttcgttcactcctggttcaagtttttccactgtaaactggagtctctcagctacttaatcacttgcttaatggtttggggaccacacaatcttctgtgagccctaggcctgcacattccttaacagatacgtgcaggaacacagggtaccttttaacaccaccaccatcaccaatactcataataaacaaacagatgaataacacttatataatgcttattatgcaccaggcactctccaaaacactttatacttaggtactacttttatacacatttcagggaagtaaattgagacttacagtggttaagtgatctgttgtgaagtagcagatcccaaatttaaacacctgtatgttggttccaaagaccacattctttatcactattctatgctaaagctcacaagtgaagacttaataataaatctttaaaactccaaatatataactaaaatttgaagtatataattcttccatcaagaaagccttgtgaataggattacgtggaccctagctcttccatcccttttcaaaaaatctttatggttggtcagcttctttatattatatgaattctaaaatatatttgccagagaaattcaatcatacctataaatatgattactcctcatctctaccaaaccacttaaccatcccaactagccctactaacttcatgttttactgctaatgcaaaaaaaaatctaatgcatttctggcaaacagggagtttctgtggaagtcaatggagagaaaggttaacattgacttctaaggcaagactatatagactggccagttaaatgtcacagatataatttccttatttgaaagacacatcatataaaattgctgatgctattctgttgacagtatgaatgttaatcattaggactatttactgtcatttccatgctataattctgctcaaatattgaaatttgtaataccaagtaagagaagctattttcattactttttacttttttttgagacagagtctcactctgtcacccaggctggattacagtggcacaatctcagctcactgcaacctttgcctcctgggttcaagcgattctcctccctcagcctcccgagtagctgggattacaggcacctgccaccatgcccagctaagttttgtatttttagtagagatggggtttcaccatgttggccaggctggttttgaactcctgacctccagtgatcctcctgcttagcctcccaaagtgcctggattacaggcgtgagccacctcacccggccaagagaagctattttggattttaaaaatatgcttttaccaattaactggtgttttcctaagcgagaagcctagtaatattattctgttattagtaattgcctgggaagaatgtatatgctatatgaaactctgtggctaggctgtacatattaccctggagaaatatacacaggtagttggatactagcatttctttgaaataaatcaaggatatagatcatgagtcctaaatctggcaaaccttgttcacattacccaaaaagatctgttttatcatgtggttcactcctacgtgtgtattccagcccaactgggattaatttctaatatattttaaaaatcatgtttatattatagtaaatggtatttctggtaacactctaataggttttggcctcagtaagattttgcttagaggaagagtcagccagctacagcctgcaggccaaatctagctctctacctgttgttcttcgacccatcattgagaataatttctccagatttgcaatcagtttgatgataaagaaagctaattttgaatctcaattaaacagaatgttattttttaaaaaagtttaaaagattttcagtgttcttattattaaatgcagtaggcagaataacgatctccgaagacgtccatgcccgaatccccagagcccatgattatgttacctgacatggtaaaaggaattccatgacatggtaaaaggtaaaaggcagatgtgattaaggttatggactattatgggttggaccatgtcccctacaaagatatattgaagtcctaatccctgatacccatgaatgtgcctttatttggaaaaaggggttttgtagatgttatcaagttaagatgaggtcatcaaggtaagccctaatccaatataactgatgccttataagaagaggagaagagacagaggcacaggaggagaggaggcgttgtgctgatggaagcagagattgaggcaatgcagctgcaaatcagaaaatgctaaggattgatgggcatagctcttccatcccttttcaaaaaagtctttatggttggtcagcttctttatattatacagattctaaattatatttgcatctgtgctatatgaaactctgttgctaggttgtacatattacgctggatccatagtagtgcataaccttaatcacatctgccaaatcccttttaccatgtcaggtaatgtattcacaggttctggggattacggcatggacgtctttggagaccattattctgccaactgcatctgtggaagaaagaacaagaaaaggaaggatcctactcagaacctcacagggagcgcggccctgctgaaaccttgatttctgatttttagactccagaactgtgaaaacgtttttaaataattgccgttgttttcagccacccattttgtggtactttgttatggcagccctagaaaactaactcctggaccctgcattgtgaaatttatcctgagttatccaggtgggcccagtgtaatcacatggatccttaaaactagagagactttccaggctgcagtagagagagaaatgtggcaatagaagcaggtttacagagacgctacattcccggccttgaatatgaatatgattcctggtattgaatatgaaggaaagagccatatgccaaagaatgcaggtaacctctgacaactggcaaggcaagacagcagactctacctcagagcctctggaggggcagagccctgccgacgccttgattttagcccagtgagaactgtgttggacttttgacctctggaactgtaccataatatcatcaatattttgtgtgtaagctaccaagtttctgataatacgttatggctgcaacagaaaactaatacaatagatttgtattacaaaaactgttccttattattattaatattattttttactttaattttgttgaactttgtgaaaatttgttttctctcttgtaaggtaagtacctacataatgtatttgattttgcatcttggcccataaagtctaaaatatttactatttggttctttacaaaatttgttgacctctggttttgagtgttagcaaatttcaagtttgttaaaaggaaaatacttaatgtggctcttccatttagaaatactacatttcttgcccaatggtttattgaagttcagattacagaagtagatggattataaagatttgtatagttgtacttctcaaaaagaattaaaagaaacatatccattcttcctatgactgtactcctgcatctaaaaacttgatttgtgaagcttgtgatgtgccaccatagtatagtgtagttgggacagcaagtgcatgttaagtatggggtcagaatgagatattagataacctggaacaaaggggagtgctgacttaaatttctggaatacaagcaagcccactcatcccagagagatggacaggacattgcctggctgcaggcaggtagcttcatagcactgtcactatggagcgctatataaaaaacatatttgataggaatgtgcaaaattaaaaataaaaaatagaaaaataaatatttgcctataaaaaaaagactcacctataatatgttcagaatttattcccctaaggatttttttagaattcaaaatttctattatattttcagtaaagttaaattaatcatgttttctacgagttcaaaacatattcatcttaatcacaacacttgcagtttggtagcctcattttgaagaatggaaagttaagagagcataaatcaattgctaaagaaagacaaagtcattataaagcaggataagtactgccagatcgtccctgccatatagactagttaaccctacttttacatgagagaaacatgtagcttaatgaaaagcatctttcattcagtaataacaaatagttgtcaagtgtctaccatacgctgggaataagaaccccagacttgcccctgttcctcaatgaactcagtcatttgctgtcagaatggaaggtgcacttaacctttgctcccaccccatgtgagtcagtctgtgggtcacattagcatagaaaaggcacaagctgagatttccctacccactgccagattggcaaagaaatatagcagagaggccatgccagacttgggaatcggacagacctagattcaagccctctctccttattagctatgtaatggtgggaaaatagtctaagatgtgggacacagttccctagggctcagatgtaaaataagaaccatcgcatatcctttgcagtgttgctgtgaggactgaccaggaaccacacagatgctcacccagttggctcatcatacagggtgctgggtacattttaaccatgaatgtccttctaggaggttaagtaaatatcaagaaatacaacaaatagaacacttagccttctttgcacattctgcaggagtcttgtgaaatcactgagttccagtcactcaggggacttggtaatggagcccctgctgtactcgtagacacacagctgtgggtaagagaaggtggggatgggacatcagacaacctggaataaaggccagtactgacttccgtttctagattcacaggcaagcctactaatcccaggatactacaaagatgtcaaaacgttgacactgaggagagaacatcatcacaaggaagggtgcatggaagaaaggtgggggagggcagtaaaaagaaggaggaggagacaataaagacaggcagaaggcttagagacacatattactcagtcactcagcatcccagggatgggctcgtggtccagtccctgaatctatctagactcacatgtatagtgagagattgatcatgctgattgcagctgtaaatgtctttaatttttgtgattctattttcctgaagtaaagtggtgatgaatgatagtggagagttaagaagattagttggacaattttcaaaagaagaatagaaatgactagtaaatacgagcagtaatagttcagttttttaaataatgcgaattaaatcaatgtgatgcagcatttgcctatcaaatgaaagaaattaacaagaacatccgtgtagatgagggcacagtgaaatacacgcactctgatgttgtggataggggtatgggttggtatgagagttcagaaagaaatttggtaatgttcatcaaaataatttagaatattcatctcttttggcctattaattcttcttagaaactaccatatgccaaaatgcccacaaaagttatgcacagacgtgcatcatttataataacagtgagaaattggacatcactcaagtattcaatattaggtacatgcttaaataagacagaatatatcaatatggtagaatattttgtggccattaaacataaaagctttttaataatatagggaaatttaataacattaaaaatgtcaagtaaagaaagcatatgttctcaggtaaattaaaaatttatttttaaaaatacactaagaaattactattgctggaataatgaacacatttcctgattcttcatatttttccaaattctctacaaagcacatgcctcatctttaagctcagaaagaacataaagctaacataatcatcataataagaaaaaaacaaaagataaaaaggaattgttctcatccattttctttcatagttctgaggccttatgttcatgagaagaaaggtaacaggaaaacgatatttttatttatactgtattgattttggaaaggccacaacacagtggaaagagaaattaagagatggtggcataaattcttgaagacggagccttattttcttcctctattacttgactttcacattttaatccatgttaaaggacctgttttatattctcgtgttttatctaaatcttttctggcagtcagcagaaatatatgcatattctatactcacaataataaactatatcagatacaggatgagaaatgtatctcttaaagatctccatatgagttaatattacaccttctctagataaatttatctatcaggaaattagtttaaatttaatttagagaagccacatgatatagtgaaaggagcccaaagcttgaagttggaacacctgtatttggagatggatccaccagatttatgattggcacaattcactcagtcccttggctcacaaatctgtcatgtgtggagctgagatgacatcatcttcacagcattactgcgatgatatgagataatacatgtggaagtgactgcgacgttgtgaagtcactgtttaaccctttcataccaaaagaaggaaaaagtctttgatagggcctcttcatgctattaacatgctgtatttatccaaatgaaaataataataataaaagtatatttaatagatctggtgacccagtctggacaaagttcattgcctgggcacatttccttgagtgcagctcaaaaatttaccagcattaacatgatgtgatttttttccaggttaaaaaaatatatatatatgattcaataactaaagctgatagtttacaaaacagaaagcagctactctaataataaatggaatattgccacttataagcgcagcatttccctaggtaacagaaatattttctcttaagatggcttattggggtcaacagattagaacttatatgtacttcgaaatcaaatggtatagttttctttttgttttcaaacttagtaaagatctcttttaaaggaaaaagatctcactgactgccaatgttgacaacttatttttacaacaatattaatatatgccactaggtataatctgcctgccctatcctcatggtccttttacaacaactacaaaactaaaaattaatttatacattaaaagcaataaaaatctttaaagtagtgtaaaaatcaataacattgatgtgaataaacacattatttcactgaaagtaagttataattctcaatgtgaatatgatagtatacatgcacacgtaaagtttgacatgtctatacatataattttctcaacatttttgtctattccaacttttgtaaaatcagtggtatgatacatgtttaagttatatatttagtgcacatagggggaacataagagcgatgcctgagttacatgtttagtgcacacaggaaacacatgcacacgtacatctgagttatacatgcagtgcacatataaaacatgtacacacacttgagttacataaatagtgcacatatgcaagcaatgcaggcacacaccggagttatacatgtagtgcacatacaggctcacacataagttacatacacagcacacacaggaaacacagacacacatcagagttacatacataatccatggaaaacatacagacacacacctgagttatacatgtggtgcacatatggagcacaaataggcacatgcctgagttatttaggtagagtacatatgggggacacacaagcaacgcctcggttacatatggaggacaaatctagccttttcccattaactcaagataaataaatagcactgcctccgtctaatcagattattaattcatcaaaagtgtgctacaaaaattgcatgattaaactgcattaggaggcccagataacccagacatgcatagattacttttttagggctataatcaaagtataattacaaaattgattattttcttggataacacacaggcacagggaaaatgttcatatactcttgtttgagaaactctgctattgataacatgacctatgtccaaacattttaaaaagttttttataaaacagaatcctagaattcctgatttgaatagaacttgtggggcaccagagttcagccggatctgacttattgatttatgttgctaactcagtgcaacagcatccgcaacagcctctaagggttgggagctctggcatttaatttaatctagtccccatcattgcccttcatcttctcctcattgctgctgcttctcctctcttttccaccttcgtgccctgtccttgctgttcttaagtaccacgcacatttgaggacagacaaaacagacataccatgaaacagatttgttttcagtctgaaagcccacaaaacagcacctctgtggaagaaaagccatagttacagttggttgtgtggctggaaattctgaattcccctggaaacatttaagactaggcccttttccgctatcaattacagaacaaatagacccccaggtctgctcacctgcacaatccacacagaaagtaatgggtattccacatataatgggtaaatgatttgacattttgctattacatatatagttatggtctgcataaggacagttgaaagataagtagacacctaagaagctgatttattgaattcagcaattcattaaatttaacaaatatttatagagtgcttattttctggaaaatactgaacaatttttatttttctctttacagcaattgtgaaatgcaagaaccagatacctaggctccaacttaaatatccatctcctttatttaaaacatatattggctatctatcatgaagtaccaggtgttctgttggggtcagtgagatattagaggccaaaaaaaatgtttctgggttaaaagactagaacacatgttatgaataacataaaaatttagactgggaaaaaaacaatttcaacagataatgacagagagagacaacaaagacaagtaaggtgaaagcaatatagcattgtgactaagaacaaaaatatgaacaagtggaaagatctgagtttgagtttcaggttatttcaattatctgtgtgaccttgggatattatttaacctctccaagctgtaatttcctcttatgtgccagcaggctaaatagaagtacctaacacattctttcttcttgtttttgttttgagaattaaatgagataaagcacagtatctggcagagggctagtgctaagtaaaggctatgtatttttattataattactacttttaatatattggtgccagaaatagcataagaaaatgaacagaggtcaggtgcagtggctacactcctggaatcccagcactttgggaggctgaggcaggtggatcacttgaggccagaagttcgagaccagcctggccaacatggtgaaacccccttctcaaccaaaaatacaaaaattacctgggcatggtggcacatggctgtaatcccagatactggggaggctgaggcaggacaatcgcttgaacctgggaggcagaggttgcagtgagctgagactgcaccactgcactccagcctgagtgacagagtgagaaaaaaaagaaaggagagaaagaaagaaagaaagaaagaaagaaagaaagaaagaaagaaagaaagaaagaaagaaagagaaagaatgaaagaagaaaagaaagaaagaaagagaaagaatgaaagaagaaaagaaagaaagaaagaaaaagagaaagagagaaaggagggagagagagatagagagagagagagaacagagacaagaaacataggaccttactctggaaactgtgagaatgctcatttggttaaaagactagatcatagaagaaaagtagaggttgataggtttgaaaagttggttttagtcaaattgaaaaacaggctgagatatagggtttaattggtagatagtaaagaaatcattgaaacattttgaacagagcagtgataaaatcagaggtgcactttaggaaaataactaaggatggcaggataaggtggagagaggaaaaatcagagcattttatgaaaagaattccacttaaccaattaagaattaagaagtaaaatgggaattagagtgttgatatgaaaaagaagaactaaacttgaaagaggtattatggaggtagaatcccttacaacatttaggagcacctttaagttcaaagagtttgaataaaataggtctcataggaagagtaaaggtcatgccataagcccaatcagtgctataacaatgacccttaatatctactcagtgccagacacattgtattaccacactttgcattactatagtggaatacctgagactgggtaatgtataaccaagagttttatttggctcatggttctgcaggttatgcaagcatggcaccagcatctgcttggcttctggtgaggcctcaggaagcttacaatcatggttgaaggcataggaggagcccacagatcacatggcaagagggagcaagagagcagggaggaggtgccaggctcttttaaacaaccagctcttgagtgaactaatagagtgagaactcactcaacaccaaaaagatggtaccaagccattcatgaggaatctgctcctatgactcaaacacctcccactagacacctccaactttggaggtcacatttcaacgagatgttgaggggacacacatccaaaacatatcacatgttatgtgtcatttttagattccttttaaggctggtcatccaatggatttcacatcctcacacaacccaaacaaaaaacagaaaaaaagaaacttcctctagttgtttccagcaaccttccctcatacctccctggcttgaattggttacatttccattcctgaactaataactgtgatcaggggattgacatacgctttaggacataagttttgtttacctgaatcaatttttgtgtttataataatgaaactatattaatgtggttagaacagtgattctcagtctgaggcaattttgtccagcaggggacatctggtaatgtctggaaaatttttgattgtcacaactgcaacagtgttactggcctctagttggtagagtccagggatattgttaaggatcctacaatgcccagaacagccccctacaacacagaagtattggacccaaaatttcaatagtgttcagagtgagaatgttggctttgaacaattaggggtcatccttggatctgggtgtgagatcagctccaaatcccaccttacattaatagataaggataaaaccaatgttaggaagacaacgaaaagtcaattaaattaatatactcaacaaaaattaattgagttggggtgtggggacattgcaagaatgctgcagtgaaaggcttccaaatatctgctcctccacaatggcaatgaaaacactaaatcaacattttaagaactctgtcaactaaccaacagagaaattcaaagattctttattaaagaaaaaacagctgaatctcaatgagaacagtgacctttctggtgttttaacttgccctactcccatcctctcttctcagctccacaatagctttgaaaaccaacagcttggtaaatatgatagcagtgacaagcatagccataaaaaaaacagcagcctaccaaccaaaggagagggaaaaacagttttgaagctcctcaaaagtgcccttaccagttgttattatttgatctggctggtagtttcctggaaacctctactagtagggcttgtctttacttgaccggactcagagataactccttgtaaacaacctttccccaggacatcggtcaaaaaccatccatggtaattgcttaatatcagctacctgaggcatctataaaatttgggcaaacaagaagctgaccaaaaccttacatggaaaatgtggtgaatgaattgtccatagggtctgtgtgcttgggctgccacaacaaaataccagagactgatcatttgaacaacataaatttattttctcacagtcctggaggctagaatggtccagcatggtgaagtttttgtaaagcctctttttcaggcttctttctcactgtgagctcctttggttaacatgcagagacagagcaacatctctggtatctcttcttttaagggcactaatcccatcatgagttcccattcacatgatctcatctaaccttatttatccacccgaaagcctcatctctgaatatcatcatattaacatataactttgagtggcacacatatattcagttcatacattctgccctagacccccaagatgtccttctcacatgcaaaatacattaattttatcccaaaagcctcaaaagtcttaacagattccagcatcaattctaaagtacaaagtctcatttaaatagtatctaaatcaaatataagtaagccttatccccaaaatcaaaattattctccagctgtaaacctgtaaaaccatacaagttatgtgcttccaaattacaacagatagtggaataggcatgagatagccattcccattccaaaaggaaaaattaagaaagaaggaaggagagacaggccacaagaatgtctaaaaccaaccaaggcaaattccattagctcttaagtctcaagatatctctttttcatttaatgccatttattctagacctacagggatagtggatcctgcctccaggcttttacacagccctgtctccaaggccccacccccaggctttagtcagaggccatatggcctattgaaactgaggcaatggtcccaccctttgccacaaaggacactgacctgatgatctctgaattgcctttggggtcactacttcattttcttgaaaagcacaaagttagagccaaatagctctctggtctggtcttgcaagatctaaaagtctggcagcctttatttcatctcatttgtttctgaccccttagttcaaattgacagtgtttttgcttgtataattgatctctattcctggcctcttctgagatggctgattcagtccatgagtcattaccacgatctctttatcaaataattgttcaaccacacccttcctgttgtcttcaccacaggcttttttatttatttgcaatagagataggctgaaaactttccaaatcttcaactctggttcctttatgcttaacaatttcttcttcaacttctctctctcctttcacattttaccataaacaggaggaaccaagccactccttcaacaatttgattaggtatctccttagctaattatctaattttatcacttgcaaaatccaaagtcttatctaaatattatctaagtttgtttgtcaaaaatatcaatttcacaaaacactagaacatggttaatccaagtgctatgtcactttataaaaggatcacctttcttccattttccagtaatgtttttcctcattttcatctgggaactcaacagaatggcctttaacatccatattgatatcaacattctcttcacgattatttattatattattatatctctagaaagatagataattccccttagctattctcttttctttctgcgccctcactccaactgccttaaatacttcactgcaattttggctttttctagcatacacctcaaaacttttccatcccctatccattgcccacttctaaagccacttacgcatgtttaggtatttgttgcatcagcaccccacttcctggtaccaaaattagtgtgagtcttcttgggcttccataataaattaccatagactaggtggtttaagcaacagaaacttattttctcacagtcctggagggcagaattatgagacaagcatgccagcagcacactttgccaggttctggtgggagctctccttctctctgtgctctgccatggcctttctttggagcatgcgtgtggaatgagaagcaagctctctggtgtcttcttttgggggcactcatctcatcatgagggatccagtcacatgatctcatctaactgtaattacaacatagacattttgagaacacaataaggactttgaaaagctccaacatgtttctgagaatctagaaggcaacacacatgtgcaggaagttgagacacctgaaaaggtcctaattttttaacttttgctgaccttgagtatctgagcaagcaggacattaatggtaacagagttttcaactgcctaccagtaaattgaaggcatgcacctaacacacatggaactattcaggaaagactgggagagttgctcgttcaagatactaaggaaatgcatgtctagtcattagctgacaattatgttaaccagttactacacatgagaaactatagagttcttacaggaaagtcatgaaacaaagaacaacaataacaaacaggaacaatagcaaactgtgaagaatgggatctggtttccagagttgctacatcatattatctaaaatattcagtttcaaaaaaatcatgatacatgtaaacaaacaggggaatatggccccaaaacaaggggataaaatcagtcatgaatttttttattataatttttgtccctgaaaaagtccatgaattagaattcctagtcaaaaatttgaaataactttaaattataatttaaagccattacaattattttcaaagaccaaaagtaaaccatgaatacacatttaaagaaaaacatgagaatgatatatcagcaaatagataacatcaacttaacatataaattatttaaaaaatcgaaattctagagctctaagatacaataactgaaataaaaaatttgctagggagactttttctatgttacaaaattagccaacttttattgagagcttaaaacatattaaaatacatattaaatacacattaaaatgtattgtaaatgctttatttttctctttttttaatttaattttaatttctgggatacatgtacaggacgtgcaggtttgttacacaggtaaatgtgtgccatggtggtctgctgcacatatcaacccgtcacctaggtattaagccccacatgcattagctatttatcctgatactctccctcccactgcccccctgacaggccccattgtgtgttgttcccctgctagggagacttaattggaaattttacttggcagaataaataatcagtgaacttgaagacaggtcaattgagactatctagtctgtggaatataaagaaaaaataatgaagaaaaatgaacaaagtctccaatgtccctgtgatgctatcaagtgtaccaacatccacataatgaaaactttagaagaagaagtaaaagagaaaaagtagaaaaaatatttgaggaaacagtaaccaaattttcaaaatttcatttgaaaatcattaaactatacatattaaaagaaactcagaatgtatgtaagatcaactaaaattatccatgcccagacatatcataatcgaattgttgtcaacagtaaaagataaagagagaatcttgaacacagtaatagagaagtggctcatcacatacaggggtccttgataagaggaacaattgatttcttatcagaaactatggtttccagaaggcaacgggatgacatactccaagtactgaaagaaaaatactgtcaaataagaattctataattttcagaactattcttcaaaaatgaaaaaaaaagtgaagacattgccatataaacaaatggaaataatttgtcacttataaatctactctataagaaatgctaaacggagttgttcagtctgaaaataaaggacaatagacaataaatagaatccacatgaagaaatattaacagcaccagtagacgtaacaatataaataagcataaaaaatagtatgaatatacccttggtttgtaattttttccctgtttatttaaaaggtaactatacaaatcaacaactataaaatggtgctgatggacttataatctgtaaatatttattcttatataagagcacaaagaaagggggaaaagtagagctatgtagcagcaaaattttatataccactgacattaaattggtattgatccaaactaaattgttaagatactagttataatcctcagagcaaccattaagaaaagaatgtaaaaatacaattaaagaaatattaatattaatggaattaaaatgttatactagaaaacatctatttagcataaaagaagaaaataatggaaaaagagagaaacaaacaaacaaaaaaagacatatagaacacatgtgcctggacaacatggtgaaaccccatctgtacaaaaaatacaaaaattagttgagcatggtggccaattggaggctgaggctggtggatcacttaagcccaggaagcagaggttgcagtgagccaagatcacaccactgcatacaagcctgggtgacgcagtgagacccagtctcaaaaaaaaaaaaaaaaaactcaaatcaaaacaacagtaaaaaaaacccacatgtggcaaaatggcagatgtaaagcttactttatcagtaattatactaacacagaacattacatttggataatgatttttctgattaaatttgttgtagacagacagaaaacagaattagatcagtattgagattacaaagtggcattagcaacaagcaaggaattgaatccacaaatgtctctttggagagaggaagcaggatgtatgtgtcacctcttaatagattcatcaggataaactaaacagcatgttcaaaaagtttataggattggcaaataatgttttggtaaagtcattagaaaccatacaatagctattatgatgataatttacagccgtgacaatcgtctagacaagagaattaagacattactggttccaattttaatttgaaacaaagctaaccgtatcatattaagtgccctagtcttgtggcctccagccactgggtgaaaatgttaaattcatttgctatttttcccagaagagctgacagaagtaggcaggggtaggagaaatgaatgagtcaattgtaaagaaatttggattcaagcaaaaaagcctcaggaaagaaaaaaaaatccttcctgctgcagcaatgttatccaaacagtggggttctcagtttgcctagtactgaaggacatctgataaacagcctctggtaaagaaaaaggtagtggtttatctttttaaaatttttattttatttttcattgaccaataataattgtatttatttatagcatacaaggtgatgttttgatatatgttcacaatgttgaatgattaaatcagactaattaacaaattcatcacctcacatataattttttgtggcaaaaacatgtcaaatctacccttttagcaattttgaaatatgtaatgcaatcgtatttattataatcaccattttgtgtgaaagatcactaaaggttactattcctgtctaccagaaactttgtaccgtttgatcaacatctaccccctttccatccatccccctttgtcaggcccttttcagagataaatcactggtggagactagaatgactgttaccagtggtttatctttgaagagtccacacctgagtccagattttgtttttttggtttttttttttctgctcttacaatgtaaacttaaagcaagatggactctagtggtctcaatgataaggagagaaaatagaaaggaaagacctatttctgtgagtagtatctgctaggatgggttctcaggacacagttatagacattccattgtaagaacaggtattcatttacatttgatgaatgtacaaatcaaccacatttagttttcctattgaggttttatcgtactctctccaagccaatgacttcttcacattctccttttggcccttctaaagtggatatcaagtcaaagtatgaggtagtgcatttcagaatcatgagtaggaaacaatttcaagacccagagcctaacccctttaccagcaccaagtactactgccctagacccaggggtacactggaaggtatcctggcctggaaagtacaaattgagctctaggtggggctcttgcttttcctgagaccttggccaagtcactcaactttcctgactctctcagtttctttacctaaaaaaggaggaagatgaactggttgagctctcttgcatctttagaatttggcggttttagatgcccctatcatataaaataaatctctcaattcctttaaaataaatatatttatgcataaataattatatatttatacataataaagccataaatacaaatatcaatatatttacacatatatagatacatattgatatcttttatatgtaattatatatacatacgtagcataacacacgtatagatatacatatgctatataaacaaaatatattatgataaaagtgttttgaaacagtctcccaacagcccatccaaaatagttttagatcattacaaaattatttcagggtctcagaatcaaaacacagaaaagcctcacggtacacagtagcccactcctgatttgagatggcattaatcaatgagaaacctctaaatagagggcaaccaatattgtgaaacatgctgtctgagtagaaatagcctcagaaatcatggcgaagcaacacttttcttttttcactctctagccatggtcctcttctaactgggcaccgactctttcctcctctcccagctttatccttcccctacccgccctggcgcagagttgtcatcttatgactctggaacccccttgcaatgtgctgtttctgtacctcacctcttggaggtagatgttgcagtggcagcctcaaacagggatgcttttttaggcaccatcggaagccacagcacagtgctaggcaagaatcagaggaataaaacacaatctcctggagctgatggtccagttgtcccaactggaaaacgaagttagaccacagtggtatgcaaagtgtcttctgactgtagaattctcagacaaatgaatgcacaccagtgccaaatataacacattaattttaattgtagccctctagagaggatgacctagccactgagtgaagatttcaggcaggtgggcctttctgtttccaccgaaattatattatattggcagccacctagtcttaaaattgcctttaggaaggcgtaggagactgaattggaaaatgcagccaggcaatttatgggaaaattgaacggagcgtccctctgagtaaggagacagggcgtggtaatgtcagtcctccttctaaagaccagagaaaatttctgttccacctgataaactctgtatccttttggactttgtaaatattgcacttggaattgactgtcatttaaatattgagaggaaatctgccaaagttatttgattagtcaaatgctttaaagattcattaaaataccaaccctgtgggatgaggggaggtattttattcaatgccttcctcatgtggtatctctgacatggcttatggacatcctcagtagttccaaagggattaaatgtttaagttcctggaacaaatggaaagtgcttactcctcactctttgtcaaactctaaaactacgactgcctcagtgaaacccccaatatccttatgtctaaatgtcacaatgatgatgcaggtcttgaaatatacaaagaactggcttaagctgatataaatcagaacctgaaacactattatttcactactacaaatagtttaaagtttgtaaagatgtgtaggtggttcttagttttattatctttgctgtgagtcactaatattgcttcatagtggaaactgtccatttaaactaaaataaatcttgtccacagagaaagctggtattggttgctttttagttaaaacagtgtaaagccttggtttaatagagagttcgtctttcttctgaggaattaaaacatgttcatacaatagattatctttttatatctttccttctaccactttacctctaatactaggataactagctaacatttaatgaatgatttctaaatgctaggtggtgagttggtgagttaaagtggctttctatggattatttgtcttcagaacaacccaatgagccaggtacttttgtgacttgatgaagataaacaacttgattaggtagcaaacctagttagtcatggagccagaaacccaatctttgacactagactagatgaattcattacaaagtctttccaaagggtccgtctatccagcctcttctttttcatattttcccttaggcattttctgtttggagagtacaaaagacctctaacccacctctctgatcccatgctgtaacccactccacagccagtctacactctaatctcacgcactgcaatatattcactcatgtaatccaatccttcagaaaaatccaaactcacacatccttcgcattcacaattttcttctttctcagtgtgccacatgccagactttagagcgtgtttctctccctatctgagaccccatcttcttctgcacctcaaacccacttcctccaagcaagctttccacagcacttactaggcacattacactttggggatgcacccttgtcctggattaagaaaataatgtatgctgcaatagaaagatcacagggcttagcatccagagacaggtgttaaaatcctgtttcacttgcaattttacttaatatcatgtggcctcagtgttgtcatctgtgatggggagtcattactatctgccgcatagagttgctaatagggattaaatgaaattgtgaacacacacacacatatatgcacacacacaaatatatgtatatatttatatgcatatactttcacatatgtagaatttcatttaatccttgttatatttatgcatgaatatatgtgcatttatatatatataattttgtatacccacatataataactttgaaaactataaaatgctctaaagaggtaaacaatcattactgttgctaaactgatttattatgtatgtatattttgcttcctcaactacattttttattcctaaaggacagcaattcttttcatttatatctttctctttctcagattctagcacagtgctatacaccataaaaaatgctccccaaatacttgagtaagaatattcccaagacctctagggagaaatcatgattcccatattatatgttagaaaaacgtcaaggcaagaaagtggccagccaactagccattgggaaatgcaggtcttctcattcccatttgattgttttttttttttttcaaccaggctgttctgtcagctttttccttaataaatcggacttcatttttactaatgacagtcagagactctacttactatttgtgggcagcaccaagtaggtggagtgtcgacttcatttggagggtgtcattgcaatgaaaaaacaccctgacaacttgaagatgtgggcagatataaacaacagcattgaggcggtagctcatgcctgtaatcccagcacattgggaggacaaggcgggcggatcatgaggtcgggagatcgagaccatcttggctaacatggtgaaaccccgtctctactaaaaacacaaaaaattagccaggcgtggtggggggcgcctgtagtcccagctactggggaggctgaggcaggagaatggcgtgaacccgggaggcggagcttgcttgagctgagatcgcgccactgcactccagcttgggcgacagagcgagactccgtctctcaaaaaaaaaaaaaaaaaaaaaaaaaaaaaaaaagactaatgtcttctttatcaaaagtctcctcaggaacagtttgaaatgagaatgctaaaatttaagatctagtgggcgatctcctcaagctagttcatattacttagtttcctttgaatccatctctactttaggattctccaacatgacaagtaaagacaacatggagagagctgcgagagaataacaaaggtgccaagggatttgtaaaatctatccgtgaacatgtagagttcacaggaaaagagaaagagaaatgcccttagtgtacaaaggaaagcagctaccatcatttttcaaaaccctccaaaatgattataaattccctaagaatagggattggctgaaaaaattctctgaggtgtgattcacaaatttaattcttctgttgtttcactgaaaatcgtctccagggcagataatgaaatctcttttgaacacatgcatttgattctttaccaagatgttagaggatgcaaaaccttagatggtccagaaactgaatgatgagctactgagcatgatgtataagacaaggtgaagaagatagcagagggaaatgtttggaaagaatattaatctggcactgttgtgatcctgaagctgaagagaatgctgagggacaaatttcctctggagagaggcagggattgaaaactaaagaataatgtttccctatttctgttactgggggacggacagtacgaccagaaagacaatgtacctccctgatgtggtttggatctgtgtcccttcccaaatctcccgttggattataatccccagtgttggatgtggggcctggtgggaggtgatgggatcatgaatggtttagcaccatcttcccttggtactgtgtagtgagtgagctcccatgagatctggttgtttaaaagtgtgtggcacctcccccaatctcttttcctcctgctcctgccatgtgaagtgctgcctcccccttcgccttcaccgcgactgtaagttccctgaggcctccccagaagcagatgctgccatgcttcctatacagcctgcgaaaccatgagccagttaaacctcttttctttataagttacccagtctccagtgtttctttatagcaaaacaagaatggactaatatactcccataagccagggccccaagaaagattatcatggtcgggaaacagttagtgccaagggcctataaggatgcggtcattgatgagaagaagtggtatggaagttggtaacactagttctcattcccccacacaaaaaggagacccatgagcaggaagcaagtttatgatactacagagagagaaggtgataagtgagggtgatggccagggcagaaggaggaattacagaacattttgaatcaccactagtctgttcatattacacagaaaacattcagtttacgccagatgatatcctgctgcattgggggaaaaagtcctttgcagttgtttcacagaattaaactttctcatcttagcagtatggctgttgctaccttttgaagcctcataatgagagccttctcatcttagaaaaggtctgacctagtgtgcttagagttattgtttttcactttttattccagaacttcaaaagcatttgcagagaagtgctatccttacgtagtagacaatttggtaaaatgtccttttctgagttccatggcattattctgaccaccagcaagaaaagggctcagacttagaatactgcagtgctgctgtgcttttaatgccccgtccaaaactctcaaagaaatggagaatgggcaaaggagcccacaggcctcgatactggtgctcaggaggcagtgctgtccaaaccttcagtcttaatgtagataactaataaccagatcaggatttaccaaagtccctccaaggcagagacaggcatggaagacaggaaaccctattccagcagcattatgaagagccacagccaccatcatttaaagcacagggcaaattctactccagttcgatgttttattacagcatgtgttttcctttgttttgatagcagtatatttgtcttcttaattatgttttatgtaaatactgtaataaattagtttgcatctcccaagtgcatatcaacaactaattaaatgtcagcccctcaaaagacaaaagagaatctgctttgtaaatacatagtcataaatctcttgaactacgtgatgtatgtgaagacttttgttataatttttataagaaagaataaaatcctgaataaccctagaaagatattagcgcaactatagaactattgcctctggggagaggcactgggtggcccaagaacaagcatgcacagagccctttccctaggatcctttagttataattttgtacaatgcatctatgacctctttgaaagtaaattacataatttcttgattttaatacaaaatgagaccaataagaggatattagtgaaatttaattatgttttattatttttaaaatctagaatattcatatctggaaaacttttattaaggaaaaataaaattttattgaaacagtgaattttaaacattgttccactttgcttttaagtgtacttcatgaagtctaattttttattatggaataaagttacaatcttcatttttttcttccaattaacacaggttttgacaccaatttgcattaggacaaatacaatttaatgtgatgagaccatgcaccacatcccccattaaagttggactgtatgattggaaacaactgctaattaaagcctaattgttaccttctgtgcactgttcacttaattagataagtggcttctgacagaacaactggtttatgctcagtgggaaagactacatgaccaggtactatagatggccaaggtctccagtcttgcagaacaacatggattttgagtttctgctccaattaaaactttcagttaccacagtggaaactgaattcatggcaacaatatccaaaattgtgatttgactcagcttcagattcgggcaggttttacaggacccagataaacttaggaggtaggtagtgtttgtgtttcgcacattgctgtctggcccacttcagccaagcttgtctgagcctccaccatatgtgatggttgctcaaaaactgcttctcctgagtccacttagttcaattttcccaggaagaaacaaacacacacacacactcatactcctcccatctcagatatctaagctacgatttgggctggataaactggacaacctcatctcccacccactgtaaccacacctctctgtgccaaacctcagtttagtggccaggaaagcagagacagcagggcagagtgagttgggcatggcccatatatatggttggtgcaggttcaaacatttttatttaatttggggcaagcatcttttattttattttattttattttattttttgagacagagtcttcctctgtcacccaggctggggtgcagtggtgcggtcgtggctcactgcaaactccacctcccaggttcaagcaattctcctgcctcagcctcccgagtagctgggattacaggcatgcaccaccacgcctggctaatttttatattattagtagagatggggtttcaccatgttggccacgctagtctcgaactcctgaccaagtgatgctcccacctcggcctcccaaagtgctaggattggtgcaaggatctttatgataaaacttaaggcaggaaaaggacaaatggccaagatgattatatcacaaggtataagattaaagccatggcaacacaaggagataaagtagacaatgtgggggcattctacaaaaagagataaaatgtcttggtacaagttaggttgattttgtacttcaggggaaaactggcaatcagagtatatgtattttccttctctgcacacctccacttggccccatcttgagacagctttcttctctactgcttattctgagaatagctttcttctcccttgcttacagagccagcagaaactgagagaagaagggctttggtacatggcattaggtgtgtatgtgtgtgtgtgcatgtgaatgcacatgtgttaacctgggaattatttaacttctatgagctttggtttttccatttataaaatggagaatatttctaatattgaccttacaaaactgatataaagtctaaatgagatgatgcacatggaatgcttaacataaaacaaggcgcacacactcaaaaaaaacccaatggtaattattgctattattatagtcaatatataataattggacttggttggaatggaaacaaagcatttaactaaagtactgtaggtattgtgtgtgggcattagacattacacatgtcatagatattgtgctatgggagatgcaaagtataacatatggtccctgacctcaatttgccttcaagggtcagagggggaggaattaataaaccacaggaagaaattgatagcctggtatatattctccaaagggaaagagttctccaaatgggagatgctagactggaggggtataaactgccttcagaaagggaaagaaacatgaaagcattttgccatctctcccccgagaaaggttgagagacaaaaaaaaaaaacctccataaataaactgtttaaacttccctcataattcagtgtgtctacaaacaaaaaagtaggagcccctatgcaaaatgggaagtggaaagtgggtcaggcaagcagcaactcacacactcctagtggaagccatgaggagcatcacacactagactatccagttggggtgacgtggaccagtcactgggacttggcttccacgagaaggtagctcaagaagctccctgtggtaaaaaaaaaaaaaaaaaaaaaaaaaaaaaaaaaaaaaaaaaaaaaaaaaagcattagattccagctactaggattacaggtaaattcattaggggttggaatggaaacaaagcatttaactaattcacactagtcaaccttcaaacacacacacacacacacacacgggctacatgctatttgttttttcagaggaccttttcagagcaagttgggtgtacggtaaaaatctcattcctcgatgcataggaatacagatgcagtgaattctgtgaagctcccacatcctctccggtttcctagggtcctactctgaccaattcagatgaaaattttgtgagctaataaataaataaataagccacagcactttaaatgaaaaaaagaatctttcttaaaattatattaatatcaggcccggcgcagtggctcacgcctgtaatcccagcactttgggaggctgaggcgggcagatcactggaggtcaggagttcaagaccagcctagccaacatgatgaaaacctgtctccaccaaaaaatacaaaattagccaggcatggtgatgtgcgcctgtactcccagctactcagtaagttgaggtgggaggatcacttgaatccaggaggtggaggttacagtgagcccagatggcaccactgcactccagcctgggcaacagagtgagtccctgtctcaaagaatatatatattattatcaaattgaagtgttttgaaggtgtttgcagaaacaacagatgaaagaactgagtgtgaaaatatcacgtgaatcaataggaatttgaattatcttgaatcctttaggcttttcatgccattgcacacaacaagctaaatattctaatcaggtgaaaattagggcatcattttatcaggtataaagccaaatatttggggcactatctcatcttaaatcacaccactgactacctaaatgtcaataattcgtaaaagcctgtattggataaaaaggtcagaaacaagttttcccctcctggtcgggtacaatggctcatacctgtaatcccaacactttgggaggctgaggtaggcagatcgtgaggccaagagtttgagaccagtctggccaacatggtgaaaccccatctctactaaaaatacaaaaattagccaggcatggtggcacatgcctgtaataccaactactccagaggctcaggcaggaaaatcgcttgaacccaggaggcagaggttgcagtgagccgagatcatgccactgcactccagcctgggagatacagtgagactccatctcgaaaaaataaataaataaataaaagaaagaaaaaaagaaaaaaactcccctccaaaccttagatttaatattttctcaattcagttaatgcaaggacccatgagaagccattttacacctcaaagtttctaaactcagggaaattgacaaaaaatggtcatcaaagaaagccatatttataaacaagcaaaacaacttagtaaattttttcaaaaaacaaatgagggggagagtcaaagtatctgaaaagcatttgaaaaatgctggtcttgaaaaaaaaataacaatgacattttaacacgttttgcaacatctgtccttgagaaaaaagggtcagttttcattaaaaaaaaaaaaaaaaaaaaaagacagtgtttatagacctagaaggtctttcaaacataatggcctaaaatgaatgttttgaaggtgaaaataaagtgcatataggattttccaaaatgtctgtgctgaatgtttgacatcacctagcccaaacattgcatttttctaattacaatagttcaaaaaggttaaatgatctgttcatagctgcacagtgaaccagtgatttttcttacccaatgatagaagaagccagttcctccatctacactacattccactaaatcacatcagctcataaatctacagagttcacaaaaatgtttagtgggattgtgcctttgatttacagaggaaaaaaatgtgtttttctgtaattttctctagggactctcacttcattaaaactttaatttccaagataagttatccaagatcatttccaaggttaatatagcatttgaaaaacataagtcacctctcttcattcaactaaggcaacacatagccagcaaaaagcagtgacggtgagagattcgcaaggggaaaggcagaatcgctccactcaaatctgttctcttttttcatttaatctgtaatcagaaagcaatgctgacaagccctttgaggtcctggagtgtgctaagacacacatcaagtatcactcatttaaaaataaaaggcttgttgttcaggagcatttgtgttggttgtgttgctattttattttctaattttcatctccctggagtcaaagtacacagcatcatgcttccataaaaacagtaattaaagcttttaaaatatacatattagcagatcacacactcctatcagtttatcttgtgaatatcataaataccatgcacacaacagatagaaattgcataaacagaaaaattctgcattattcatgaactgtagtttgcttttcccttggctccatgctactaaggaatatgtgtgcttgtgtacatattccctgttaaaaaccacatctttaactacaacatagtttatgttgaggtattttaaatgtgaggattattacattttaaaatgtgagtatattgcagttgagtttatcctacctcacacttgggaatgaaaggagatcatccaagacataaccaaaatattattgactcattagtaaaaatccaaagagagtatttatcaagggtgggtcatattttcaacagctgtccccctgttgaatatagatatttcgtaacacaaacaatataaaaagacactagcaaaaataaccacaatatatgaaataggctcgttgtattatttctacccaaatttaaatgattcttttcactccctccagcagaatcacactccaaaagtgaaatttcttgaatggagaatttacaatgagtttcttgggaacagactcagagatgaaaacagctatgagaggtactcccaagaatacacttgcgaggacgcgaggaaggcaggactgggtggaggggaaagctcaatggttccaacagaagccttaggccaattctacaaggagctctagagctgagctgacccttcagctttgtttccagttgggtatgaggttccttatctgggtgacagtttcaatcaaagcccaaaccttggggtatttgtaatgaaccaaatcctccacttttgtgaaatcatgaatccagaaggagacatcctaggcatattatttagaattttgcaagttagtatcagaataaatataaacagaaacagtcaaaaactgttggtgtctgaagctgagtatgttcttcatgaattttgcattttccgcactatacaataaattaatgtacttttaaaaaagaaagaagatttgttccagttgaagccaggcatttgtacccctgcaccagctagacagggctgtacaccagcatgttaatctagggccaggcaggtccctttggctgagagcatgagagcaattctccagtgagaggcagctataagctatcagttgtccattttctcagcatctgggaatcatgcttctgacttgaagcagggagctaggaagagtaccatagtatccctacaaaggggattttaaattgtagcaagcaccaccaattgcaatttcaagctagagcaatcttgattcaaacttttaacatctacaatagattaagggttcctagccaatgaaaggcaagcacctattaaacaaaagagagaataaacaaatttttaattaaaaactgggaagagaggaaagacaaatatatctttttctcatcaattcatttataaaaacaattgttctcagcacttaaaactataaaaataaaaaattaaaatacaattaatattgagccttttctcattctagtaataagtaatgtcaccccagatgaataaactaattaaaatatttaaagcccatctgtttcattaacagatgcattttaaaacaaatatagttatttttattggttacctaaatctaaaattattttgatcaatgatactaatgaaaatctaattcagaaaaaaaaatttttaatttatataaatattttcattatagagaggtatgaaagagtgatcaataaaagcctttaaagtatagatatattactttaagttctgtgaagaaagttaaatggaaataacagttcatggaggaaaggaaaggatagaaaaatttccatatgttaaagaagagattatttatgtattttaaatgaatagcagtagtgaacaaatcacggtagtttccagatataatcatatattcttaaaagagagatgtaccatttttgttctaaaatggaaacatttacattaaaaactacataatttgggactgtagtatttaaatttgtgatataaattttaggcttcatttaaaaatgtgcaaggggacagatagatttccaaaattattttgggggtgggtagtgcaaaagcaaaacagctgacagagtacctgtttttaaagtccctcccaactcttagctacttattgttataaatggtgtgtttcccatggccctgaaactattgcctatccagaaccttaggactaccaacagaaacatgtttaattaaatgtcaagaaagcattttaagaaccctacccagcacagtaaaggaacaaaaactgatcacattaaaaccacgtaggacagagaatattggaaaatgagggggtttcaaggtagagaaaaatccaactcaccaaactccagaagggcaaaatagtgcatggtatggagtcaaaataatcatagtctcaattgtagcgtaagccgaatgcagtattgtttttattgtcatgaggtaactcttgtcttaggcggtgaacaacctcttgggacgaaagacccctgggttctctcttttttgcaacaactatgaccacctttgtttatttctctgactgccctcctccctttattctcattttttatctttctatctctctgcttaaagaccccatcttagtaaaaaagaaaatattatagttataatgcaaaagggaacaacataaaaatcactcattattttaccaagaacaagagacagattggccaaaataactttacaggaaggaagagttaattaacaacacactctggtcagtctcttaaatccctatatctattttcattccaaaaaaatacatattaataataatatgtgtgtgatttaccccactcttatctaagaaaacattttaaagaacattttaaacaacagcatttaaagaatgccttgctctgttgtaaatttgcttactcccctcatcttagtcagaattgatgtgttcatatgatcactttactactttcaaagattatttttgcatctttcattttagctcaaaattaatcagatctttggttcaattacttccaaaactttttgaagttagagttaaggggggaaaaagccaacagacaatttttccctgcttagtacatcttttgctacttggctacaacaaacacacactggacccttgtgtgccaggaagctggtgggcccagagaaagggctggctctcaaacctacttcacattttaattttgttcaatatattttcaatgaaatttggttgctcttttaaaccctaactcaaaaagagttcaagatcagcaaagttacaaacagctttattcataaccagaataatttgccaaacagagcagaggagctgggcaagcactctagatcgcttttcatacataggacttcaattctgagactgccttttgttactaaagcttcttggttcaatttgacatgcatataattttgctcaatttttctcgtatcaatcctaaatgtccattccattaagtcaagctccctgagtttgcttaaatttccctttcacagttactcagttgttttccgaaagagcacttagggctccttcgtttccaggttttctctcattagaggacgttagggaataaacagatgaccctgattccaattccccaaccagttccacaactggtctgcccaaataggtgatctttgtgcatcttattccatactagttcccactgacttccttctctgccgtctcaggcctccttcaaaacttttcatttgtttgttggtttaatatgacatgtttttttaaagaactaaggtaggtcaacctgtttcccaggctataagcaaatggaaggagagtatcaaccttgagcatcacacaaattcatcgaacacagtaaagtctaacatgcaatagtcccagaaacttaccaaagggatctcaaagcatctctgaacctgaatccccctgacctccacccttcacctcccacaggagagctctgagggcacagtgctccctgggcagccctgtccccctgctattctgttcatttcagaatctgcctttctctgcctccatctttaagcttctgaaggtgaggaaccatatctctcttctccttctccttctcttgacaacttcagagctacaaataacatactctgggcacagctttggaaatatgcattgaatgaagaaaacagggaattatgattctaacattattatcagattaacaaggactaattacaagtctgacaattgaggagggcaaataactctctacctcttcaaaatttacagatatcctgacattacagccatctcaacacatattatgagttgaattatgatgggcttctaccagcactgccaagcatagcttacaaaaagctttgctccgtaggagtctattgtcaccaggctgcatgttgcaactaaatccaaataaagtctgtgactccacttccccaccccccacagtgcaaaacacttagctttctgcaagagggacagaaaagtaagctgaatgctgccagttgtcagccttttttacatactgtggcaactgccacttttaaaattatacaacaccttgaaagaaataacaaagatggagatttcttcgaaaacagctctaaagcagcctgctaagcaggagattcacgcctgcagccaacatttaccccgtctgccttgcaatttcaggatcagtatacatcaaatcaagtgaacaacccagggaattctgccgttaccttttagaaacagaataaatattaacagagctttacttctttccaccaaggaggactatatgttaatacagtaatttacactggaaaaaatataaatgaaagggtttagaacctcataactttaaaaataacataattcctcctagaacattcctttcacttgtgattctcaaagcactttgcatttcccagctattggcagggctggaattaggatcaaagtatcactaaatggtaggtgaaataaatgtgaagctgattttcaggagtacaggaatggagtcatcaggcgactttaaagttaagaatctgttggagcagctgccaataaatcaaggcccaaaggagaaagttctttggaaaccttgaaatattgtatacatttagataattattgttgttgtcaatgttaacgaaaaaagcaataaatcagggagatggcactgatgagtgaggagaaatagactcaacaatttaaatggaatcattccttatcctccttccccaacaagcagcctcaacagtgtttgcttctgcctgccaacagccaagccaagtgagaaaacactatataccctccctatatgtcccagccatcagttaccagcctctttagatggcactaatgaaaaacaacctgtaggtcttcctgtctcctttaactaggagacagctcagtctatggtactaataggtattactcagatgctccagcctcaagaatgaggaagactgatgatacctttggcctgagaaagcctctgggtgagaattcagatcatcactcaggagtcaggtcttacagacaaggtggcccctctcctgaaatgactgaccagttgaaaagcaagcatcgagtccctccgctgcagcacattatttggccttagcctaaccttttcctttactgtcttgagttgcactccataacttgtaatacttgagttggctgcacttgcaaaattaacaatattggtccatcgctgttgctcaggaagatcctttcactctctggacttgctcattaattcccttcctttgccattaattactttcaaccaaatgatgaaatgttgtcattttttaaagttctgtttattttgaagctatcacgcagtgtcatttttattgtctccttctattcttactttgaggctctaaaccatcatttaagattcagaagcttaaaaaaatatatacaaatgtatataggttttccttcctcaggatacatcattgggtggctccaagaaggatccacagccttttatgaaactatttgagcaacttggtcatcacacaataaacacaacaaaaatactcattaagtgtgttaaattcatcctttaagtcataatccctggaatgccatttagtttcaacactcaccactccctacagaagctaggcaaccatctggaatgatctcctctcactgtgttgttaagttcattatgtataatttatatttctagatcaggggatctcaaccggaagagatatttggctactgctggagacatttttcattgtcacaacttgggggctgccactggcatcatgtgggtaggggtcagagatgcagctaagcatctgataatgcataggacagccccgcagataaaaaattatccagcccaaaatgtcagtgatgtcaaggttgagaaatcttgttctagacgttctatcttgcctaagttgctcatatttggtatggaaaggccatttactcatcagcctgaagagttcccataaaacctgaaagaacaactcacctatgaagaaaggagtgggaaacagattcttttttggtgggaactgaatgtcaccacccacatgctgtgaaggagaaacatatcactattcactcttctaggaaaattaagtttaaaatttcacaatttacctcttcttttggttcatatgcaaattataaggtactaaaaatgggagacactgacaggttaattgctcccactcttctggtccagctgcacagagctgaggcagagggagcacagagaagtgagagaacctccaaggtcagcatgctccagcactggatacatcagcatatcatgggttttgagttagaataactgataacataacacatgtacttgaagttcactgatttgattccagctttttaaaaataatcttttaagcagaagctggcactgctttttactcctttatttttttctctgtacctcttaaaaataaagtataaatctgacatatgtttcaggcaaattggctcagaactcagaaaaggtaaaaagaactctcctagacagcctatgttcccaaataaaaattatctctagttcctatgcctgcatcaagcctttctaattaagtgatatttggtcctaacagccaggttaaaccaacctacctttatgtcagatctgagccccttccccacagcccacaaccatatttaccatccacactactgtgtgtgtatgtttaggctatttatataattctgattagaacattttgtatccttcctgagataatatgcttttcaaaagtagactgtgagtttttgaatcatctgaaactcttcttttatttttgagtgaaaaagggaatagggacgacgctatgtacattattttaggcacacgtttcctcttcttaaagcactcttctcattcactgatgagtagcggttgactttgtaattttcaagtggccaaagcagatggagtgagagaaagaaaagtcagagacagaggtgcagctagatccagaaatgtgaaatggatccacaggagaagatgtgcagactgagaaggtcagtatttacagaagaggcaagagactaaagggtgcatacagttaggcagtggtagaaagaaaaacaaaaaaccctatgaaagcatggtaaaagaagaaaggggattcgcatcgctgggatgtgaatagaatttgcaggtgctatgcctgcctctcaatccagagcccaaatctatttgcctcattctatacctctgagtagctctgagataacacaggatgaggtttgggaaagccacatcattctaccagatagaatgcctggcttcaccatctactagccagatgatcttaaccaagtcgctcaactctccccaaactccatttcctcaaagtggggacaatcatttattcacagcaggattgaggtaacataggtaaagaatcaagggcactagagaatgttacatggaaggctctatgatcacatcacgcggtattctaagtaatggagataaaacattttaacaatagtaaaagcaaaattgaattataaacattgctttttttaagattggcacatcataattttacatatatgtggggtacaacatgatgttttgatacatgtgtaaattgtataatgattgaattagggtgattagcatatccttaaacacttattgtttgtgatcagaacattctaaaacctttccgatagctattttcaaacatacaacatatcattgttaactagtcatccaactatgcaatagaccaccagaacttattcctcctatctaaccatagcttagtacccattgaccaatttttcaccatcctcttcctcccctgaccctccctagcctctagcaatcacaattctattttctaagtcaatgagaacaacttcttagattccacatatgaatgaggtcatattgtatttgctttcctaaacctggctgatttcacttaacataatgtcctccaaggttcattcatgttgccacgaatgacaggatttcattctttcttatgactgaaaaatactccactgtgtagatgtacattttctctttccattcatccactgatggacacaggttggttctatatcttggctatttgtgaatagggctacaataaacacaggagtgcaggtatctttttgacatattgttttcatttcctttacatacatacccagtagtgaacattcttaatacaatggcaatttaaaactttatgagctaaccactaattcccagaaaagaaaacttgatattctctaaagaagactttaaagcaatgcaattctaagatactctgggagtaaaaaaataaactacatgcacacacagttttattgctatcttcttccatggagaagaataagccactatcaaaacgctcatagagacatttctgttctaaagaaaacagtagtcaagaatttaacagacccaatctcagtgttacaacaactgtgcagaaaatacctcaatttactattagctaaaaaatcatttttatattttaaaagatcatttgccacaaatgagatgaataggcatttcaatgctcaagacattacatttcataattattaatggggatcaaataaaagcccactctgtgtaattaaattggaatttaatttcccggaatagtggcaaacatgagaatcagagaaagaagatgttgactcagaaaaagaaaagtaattaataaggatgtcagaagtcacccctgtttcacacaactccgcaggcagagcaacatgcaaccaacgcagcaaatgtgaggtccaccggtgaagcgctacagctgagatggccccagctgaagtgctgccttgatgaggggagcactctgctgcagaactgtgccaaccagagtaagctgagaaagcccggaacactggtggctgggttcaggaccagcccaactccatcatggctgtgcagatcaagcccatattgcacagtaaaaaaaatatgcacatatatttacaaattagtattttaaattgtttagaaaattcccctcagaagccaaattctgcccgtttcaagagaggactctctcttgtattcgtgtgctccattttttactagcacaatctgccttgggaccttcatcaattttgctttgcccaactctgcaaatgcagtattgattccaagaggaaatcaatctcagcttgaaagaagatctttcatcaaatccgtattttctcctcaatgccagagctctgcttgaataaaaagccctgaccacaaagcagaagtttccttccatctgatttgttcagcaaatattactgagagctagagctttgaccacatcagaatagaccttgactccacaagaaaagggtctaccaggcccacgctggacctgcagcacgtgggagagcacagctggccatgggaaattagaatttgaggggagagagcagttttttgtttggaaactgtaacagaaataggtagaattcctagttgaattgtggagaactcggaatcttctgggtggttgcaagaaaacttagaaggaagaaaatatcaaatattagaggaaaaatcccatcattcaggttggtggtcaatgatggggttcccatcattgaatcccatcatatttatttctatgttaaagggccaccaaattaagctagggtgccataactctcaccctttttaatctttttcttttcgcctgcatctatggcacatccacttaatgtcaccaccttggggtgtttttatcctcatttttatgcttactcataaaacgatacactcatatatatgcatttatatgaatatgtagtaatataaacctgtacactcttttcattttataaacctaagattataaattgctctcttaagagcaaattcatttttaactcatcaattttcatgtctgcataatattcaaattgtcctttttatttttaattttaatttttatgggtacatagtaggtgtatatatttatgcagtacatgatgtatttggataccggcatacaatgcataataatcacatatcacatcagggaaaatggggtatccaacacctcaagcttttatcatttctttgtgttacaaatattccaattatactcttagttattttgaaatctacaataaattactgttgactctagtcaccctgttgtgctaactcaaattgtcctctttttcttttgacattttctcttgcttcaaagcagctacactggttggataaaagacattttctgtttcctgtgtgggcctttgggtgttgcgtccactcccagcatctctggagtctcccattgcctgcttacatggaggtgcattttcttgccctacctcctggggctgctacctccatgcaatggttaccccagagacagaagaaggacttcttcacccaggacttgacatcaacccctgctccctagatttctactgctgagtgaaattcttccatttcatatcttgctaaagttagttgtagaattgaaccttctgagcttgtggaaattggtttggaatttggatatatgatacttccaaccatgaaagaaaaagtaatatgcttcaggcagaaatttacaatgtttactttttaacttcctcctgaaattggaaggctggattaccattttggtggggttcagctgttgaaattgatactaaaatatactcagtttatatatctcaagccccaattcacaattcacagttctgaattctattaaatgatcaaagtgaagccaataatgacaattgaaaggcaaaagattttcttttagttaagcctgagacatgttcagagcttctcaagaaatatgtatttgtgaaacctaacccagggacattacttgtattttatagtgcggttatggttgaatttaatcttgttaacagtagcatttatactaataattatcattggaagactacatttgtataagactaagtataatacaacataagtgtaagtgatgtaatagtaagtgatgtaataattccatataatgtagttttcatatgataattattaatatgaataataatattccagtaagtgaccttagatttctggatttccattttcccttccataaaagctaaaagttggatgaaaattgaatttctaaaatgtcttctgtatttagtctttttgaattctaaacttttctgctcatacgtcccaaccctgtaagagaaaagtgcttttacttgagaagaggcatctaatttttaatcttattttagtaattctcttaacaaaaatatgtgattatatttttcatttaagaatggaaatgaaaatgtcatataagcaattcactaagaagatagattccaaagaaaaaatttctaaataagtctcacttctagtcatcaacatgataaactctagatctacacataaaatccaaaatgtgtattttatgtagacattccttttaaaacacagaaatttaagaaggacagctacatatcttgaagtttcaagacattagatatatttttacttattgtactcgccaacatacaattcaaaacactgcagacggttgaaatactgccattattctccttagttagtcttccctgtctaatgcacaaaagtaaaatatttgatcacgttcttgctttaaaataacagagtttttcaaggcattatatacatttttcaaaagcacattttctaggttgctgtaccttctcttggcatcaagagtcacttcacatgatgtctgcaagttgcatttactaatgtgctccttattggattcgtggcacgcacaccttccagagcataagattatacaagttaacatcagcccggctggctcttactcatgctcatgagacaggcctgttggtctcagctcagcctctctttagcggtataatcttggacaaatcacttaatctccttgacattcctcttcctgtctgtaaaataaggaaatgcactacacaggggtattgagataacaggtataaaagtgaatgacagtttaagagtactctgtaaataggttatggtagcattaacattcttcatgttagaaggagagcggacatacaacagattctgtgaaagaatgtttcccaagagcccttgcttgcttttcaatgttcaactaactctaggtactctagcaatgcaaataattaaataacagaatatttacaaacatatctatgtgattttaggcaaactgcattatggagacaactcttatcaaaagagaactaaatttggggattaagtgattttttttcagatggaaatttaatgaaataaatttgaagccacagttatctaatgaacacaaacccaccaataccaaaggacggaaggttaaattttagaaaatttaggtcttttaagaaaactgagtgaaagaagaaactaatttgataagatgataaatctaaacccattttctatctctgctccacagaaagggatccgaaaaacaagctagaatcctgtccttaaggagctgagtacttgagagggagaaatttcttttaaaaggagaccgcatataatagaaacatgcacagccatttcagcctttcagaatatatgtttgagggctgggttgatatgaatgacatcacacaaacacacaaacacacacacacacacacacacagattttaagtgaaaatgtgatcacaagctctttgaactaacagataatttacaaagaggtgagatgaaagtcatgttgaagttcaattgcaaatgtagaattacagtgcaataaacatttgtcaaatttttaaattattaattattttatgtcattgcttaatttcctaactagactacaagttccttgaaggtaaaattcttgtcttttgtatttacatttccaatactaactaaaacaaacttggcatctaataaataagtgtccactgattgtctgaaaccacttaattctgtagacactagaaattctatcacagattagaaaatgattaggagtcagaaattgtttatctttagcaacaatactttttgattctcaaaaactggtactattatgaaacttattatacacctccaaatcctccttaccccatacagtcttcagagactatgaagctcagtctcactctgaacacagaatatagcaaaatgcctgtctatagcatcgtaagtatgtagtaagtatttgctgaattcatccactgctattcctagggtttttcgaggactttgtttacactgttattatagcacttacacttatgtgtattatacttagtcttatacatgccatttcccctaatttgattgctagatcttctggcagggttcattttatattcagccttgcactagcacagtgtttggcagacatctggtcaaccattatttgtttgacaacgtatgtaattttgaaagttgaaggcattattaaagacatgcactgcagccttatatcaaattaagaaaccttgaccaatggtttgccatcgccagcttaaatacctccagtagtcataagctcctaaggcagtcctagttattacagagaagggcatccctagctgttaaagaattctcttttgagctgaaataatcttccttgtacctccttcccactggttgtaactgttaagaaaaatgcagaatagcttgttctactacttctagaggatactcttttaagatacaggtcagcaatcctgtctcactcaggatgtttcttccccagggtaagcatcccattctccttgagtagtctttgtggttatcctgctcattcttcatgaacacacactcctctaatcaatgtccttctcgaaatacagcatcagaaatgaacatagtcctctaagggaatctgtccagcccgaagtgctgattacataccaaaatccaggtcaaggcctccattaacgcagcccaagaccctacttaggagaaaatggaggaaatataatgaaatcatattttaagagactatgtagaaataagctctcaatagaagtctttcatcatctatcgggatgctatctgggtcagttaaactatcctggaatatgctagctttcactttgtttaaaacctcattttctacagttccaaatataggtttcaaattacctagagaaaaatcaccccagaaaaatgctaaagtcacaagttcacacttttaccaaaatttagtatgagtgggggcaagggtgtatgtaagaccactttactaaaaaatatggctggtgactctgaagcaacatcagtgactagctagacatagagacaggtatctggtttggggaagagggcaatgcacagaaactgggagcttgtcagttcaagagtgaaaactgtcctggctactggagatccaaaaggcaccaaaattatttatttgtaaatcctcccaattaattccattttcagtgctgcccctgggatcactgcaagtactcttgtcagctttgtggtttaaatattatttaagaaggactagaattttgttaggctccctcttatttagatttgatatgatagttttattctgcttttttcctctgcatggtgacagttatttacgatggcctacggctttcagaaggacttttggtctatggctttcagaaggactttactccacttttgaaacacttaaaaatcaacagggtctttgcctatattttctatctactgtcataattcacatttatcctatctgtttcaatctctgtaaatatctatcccaaacgttgctaccacagtttaccagcataacttataaaatgttctgccctagagcccaggagtttgaggctgcagtgagctattgtcatgccactgcactccagcctggatgacagagcaagacgctgtctcaaaacaaaacatcctaatttagaatattattatattaatcttttttagttttcattctgatataaatgacagaataacataatggtaataagaacttgaattgagttacagattaatcaggatggtgagagatacgtctctacagcctctgaaatggcattatttttctatcatttggcttctcttttcatacataaacacgtataaacatattgtaactaataaagatatttggttgtgaaaaagtagaaagattattttcatcatataactttttcctatcattattaatagtaaaaattaaataaagaaaacatatctccaaaaggctctctcacattactatgcattccaacagcccttggatgaaagtagctctcccccgtattacatcggcagggtctttgcagggcttgcaaagaaacaccagattaaaggaatttttagtgtaaaaattagtaataaaaatgtcatttcagtatcagatctgtggtggagaagtgatcttttcctaagaaagaagatatttcattgtactgtgtaaaaccgtgtgctcagggttataggggtgtcaactttttggtgcaccatcatgttatagattcgaatgtcgctatgctgaattaatagatcccatttatcattaccacaagttgtcctaggacaaaaagagggcaacattcagggtcctatccaactgaaattgacaaaaaaaataattttaaaaagaaccaaggattgctgaagacagtatttctagatggtaacttgtgtcatgtataccaaatagattttaaactattcaatatgctgctaagtatcctcatgtctctgagcctaaagaaactatactacataatgtatttccatcaaatataagacattatataattactcaaacattagctttagttttatccctttgagcaaataccttgatgaacaataatcatggctgtcttaaaagatgcctcgaggaggaaatgtttaacacactgtaatctaagttggtgcactgaactgcaacctcgtcctcaatgctgagccataaacattttactctctgcttcccttccttcacagaaatgttctaaatatcttccctatgccaagcccccaattcccagcagaattccctgaagaggagcccttctgagggtcacagtcgcagcctctccccaaaacagcacatgcttccccacgtctcagccctgtcttacctcttgatttagaaagctctcctcctccacgagagctcctcctcctgtgagttttgtcccccaggccttcagagctctgaaacctgcttccttctttgcagctcctctttcaatccctctctctccctcctctcttcactggcctttccccttagcccatggacaaggccttgaaccccaaaaaaatctttcttcaaccctgactttcccctaaatctccagtacttcaacatccacctcttcaaggtgacattgctagacagagtaactatacctccacttttaactacccgctcattcagggctagaccaggctagccctccggacaggctaattatttcaagccctttcaaaccattattttatcttcctttattttatgctgcactagagaagacaatttttatgaatgcaaattgtatgtctctccatcagttcaataagggatttatttcatgaactaaacctatgctgttaactgatttagaattgtccttgattttgctcatttccagtcacctctaactgataatattaggtccctgagtatacattaaaggcagaagaaaattacagattagaaggctgattcaaaaatgtttataaaaactgttttgactctcagctctgcaaaatatatcttctttttggttttctattgcaatattacaaaccagactacttcttggagacatattaaagcaattaacatttaggtaatgaagtaaattatattttccttgaaaacaagattctgccatgcatcttttcagttacaggatgtacatattgtaactgaccacttgcagaaactgtcattgagatagtccctgagctgaggtcgtggccgcatatttattcattgtttcaatttgtgaaagcatccttggaagagtttttacctgtccacttaaagttcttggcaacttcagttgacatcgacattgacattgaattgacattgggttaattatactttggttcacgcgtgttgcaatttcctccaaatgatagtgcaccaggaagtctgccagctggcccgtcccttacagcacacttcctaagatgctatatgtggtggttacaaaggtgggctcttcagccagatggcctgggtttgaatcagaacttggtcatttattggctctatgatcctaaggtagccatctgacttttccatgcctcagtttcctccactgaaaaatgaactaatgctgaaacctatctcactagagtgttgtgaggattctagctaatagaccaggaacaaagaaagagctccataaataatagctagctatgctaattttaaagttatcccatttatctcctaaaactattcttactgctgtctgtataatgcctatttcaatattcttattttcttattctattcaatttttcacaatagataatattttggaatgtaatatttttgagatgttcttcaacatttcagcttcaatacttcagcaacaatgcttcctcctggctttcctcttatttttctgaatattattcagtctccttttgtaagttctgtcttcatctctgaaatctgcttattcttccagtttttggccttttagttctcattgtacctgatctctttagggaacatcatctactctcttacaattaccactttgattatgatggttctcaaatctatgtctgcagcccacttaagccaaatctttatttctaacactgtcagcacattttctcatgaacagccaccagaattcaatttatcagtttaaccacacattctaccttccttcctctacccccttttcaaacctctcttctttctgtattttctacagaaaatggttaatggtaccaatttttaaacttgacatcctagccgggaacattaagatcatatttaactccatttcctcccccaatatacatttaagagccacttttcctatattctatcaaattcctggagcttattttcaaacatgactgcctgtctagtcctggccatttttcttcccagtttaatatttaatggattcttatttttctcaaaataaagcctatattattattataacactcaagccctatctctttctgcctcccattccatccaactagggaatcctataggctactcctttagggctgttacatactctcttgcttcatggaatttttttcttgctttttctcagtttggaatgtcctagcctatccacctgccaagggagatctacttcttttttcctccatgcaatgcttaaatgtctcatctttcctaagcctctcttccagtcaaaattaatgacaaagatttggggcacttgcctttattctattttttaatactgggtcttcctctcctactatgtaatctctctgagagcagacacaaaattgtgtacatttttgtcccctatgcatccccaccctgatgtctatcacaaagacctgtagtaggtattcatgtttcgcaaacataattatgatgtgtacaccatgaatattactctacatcacacaactctatgcaacgtcagtcatacatcttctaatgcaaagttttactaatacttatctattaataaaactacattatttatactctgccttcccaaaaggacttcttgccacgtagaataatagatacaggtaatataaaaatactaagtatgaaagaaggagagtcctcagtaaaggggatgaggaaatgtaggattctgttcctcccattgtgttcgcagaataacaggtgggtactttcaatcaagcatacataccatctggcgtcttgtctgctgagctacgtaaaccacccgcctttgttttacatcatatattgcatgcaccacatttttgactctcagacacttccagatttatttattttaaatatgtttaccaagggaaactctgcatatgatactcttcattcctcattgaataacagccaagttttcttattgaacgtttatgttgaccaacattttctttcatgtttgctaactgtgaaatggcaaaacggaaacatgctcttttgatttcttcctcatggcagttttccctgtttcaaagatttgttttcatccaaaatgaacgatgttaactttatcccactatatttatcctcaggtatgttggacagtttttcttctccaccaacacaaaatgtagtttctagtttctcaacggtagctttaaaaaattaagatacattcctatgtggtagggggtgccatttaggaaatggtgaaaacgaaacaaacagaacactaaagtcaatcaaaatctcattatcttcctctctaacactgaaggtgccctctgccccttaaacttactcagaggtattaattgaatagcatatgattaaagaagcttgaaactaaaattgcctaatgaatacttaatatccttttccttgagattgaaaacaatgttctcctatccattcattcatctatcatattcaattatactaacattatctgtactcactgatcctttcttaggcaccaaaccctttgctaagttttttgttaacattatctagtttcatattgaaagtaccccgaggagttggctataataattcccattttacagataagaaagcagaggcttagggaagtcaagaatcctcctgttattgcacactaaataaatgctagtatcagaatttttgtttcagtgattctaaaagtgtgctcttaacagttctgctatactgtcttctaaacatagcacacctctgtcctatgcaagctgaatattaaaatataaaacctcctcttccattgttaggtatattttaagcacagtctcgaatatattttgggttgatttaaacatacagttctcaagactactgaatgttgtcttctctcctcctaacatcattttattttaatgttcctttatttcatattctcacttccttctgtattgaggaagcagaatatctgtttttcttggctgcatcttgaatggttatgcaccccagggaagatgtcagagtccaaccttgccctaacacgtagaagacctagaaggagccagtgctgcctgggagttctcactcacagcagactttgtgagttttgtggataccctacgtttgctagactccaaaatcttacatgattacattaagctctgttgtcctaatttcatttaaatcatgcaaccaacaagagtattaataactaatgtttacttagtacttaagacatgcaggactccatgcagaaaatctcacatgacttttacaacttcatccccacaacaagcttacagcttagaacgactattatcaccgtttcacagatgatgtgtggcgcagagacatggtgatgaataggagaaatgaacttatattttgtgggcactgtccattattctttccactatttcttgctactggtaagggtaggtataaaagatcctaaagttgtgactaatgaggattttcatggcagacaactgcctctacctcaacatgggctgctctcttggcttggaagacaccactctcctggctgtcctcttccctctctagtccctcctcagcctcctcttgtggattctccttctttattctacctcaaggcttctcaggccttggtcatggttaataaaataagtgttgcatttccaacagctaagtgtgtacttaccaatggctataattggagatttaggatttaatgaagactaaaggagttttaattccaaattttccagattaactctgaattgtgacagtggacagatcagaggtgaacttagggtgaattatttgagcatgctgtggaaggcttcctcaaactgaacagccttctgttattcaattcattaaatgacgattctattccaggcattgtactagtcactgatatactgctgtggtctgaatgtttacattcctccaaaatttacgtattgcaatcctcacccccaaggtgatggtattaggaggtgggaatttggggaggagattgggtcaagagggcagagccctcataattggaattagtgctcttataagaaggtccgagggagcttgtttgttccttgcaccatgtgagaacacagctagaagtcactgtctatgaggagtgggccctcatcacacagcactgaatctgccagtgcttttatcttggacttcccagtctctagaactgtgagaattaaatgcttgttgtttataaaccactgagtttatgatatttctttatagctgcctgaaagaacagactaagacagataccaaagttaagaagataacctttgtccttaaggagctccctgtctaccagggaatagaaaggtataaacaaacactgcaattacaaagtaaaataaaagggtcctatatttagagctccataaaaggtatactgggagtacaaaggaaaaagtggttcatttataccagctcccccttcctagcccaattccagtgttggggagtgggcctcatgagggatgtgactccaggggactttgcaggcggtagcaggtggaaagggtaaagaacagtccagaaaaaggaggtgtgtgtgcactttgctaatatgtctattagtgtgctagtcattctggaaagaacttgtgtcatttattcctcaaagaccctaatccatctcagttataagatcgagtagatggaaaccctctgagcatttatttgtaatttgccataatacctgtaaagagcattggaaaaaaatgcaataatattactgaaacttttattaaatgaatgtataattatagatggataaagccatattttataggtatcattaacattcaaactaattgggggagaagttatctctattcacctggtaaagaaacgatttaaagagttaaaatgacatactcaaggtctcagaggtagtaagtggagaagatggaatctgacgtggggtatcttgattcaaaatgtattatttccactgaattatttcccttttcttttttgtctataatgtcatactttgatatctgtcaatctggtgagccaagttgccactaaaaatatttgtctcagtttctctgtctctcagatacaaatttaatatgttgtgaaatatatggatcattttttaagtcctgaattttaaattaatggtgaaagagctgtttacacggaacagcaggttgcaaatcaacagcttatcaaggtcacataaaataagtactctgctttgcattttgatccgtttatgtctttaaaaagtaatctccttcaccttttggtgtcctatgaatctggaaaaatattctttgtgaacagcagtgacaggaggtgagttggctacaagaataggctagaaatgtttagaaatgagaaaaatcatttaaagcaagagcagaaggcagggtctgtggggtaaaacagcttcatcgatagaattaaagaactgtaagccacaattcttgagatttataacagaaatatactaattatgctattttagaattatgttacttcttcagcattcagtaactgacaaaccagccaaatatagcatatgttatgtcctccctcctgtgacctgtccaatggctatctcgttactcatgagaacctgctagagaaagagcacagagaagtcagatctcatcaatccagtgatatcaagaggacagtctgaattcagataactgactccacctctttctggctgaaacacattggcaaattacctaagctctctaaaactctgtttctccacctgcaagatagtcagtatggcagtaattcccaactcacagggtcattataagggctaaacaaaagaatgaatgcaaaaattctgacacataaaaaatgctcaattaactgatactattattagctgttgctgattgtgatagagaaaatagcctgagactaaagtgcaaactatattagagtgtgctgtggtttatgtagggattttatttttattttttctaatccttattcccacttgttttgctaatcaatagaaagaggcagactactataaacatgaaattaaataaatgaatccctcaataatttacacctaagtatccaaagtcatgtattacacatacattgaacaaacctaactacagttaacattaaatgtttaacatgtttttattttagctattaggtgattaaaagtagaaaaaaaatcacagtcatatggagctacaagctgaagaaaagaataaaactaaaaataactttcacatccacatcaacaacaactttacctaaacagtaagttgcaatgctatatatcctatcaagctatcacaagaaatttaaataagaaataactctaggcaaacattcagtgacaattatattctgttaggttttttatttattgctaataaaactaccacatctacaatgttttattttcagagaagcatttgcaaatatcagtctgaacccttctcttttattttgacatatagaaataaaacataaaattatgaataattaacaagttgattttaggtgaaaatgtaagaattctaaatcccaagtcataagagcaattatgatcttctcttgattcccttagtatagctaatgtatattttaacatatattttgacacaaaaataaacacgatgtaaatcgttgtagacttatttcttcaggcttttcttttacaattgctttaagttaaacaccctgtaacacatgccatgtgggaaagaaatgcctttatagatgagtattagaaaaccctgaataaaaaattacttttatatttgatgacaataaagtagtagttttatcttgaaatgtgcttatatattaggtgaaacaggagaggctttaaccaaattatatgctggtccaaaaggagtgtcccccaccttttccggtgctgcctgctctgcctgagacatccgtgcagccctcccttcttcccctgaggtcttgcccctctcactttctcagtgcagcctcctctggtcccacctcacaccattcccttatgactcatttttctaccaaagcattcctcagcgtctaatatgccatttttgttgttgttgttgttgttttgagacagagtctcactcttgttgcccaggctagagtgcagtagcatgatctcggctcactgcaacctccgcctcctgggttcaagcgattctcatgcctcagcctcccaagtagctgggattataggcgcccaccacacccggctaatttttgtatttttagtagagatggatttcaccatgttggccaggctgttttcgaactcctgacctcaggcgatccacccaccttgaccttccaaagtgctgggattccaggcctgagccactgcatccagcctcatttttttatttaacttgcttttttttgtctagcttcccccactggaatgcaagttccaccagggcagggacttttacctgttttgttcacagctgtacccccagcacctataacagagcctgctactaggaagagcttgaattaaattgttaagcaaatgagtgaacttgggagatcatctctggtgcaactccctaattctgtagatgaaacacgtgactccccatagctgaagatggagtcagataagagaatcttctatgacatcatactgcctatataaattagtagaaaacccagccactgttccaggaagcttactcttgtcgacacacaacccagacacttttccaggaagcttactgttgttgacacacaaaacaatgaggtcagtgagtaactgaagcctctatttgcatcatgctgacttttaatgtgcttctaattggtttctcgtcaagtttttaaacatctatcttcaactgttaaataaactatgctcttccatatttgactactatatggtagacaactgtccaccttacatgaggtatctagattagtcaaaatcagagacagaaagtagaaaggtggttgccagggactggggaaagtggagaatgtggagtggtttaacaggcagagtttgggttttgcaagatggaaagagctctagagatggaaggtggtgatggttgtacacatcaccaccatcaatgtgaaggtacttcataccacagaaacatacacttaaatgtgaaggtacttaataccatggaaatatacgcttaaatgtgaaggtacttaataccatggaaatatacacttaaatgtgaaggtacttaataccatggaaatatacacttaaatgtgaaggtacttaataccatggaaatatacacctaaatgtgaaggtacttagtaccatggaaacatacacttaaatgtgaaggtacctagtaccatggaagcatacacttaaatgtgaagatacttaataccatgaaaacatacacttaaatgtgaaggtacttaataccatggaaatatacacttaaatgtgaaggtacttagtaccatggaaatatacacttaaaaatggttaagatggcacattttatgttatgtgcattttactataattaaaaataaaataaaataattttttaaataataggcaattttcaacatttttttctgaaatgttgagagattacattactatcttcacagtgttcagaattattctctcaagttctgtacatacttcattaatatatatacatatatatgtcagacacattgaatgcatattagtcataaattacatctgagcttatgaaacatacacgtttgtcatctccccagcgatgtgtatgagttatgacattggaacctggaattccatttactttctgtgtatggagaagccatgtgtagaaaagactgtatggatgagtgatactttaaagcactgtttgggtaggagaagtaaagtcttgttattatcagaggaacatgaactctgcttcatgtgcagctatatctcaggtttccacatagaatacagtatctgtcatactgagagctcccacagaacaagattattttgtctggccaaaccaatgtatcatttgaaaattatctgatttataaatttggtttactcacaaagtctactgcatatatgcccagtgaatttctgaaacaaaaaacacaaaatcatttggcagcatttattcctttggaagctatattttgggatctatttatatttttctgtaatgtttaatcatgccaaacaatatgatccattaatcatgtaggataatattaaaattccagtgtgtcattaaagttttacaaatgaatcaattaaagttatgaataattcagagatctaatatccacttagctgtcaatataaccaaatacaatcattcactgaaaattttttgctttgttctttgctgctcaaagtttggtctgtgagccataagtgccctggtcacctgggaacttgtttgaggtagaaaaccccaggcaccacctacatctcatgtaacaaaatccttagctgattcgtgcgcaccttaacatttgagaagggcttcctagggatatataaagatataccatacaaatgttgcaaatttatggtcaaaaaggatcaggatcagggaagaaaatttgtttattttttaatcccttatttcttagcttgtaaaacatattttctagagaaaaatgtgtctcttcaaggcaactggatattttgatgcaagatccctgactttaaaactttgggattgtcagaggcactgaaaccagagtgactctatcttgaataggtgctgggtaaaatgaggctgagacctgctgggctgcattcccaggtgaggcatttttaggcacaggatgtttacaattcagggaacagattcgtaatatttacccaatagacccaggacttgtaacagacccagcaaaagtcctgatgtcccaatatcttaacagtaaaagcattcatagtttaagaattagttttgctttaaagatagtaacataaattcttgtggaagataatagttacacaaagcttggcaatcctttgtcaggaacctttgtagtagagcacaccttccccatgactttttgctctgttgtcttatacgtaaacaagcttcaaacctaaggtgagtgcgtccctcctcttgctttggggaatgccctgctctgtctattctttcatctcttaactttctaataaacttctttcactttactttgtggacttgcccgaattattcgttgcacaagatctaagaaccctctcttggggtctggatcaggacccctttctggtaacaggatcagcagatcagggatgagaacaggaaaaaatgattaagaatggcctaaaattacaggcctttgcagaaggaaaatccttcaacagactcaggaagacttttgcttgcagtaaatagcccatcaatgcctgctgaccctttgacagactgagaactctcaccggacgcaaacaggaagcctgaacctatttgaagagcaaacgactggtggcacaaatagaacgaggtgcactgtcccgggaagccaaacagtacaagtgagtggagttttccaggctgtggaaagaagagcctgatctcgggctagtgcctggtttccctcccccaggactgtgcattgtccaccctctaaaggacctctggaataggagttagaaatgtgcctggggtcaaacaattcacactgagcaaagaaagctaacaagtaagcgtgttttcttgcagcctcttagtaaagtgggtgtctagtaagtccacatggacataggatgcggaaccctcatttgcatcatcagcctagagcaggtgcagggtgattcccttcactcatgccgaagtgagaaaggcccagagaagccaggctggagagtgctgagctctcagagggcctcccagcaggaggggactggaaaggcgctggagtgctgagagttggttgcgcaggactgcaaaggaccacagagggggccgcactaggtcccaagaatgccattctcctgtgtgatcacgcctcacaggtattgctggcaagccaggcctagaggaggctgccaggaacaccgcaggctgaaggactcccatcttctctgttgtttgctcagcttagtgttgtccaccacaaggaagactttctgatagagcgttatctcaacactcccactcacctgagaccttcccacacacatttgccgacattcaaaaaccctagagactcacatgtctgcagagtggggcattctttctctgagaacatctgaaaaacgtgaggtgggttccctgcatccgagcagcaggaggccctctgcacagagtaggggattgagccgggtatgtctttctccagccccagcaaaagccccggagaggctctggaagagaataaatccctgggaatagaggctgtccctcatccctgcgaggggcgcatgcccagccccttgaggagtggtgaatgtcacagctcacaattgaacatctgttactttggtgcaaaccctgtttcagcagaaggagtatttgcaccagatttctaaactgcttggggttttttacacttcagaaaaaaaaaaaaaaagaattacaaacctggttcaaatcaagctaaaaattttttgatattaccagaatttttaagtcatctaagccataaattaaatacatttctaaaaaactgtcttcagcctttcaaggaaaaatatgtaagtgtagaactgacccctgaacactcaatcttctgtaaattaacaaataataattatgagtttaaaatgacaaatctaaaacatcttttaaaagtgaggtgttgatttcaataaagaagtgatttgacttacaactatatacatatgcagatttttggaccacatctattgaggaaatctgtcttggcattcactctaaactggtattaaggacacatattacctaaatagtcatgtttttaagatctacttaagtttcaattatgcagctatttatactcccctaaatctagttagttaccatttatgtacctgggatgtgcttcatgggcaacgttttctttattatcattgaatttgtgtcttaattgaattgcatgcttactaaatgaaataattggaacataagaaatttgtattgtaaaggctgcactcagtcaaaatattctaaaatatattaaagaaaggatttaacaagaatatacaaagtgatggctttaagagatgagataaaggttaatccaaggattaacaaatgccacaattcaaaataaaacaggttgcaactacttttccagagatgatttaaaatgtgtagaatataaagaatgtttccatcttctgtcctgtcttgtatatcctttcaacatgctcttttattgcagcgatatttgttttccggactgttactctaaactgtagaagatacacatttcatcagcatgcttgacactgtttctttccattaaaagccatttatatatctcacatctcaatcagatgatatttcagagagaaactgaacttccctctttaagatgtattttatgaacacagtttataataatgtacatatttataagttgtcaatgagtgagagcattatattttcacgagaagtatttccatgttgttatagccaagaaggcagattcaaagtatagacagtgatatggcagacagccaggatcattgattcatttttagagcaaattagctggagacttattaatgtaattagttagagatttattaatgctatttaaactattaaaataacctcacagtgcttttacacaggtctccccttattttcccttacctcttgctcatttatgtgacttatgtgtctggttcatgtgtctgtccttagaaaggtagtacatataaaataaaatgcacattgctgaaaagaatagcaggactgaatacagttctgtacacctatgacctatgttgcctatctgcttaatggagtggaaagcatggtggactcaaaagacgatggaactcagaggcagaacacttcactgcagctgaggaagagaaaagttcagtaactcgctggttaaaaaaaaacaaaaaacaaaaaacaaaaaacggtaaatgacaaccccaagatcccagcccacatctgtcagactccaaagccctgaagtagcaattgcattgtagaaatgtctattacccagttactgtacagatttttctgtttcatcatactgtggccaaactggtttttttggggtttatattgcttgtttgttttctgttcaaagaaatgtctagtgtacttatcagacgaactaaagatgatagaaattaaaagccaaattatatttgttccattagtgctacagaaaagtgtttctcaaacattaatcttgtaagaaatgcagattctgactcaatacttctgggttgggcattcctagccagctcccaagagatgctgatgcttctggtgtgaggaccacactgagtagcaaggcttacggaagactcctaccaattttctgctttggaatttgaatgaggctggtgaaactgctaaatggggaacatgcatttatagcattagctgcacatgtgactaacaagtaaaaaataaagattatgaaataatgcccctaaccaaaagtggtccctttgatttctggagctctgcaaatgaatggagccactaaatgaccaagaaaacctggacacagttttcctgggttttatgactcagtatttacttttcttactgcaacccttctgatattgtcttaattatttctgattccctccttcacaacaggtcatcttccaaaaagaggaccagaatgtccttttttaaacacaaagtttaagaaaatacacctttaacaaatgtcactggaagcagaaaaatcatccaaagtatgtaattaggatcaagaaatctagaatgtaattttacaagataaatgcaaaggatatattagcattttgttctgattggggaaaggctctctttaaaaggcacacttataaaatgtgttattttacaatggaaattttaacacaatgcttttaccacttcatagcatagtctatctcaagaatattaccagaaatgctggctgtctccttgcacctgcattgttattttttatcagcatcatagggagaaaatgcttcttacagataacatatataactctcagcaagattatgaacaggagtttagaaggtacagataaaatatctctatatatagcgatcttaattcaaaacagaatataaagcatatggccaaccaaatgcagtcattctgttatctttgctactccctgctctataaaataatgctttccccggctcacacattatataataaagacatgtcttcactctgcaaagcatgctttccttgcctacctctactgttaacattgctcaactaaaataaacatttcccggcaaattcaagagctgatatttgcatctttcaaaataatagaccaattttctgcttcccaccatatctggtttatagtctccctctttcatagaaaaacaccctttcttggaaaacacacaacttgtaaggacaactactgcagtgccagttctcctcagctatgaactactcagtaagtattgctggaagaaacagctacaggagaggaaagataaatacctaccatttaaaaatgactaaaagagtataattggaatgtttgtaacacataaaattttttaaaacatttttttgaaatacctaccacagaataacatgtaaattccagaaggattgaagatgcaaactttaatggaataaacaaaattaggagaaacaatacaagagaataatttttaccctcttatttaaaaaaattatcaaaatacataataggaaatgtttaaggtccataacatgaaaagtgcttcttcaaatcattaggagaaaaggcaaagggcaaaatgtaaaaataggcaagggttctgaaaagataattctcagggtggcagagggtggggggaatatgcaaatgtcaaattaacatgaataaagatgtttggctttaccagaaatcaggaaaacacaaattaaaagaattcgagtctttatatcccaccagactgataatgaacagtggacgctttgatcattgtagagaaaggggcactcatacagaaaggggcactcttgtagattctagctagaagactctgtcgcaatagcaatccaattcctggtgatttttttcccctttgcatagataggacagattacatgcatgtatgagaaaacttataacaaaaaaaggagcataatttcaagtcccatatccctttaccctagtataaacaagaaatggtaagggtcacttgttgccttcacattcccaagtcgttctgcaattgtaccccatacaatccatgtggccaaacacaacagccctgttctttccccatcgtaaaaagactctttagaagaaacagcaataaagttataagatgaagatttctttgttgaatatcagtcaaaagaaactaggacaactaacaaagacagctcagaatcctcctggagttatgctatagaaaaaaatatgatctgtccacctgctttgctaatttgagctcaagaacttgagcatcaagacagtttatttttttccattattaaaaaaccctttccatgagtagcagccagcctatccttccattacctacagagccatccacttaatgaagaaagagtttgtttagagtacaatgaagatagacaaaccactggggacaaggttttgccaatgagaagccctaaagctctgatacagcaaatagctcctgccaggaagtcttatttttagttaggaaataattttctacaagccatgcaagttctgcttgctttgtatttaagattcaaagaatctttattcttggcaacctgaaaataaaaaatcaactaaatgctctcttttggctttaagaccccaaaatgagggtaatgaaaggtacagtggcttttgatttgaagttaaacccctgttccttcaagtcattgtctgaatttcaagtacaaagcattgtataatgagcctcatcagagtaacctagtttgggaggctaaaataaaatgaaatacatgtaaaatatttgtaaactgtatgaataagttattagctcacagaggttctactcttaactccctctttcttgaatattcctcaggcaatacagaaaatattacatttaagttgcacttaaggtgtaaatatgacaaaaagagtctgacaggcaggaagagccaagccctgaccatactgtgaagtgacatgatgtctttgtccatttcagctgctgtaacaaaattcctgagattgggtaatttataatgaacagaaattaattggctcctggctctggaggctggcaagtccaagatcagggtcagcatctggcaagggctttcttgctgtatcatcttatagcagaaagtggaaggccaaagagagagcaagagagatagagagagaaaaggggcccaaatttgttattttataaggaatccattccacgaatatgagcccactctcatgataacagcattgatccattcctgaggcatcagagccctcatgccctaatcacctctcattaggccccaccacttaacacagctgcattggggattcagtttccaacatatgcttttgggggaacacattcaaaccacagcacatgcattatctcctctgggcatatccacttcatgtacagtctttgtccttttcacagtattttgcttggaaatccatttgtttaaccaatcctgtctttttagaatactactccctccagtgtgcaacagacaagctttccctcaaaatcagttctctactcttgccctaggcattgggctgcacagctagaaactatatttccaggcctcctttgcttttaggtttagtcatgtgactaggttcttatcaatggaagtgagtaaaaacagtgtgttctacttccaaagcttggccataaaacctcagttatgtactccaccattccttttttctcatttcctcataagctaaaacagggacataatggtggtcagctacaataaagccctaaaggatagcagagcagcaacatggaaatatgctgggtctctgaataacataacaaagccaagctactctgtcagaataaattggttgaactacaataggagaaaaataactttctatcttctttaagtgacggtctctttgtcatagcagcttagcttttaccatcacaaatacagaagaaattgacttgttcaaccaaattctgccttttaatgccacctttcccagaaggaactccatttgaatatggaatcctgataattcaaaaatgttttaaagtccaaaatagattatgtaactgtataaacccaagtcactggtgataaatatctaagcccgacatttatttataacaacacataattgaattgttcaattgaaacaattaacaacaaaaaaactaattttcaagtactgatataaaataagttggggtatcagtgtgataaaaagtatggtaacatggaaaggaggcaggaagaccaaggtttcaattcaaggtctcacaattaagagctgtgtgactttgggcatgttttttttttttttttacatttctctggccctcgatgaaatgtatataataagagagtatgacaatccaccacatgatgttaaaataagtgtttagcctggtaactggcaaataggtggtcagcaagagtgaagctactagcagtagtgctttaattaatgaacatatatacagaaaacagctataaaggacaattcctctcactgaaacactattaaaaatcctttggcaactatgttgatgagaactctttcaagtcccgctcaggtttctcttcttgggttgtctagactaagcagatgctctgaagcatctcttactattctcatcccatcctgttctgcactgggatgcttttcctaatgtagaagcccctcatcattatatttagtaagcgctaattccttacctatgtgattccttcaaagcttcccctaaattctaagttttaaatgagagtactacaaacgcggtctgtattctccatgtgtcctgtaaaatttaaactggtacttattactctgagactgaatcttcttggaatttgaggagtactgtagatctgtgctgggtctgaattatgcatttttgagttctgtatttgtcttgagttcttttgttgaaaagtgtaacttgcaagttgggtgtgcagtagaaatctcatccctgatacacagaaatagggatgccatggtttttgtgcagctcccacatcctctctggtttcctagggttctactttttgaccaattcacacacaaaattgcatgagctaataaataaataaataagcacagcactttaaatgaaaaaaaaaaaacttccttaaaattatattattatcaaattaaagaaatttgaaggcttttggggaaacaatggatgagagccgagtgtacaattgtcatgtgaatctatatgaattatctcaagtcctttaggtttttcatgtcattgcatacaatgagctgaatattttaatcaggtgaagatcagggtgccattttaatcacacaactggttttgtgaggcaaatatatcttcttctcaagtaaagaatattgaaaatgccagtgaaatgtgcctgacccagcacagagaaagaaactgtgctccatcccagcagaggccatgtggatggcctcttgtatcctaggatacctttccaaggaagaaccacatgtttctgttaacacacataaatacacagaggaaaacagatttaatgtgtttaaacccggaaatgatataatttcacaatagtagcctttcaataaggtagtagaaaaaacatcaatttattcttataacatgaaatatggaaactactaactacctctaatcaacatcaaaagataagaaaagcagttgctctccatttagggaatgcctgcagagatatttatcacatcttcttttcagaaatcccaaccagtggacaaatcagctccgtatgtgtgctctttctttaaatgatcccaaatgccatctacagcctacctgagcttgagtgagtcatgcagtcatatctatacaaagacaaggtacacagacagcctctccgaagagttacttgtaataattcagatccaaaagaataatgtagttgtgtgtctccctatgcttatagcagtttgtaaatataaacacttctattagaagctggtagttagaaaacgttagagaacaattactgaaatgtctttaaagtatttacgatgagtcttttaaaaatgtagactaagttttaccaggaaaggctcatgttggccttatttttattttcatgactggggctcatcaaagtgcctagcatataggagagattcaatagaaaggtttctaaatgaaggagtaaatttatgaaataagtaatggtaacttagaagtagaaaaaaattatccataaactcaaattcagctaacattaatatttctatataatttcctttagattgttaattttataaggatttaatgaaaaataattttaataggatggtagcatttcctgaacacacactatcctctggactaaataaacacctctcagcattacctgatttaataagcacactgcgtgtgttgagggcttctattaccctcaaaaaacagttatgagaattgagatatgtttttaaagtgtcatttgatatttaaaatttaaatttttgcttaatattcaggaacaaatctgcgtgcaagacagatcaagtgcatacaattttaaagtatagtaagaaaaacacaaacttagcagcttacagtctggtaaaaaccggatgccttcatttttcctacttaccacttgaaaaacttgcaattgatcacgatacataaaacattaccaatgttttgtttcattcctttctttctaaaacagattatgtgataggtggacattttcattttcttttgtcttagaaaagaagtgaagcacagaaagttcaagtaatttagccaagatatctgataagccactgcgagatacattcacagaattcatctctcctttacagctagactactgcttttgctatatgtattctcaaaaaatttaagaatgatcatactcaatatgagaattgataaagcaaatgaccatcagtatcaacgttgttacaccccttggcagtcattataatgttaagattttcaaatagccaatcagccttcaaatgttgaattaacaaaggagagcaagcaatgctacacagatgtaactatctaggctaccttttgaaaatcaaggtgagttggtttgaaagtgtaatggcaaaccctcaacttatatcccaacgccatgcaaaagcacttaaaacagatggagctggcactgacagagaaggcaaagcaaatttcaacacagagaaacacaaatccttgttattcattggggaaaatgaggaaattttatatccaggtttgttaggcagttaatgattgactctattatgtttcaatgaatcaacatcaagttagtttaaaatggccatattccacaaagcaatttatagattcaatgctgttcctatcaaactaccaatgacattctttacagaagtagacaaaactactttaaattttatatggaacatatatatatatatatatatcccaaatagccaaggcaattctgagcaaaaagaacaaaactggaggcttcacgtaacccttcaaactatactacagtgctgcagtaaccaaaacatcatggtactagtacaaaaacagacacatagaccaatggaatggaatacagagcccagaaataaggttgcactcctacaaccatctgatcttcaacaaagctgacaaaagtaaccaatggggaaatgactctctattcaataaatggtgctgggaaaacttgttagccatatgcagaagactgaaactggaccacttccttacaccatatgcaaagttcaagacggattaagaatttaaatataaaatcaaaaactataataaccctggaagacaacctaggcaatatcactttggacataggaactagcaaagatttcatgatgaagatgccaaaaacaatctcaacaaaagcaaaccttgacaaacggtatttcattaaacttaagagcttctacacagcaaaagaaaatatcaacagagtgaacagacaacctacaggatgggagaaaatatttgcaaattatgcatctgaggtctaatatccagcatctataaagaacttaaagaaatttacaagaaaaaaaaatcaaacaaccccattaaaaacaagtgggcaaagaacatgaacaggcacttttctaaagaagacatacatgaggccaacaagcctatgaaaaaaaccctcaatatcactgatcattagaaaaatgtaaatcaaaaccacaatgagataccatttcacaccaatcaaaatgactattattaaaaattcagaaaataatagatgctggcaaggttgcagataaaaaggaatgcttatacactgttggaggaagtataaattagttcaaccattgtggaaagcagtgtggtgattcctcaaagagctaagaacagaactatcattcaactcagcaatctcattactgggtatatacccaaaggaaaatacatcgctctaccataatggcacatgcacacatatgttaattgcggcactattcataacagcaaagacatggactcaacctaaatgctcatcaatggtaggctgcatgaagaaaatgtggtatatatatcctatgggatactacacagccataaaataaaaggagatcatgtcctttgcaggaatgtggatggagctggaggcccttatccttagcaaactaacataggaatggaaagccaaatagtgcatgttctcacttagaagtgggaactaaatgacgagaacacatgaacacaaagagaaacaacagacactggggcctatttgagggtggagtgtgggaggagggagaggaacagtaaaaaagcaactattaggtactaggcttagtagctggtgtgacaaaataatctgtgcaacaaacccccacaacacgagtttatctatttaacaaacctgcacatgtacccttgaacctaaaataaaagtttttttaaaagtatatactttgcttgtaaggcatggttttcagcattttggaatatataaagaagtagaaaatattgtccctttctttttgactcttagaaattattaatgtatacttctttaccaactaaaataaaatgaggaaacagataaaatgagacaatgctgcagacatgcattttacacaggtttagagtacatatatcttatttgagatattcaagattccagtaagagcagaggggtgggaagtagatttgatgtgttcagtataaaaatgtggataccagtctgactcaagcatagtgtttgtataaaaggaaaagtggagtacagagtgggagagggagatgggggccagattaccaagaggtttggattctgggctaagtttggattaaattcaccaggaaattgtgagccgtgtattttgcaccaggaattaacagaatgaaagccatgttttaggacggcttcaggtgaaatacacaaaacatattacatgcagaaagaaaaagtgaagagagaaaaaatgtccacaccatctttcgtgatgtgaaaaataaatgaacaagacaggcagtagaacgaaagctgaaaaaagcattaaaagaaaagaatgattgagacttgatgtctgattacatataaagcaagggagcaggaggagtccaaaccccaaaatttcaagtctagatggtcaagagaataacagtgccattgatagactaaggaagtgcaggaagtaatgtcctgggaaagaaagaattgagtttgagatacatgggttctaggtatggtggggcatctatgtagagccacggaatgctcattgcagacataaacccggaaacgtgaatggaggctagatggaagtcacggcctgaagatgaagatttaagagcatttactacaatggatgagatttccaaaaatgatagaaagatttaccaaggagtgggagtttatccctgttactcccttacttgagaacaagcaaaaggagacacacggagcaagaacttgttaaaaaagtagacagaacttggatagcaaaatgttgttcaaatcagaagggatattcctaaagtggtcagagagcacaagtgctaaaaaaacaaacaaacaaaaaatgtaaattgaccacaatcagaaagaaaaggttggccttgaagacagcagttttgcagaacaatgggagctgtcgttgagggtcatggacagagcagacagtgcggaatgcagactgtgtgtgagagtgaccaacagctcagagaattatggtatggtactgagaggggtgtgtgtgtgtgtgtgtgtgtgtgtgtacgcgcacacatgggcgcatgcacatttgagggtatcttctgttatcttctgtgttgaaatatgtaacgctgaatgttgacataggactacacctgtgtctatttcaaccgagtcaccaatctggtggtcctcagatatctgagtgaaagacagcacttccttcttgttccccaattcctaagcaacagtcttgggaaactctttcacatctcttgaattatttggtgcaattcaaagatacataaaggatttcttcagttagagtgcagagcattttcttcctcctcctcatgagaaatctctcatggactctagaaccaattaccatgggctgggagggagaaggactggctatgctctctgacagtggactaagggggaggcatgagtactcctccctggaccaggcccagccacaaaagaaagggagatggtcttgatcctgcctatgtaagaagaccacccccagggtaaaaagacacatgtgttccctatcaatggaactgttggagaggacacccctcaaagcaccatcatggaaggagtaagctttaacatcagccaagctgacagaaagaaacagagctaggtcacaactgtctttctgcctagcctcttacctacactgtgccctatcaaggagttaaacgcagttaccaaagggaggaagtgcacaaggagaggacagccacaatttccctgggacacaggcttccaatgtgaacctcctctgacctgggagaagtccaaggttaatgcacttctttggaatcttaatttttgcacagtatattgtgcatatgcttttggaattaagtctgtttttatagcaagaggaatttcattatctgaaagtgatcaaatatcatagcctcatccaagcctcctccaaaggaaaagcagaccacccccaccaatgtggaaaggaacagggtaggcaaagtggagttgatttttaatgagttcagacataagtgtgactggcattgaatattatgttccccttctgggaaaccacggtgcattttgctatattaaaagccctgagaaatcctgcaataaagaagcctgttcactttgttaaccctggtatttcccaaatttatttaaagagacatatttgtttcagagaatgctgattaatatgctgataaactaagattaatatttcattaaacagagtttgaaaagcattgttctagacatttggcatattactaaatctctatcccgtaaaacatatttaggaatgcctacatacaaaatgacttactccaaagaaggacctatttagtgttattcctttatttataaattttgtaataaaatatctttagagtaatttttctgcaaatctttgcttagctaacctcattgagaaattaagcatcttacatacacgaattttctggataaccagaactttctcctataaactttaacacttaaaaatatcaaccattgaaaataaaacctctgaattcagatttttattacacgaagttttcattataaacatgaatgtttcattataaacatgaatgctatattcattatatttgatgaattcattatatttgatgaatgctacatcaaatcactactcattggtatggtatctttgtctctgggaactacggagatagaggtacaaggttccctcctggctgctgacttcttaaggcctggatgtctgtttgaaaattccttttatttcctgtcttgcaatccacctgtctgctgctgcacccagtcagaaggctctgagtgagggctggagcttttatggcactctaagcctctggactttgtaaaaactgttggttccccaagaaccttttctgttggcttgttggattttgttttattcacttccaaattcaatcttttaaaacatcaagaaacaggatctcatgatgaaacagcatttccttcatcctgaggactgctgcagacagtaaagtttgtacactgcataaaggacaaaaacaaggggcgaggagggctagagtccagtagagatgccagccatcgagttctgagcctatgggatttgggttttctctactagctatgctctgcacaatcagaggagacaccttttccaaattcacgttggggcaattggaacccagtatccctcgtgcttcagtggaaatcagatgccacaccctttacatgactctttttagacttcccttcctgcatcctccaaatgatgttaccaaatctctccttccaccaagcctcatccaatccccaaacaattttccctttatttgcaaaagcacacccttatctaaatatcactgataaatttgaaatgaaatttatgaatccagagaactcattttctttgttcctctgcatctcagcctacagaggctatgacccacaaatggataaaattaattatgagcataatgctgtaccagtccagtcacaatgttttactgatcccagacacctgtatatcgatgcggctaatctaatctatctggaccatgttaggaaggaagatagctgggaaaggcattatgcacattttgcaaccaaatagaaaaagaaaatgagccacttgcgaaatgtaggttgcatgggaagaactggagcaggacacatcctaagggttgacatgcacttttttacatggctgaggccactgaggcaagacccagccctgctagagtgggaaactcactggtttcatggggcaaaagcagtattcaggttttgattctcccacttaactgctgtacaactttgctaagcttcaattccctcatcaataaaatggaatcagtaataataacttgcttaacaaggcgaggatttcatgaaatatagccgtaccttggtatccgaggggactggttccaggacctcccagagatgcccaaatctgcaaatactcaagtccctattataaaatggcatagtatttgcatataaccttggcacatcttcccatatactttcaatcatctccagatgagttagaatacctaatatgatgcaaatgctatgtaaatagctgttatactccattgtttcttatatgtatttttattgttgtattcttattcttttttttttaattatactttaagttttggttaaatgggtacatgctcagaacgtgcaggtttgttacacaggaatacacgtgccatggtggtttgctgcacccattaacccaacatctacattaggtatttctcctaatgctatccctcccttagctccccaccccacaacaggtcactgtgtgtaatgttcccttccctgtgtccatgtgttctcattgttcaactcccacttatgagtgagaacaagtgatgtttggttttctgttcttgtattagtttgctgagaatgatggtttccagctccatccatgtccctgcaaaggacaagaactcatcattttttatggctgcatagtattccatggtgtatatgtgccacatattctttatccagtctataattgatgggcatttgggttggttccaattctttactattgtgaacagtgccacaataaacatacgtgtgcatgtaactttacagtagaatgacttataatcctttgggtatatacgcagtaatgggattgctggatcaaatggtatttctagttctagatccttgaggaatcgccacactgacttccacaatggttgaactagtttacactcccaccaacactgtaaaagtgttcctatttctccacatcctctccagcatctgttgtttcctgactttttaatgatcaccattctaactggcatgaaatggtatctcactgtggttttgatttgcatttctctaataaccagtgatgatgagctttttttcatatgtcttttggctgcataaatgtcttcttttgagaagtgtccgttcatatccttcgcccactttttgatggggttgtttttttcctgtaaatttgtttaagttctttgtagattctggatattagcactctgtcagatggatagattgcaaaaatttcccccattctgtaggttgcctgttcactctgatgatagtttattttgctgtgcagaagctctttagtttaataagatcccatgtgtctattttggcttttgctgtactcttactctttatgggtttttttcccccacatattttcgatctgtggttagttgaattgggatgtggaatcagatacagaaggctggctggaggtgaaagaactgtaaactgtaaattgtactgtataaacaaataaactttaaatgctatataagcctcttaattaaggaacccttgtgattagaagtaaactgggataggaaaatttccatttcattgacacaagtctctttcttgtccctcctctcaataaagatgaagattttattccctcacctcatgtgattttgaactaatacaggtcaagtgaaggtaaacaatgaacacagtacacggtaacaccacccaagggtagtaaggtttccaccccagcaagagagggaaagactggttggtgatggtgaatttctccattatttggaaaaactgctcattaagttaacaaccttaaacaatcccaaaacttccaaaaatataacatggatagcagcctttataaagttaacttggttaatatttttgttaatctcacggtgagtgcttatggcacaaactcacaatgcaggttgtctgtgagggttcggccattgtcccaaaatgttagagatgggtaaagtcagcctgggggatctactggagctctggatcagatctgaggtcatagttgaaaatacgttacaggtggagctcaggggctgaaccaagatcctcatagttgggtttacaggagcttccaggcgagtccaggagcctctttgtcactccaaataaccctggactcagaagcaattttatactttattaagattcctaagaattctgatggccagaagcccctagaagacctccatttgaggctatctgtaaggaagacctaccacgtggtcctcgtcgttggtacagatgagggtttctcaacagcagaacttttgacatttggggggctaaagaattctgtgatggggagctgtcatgtccatggtaggaaattcaacagcatccctggcctctacccactaaatgcacgtagcatcatccctcagttataacaactaaaaatgtactagacattgccaaatgtcccctgaggagcaaaatggctcccagttgggaaccactgacatagctgaagtcctggagacctggagaaaatatagagattgcaggctatggactcttctcaccaacttgcttcatgttttaattaactgttaatagactattttaggaaacagctaggtgaagtctctaaatcactgatcatctgcgacagtttaatgtaaagttaccattcctgctttggaagaaaatgttaaatttgaaaccccttttattctggtcattgttcacagtgctgtttccatgaatcaaaactgaatcatttagacctcatcaaccagaaagataatgcagaccacctcaaaatttctctctttcatcactgagttccagagatagtaaattattcttctatattctattactcctttggccacttattctgattaaatttgagcacgatttgattttgaaagggagaggaaaggccagaagggaaatccaaatgtccaaccatctttcggtatcaagtacagtgataggaaaactactcagtcagccacaaaacatgaaccaaaaattgttgaaaaataaatagcatttttacccaaagaaataacatccatttgcctttgctttttacatgagattatcacacaataaagaaaaaagaaataaagcagatgagagggggaagccatccatttaaaggaataaataagatttataaatcaggaaagaaaagaggctgtcatgtacaatcagttgtcttattaacccacaggcagagatacagtcagaaaggtcctatgatggaagatttacccttgcttataaatgaggcaagattacaaagtaatgtaatttcctgggtaagctgtgagtaagtaattatctcatcaaggaattctgcttctggggggcaagtagatgaagaaaaacagcctttcttctgtctaagacacttatgctggcagaaaaaaaggttactattgcctgattttgtacatgtctagctgagttaaaaccataggtctgcaaagacacccaccatcacctaacttctaaagggctaatattgtgagtgagcatgctgctttaggactgtaaccttggtacttcaatgcatcttcctctaaacttaatgtcaggaaacctttacaaggcatgcttgatggtgggactggttctggtggagaaacgggttttagaaaataaacttgaatttgataataattaaaaacaaaaaaaactcattgattggaaaagtacccaagaccactcagtttctacttggggacaggtgaggcacagcaattactcaaactctaaatcaggatggagcagtgttttgatttggaaatataaagggatggtatgagttgatggaagagagggagaaatgaaaagattgagaacaggtcacatacattctatgaagtctttcaaaagtagctaacatgccaggcatggtggttcatgcctgtaatcccagcattttggaagaccgagagcttagcggttcaagaccaacctgggcaacacaggtagaccccatctctacaaaaaaaaattaaaaaaaaattagccaagcatggtgggacacattgtagtcccaggtactcagcacggtgaggtgggaagatcacttgagcccgggaggtcgaagttgcagtgagctgtgatcacgccactgcactccagcctgggtgacagagcgagaccctgtctcaaaaaaaaggaagaaaaaagtagctaatgtacaagttaaaacagaggcgcctagcaacttgtcaaattttgttggaacatttctcaaacttcccttgggaactactgaatcagacgctctaaagagttaacacatcttctggaatttcccacattttaagcagaacttacttcctccacaagatctgtcctaaattattatataacttactagtaattgctcatgctagaacataagggaagcttaacaaatgggtgacattgcttgatttaaaattaagagtcgatgctgataatacaataaaattagtccatgtagaacagtttgactttaagttatatgttatgcaatatcaggtttataaattaaatctaagtagtttgagttaaaataattggtcatgaattgaaaatatgttgaaaaaataaatcatatttttgctcaatgaaataacatccattttccttcacttttcacatggaattaacacgtttctatctgaatttggtggcttgtattgaacttgatctggtatataaggaaaaaggagaattggcttgcataataattggcataataaaggcagtgagattattacaaaattaagcatcagctaacttaaaattggcatttctctcacaacaatagtatcagagtatataatggtaggtatacacagtttacctattagaaaaacaaaaagcatacctgccaacagatagaaatgcattacctccaataatagggacattttctggaagtgaattctttcaatagtttgctgatggttttaatttgacatcttttttttcctttttgcatgcatgtccatttcctttcttttcttttttttttttttttttttttttttcgagacggagtttcactctatcacccaggctggagcacagtggcatgatctcggctcaccgcaacctccacctaccaggttcaagtgattcttctgccccaggagcctgagtagttgggactataggcatacatcacaacgcccagctaatttttgtagttttagtagaagccaggctggtctcaaactcctgacctgaagtgatccacctgccttggcctcccaaagtgctaggattagaggtgtgagccaccacgcccagccgtttgcatgtgcatttctaaccaatagagtccccaactacccatcttctgccaatgtatattttttccatcaatacttccatttttcatacttgctgccactaagccacaaggaaaagggagcgcttcatgcaagaacccaagcatttgacaaggctgacagtctgcagtgtttctggaggggccaccttcagtcttctcctttcttttcttcttcctagctcttcaagctgaactaacccatgtccctttatggcccagttcatcagccacttctacctatagctgtgtattagtctgttctcatgctactgatgaagacatacttaaagagactgggtaatttacaaagaaaaatgtttaatggactcacagttccacgtggctggagaggcctgacaatcatggtggaaggtgaaaggcatgtcttacatggcagcagacaagagagaatgagagccaaacgaaaggggtttcctcatataaaaccatcagatcttgtaagacttcttcactaccatgagaagagtatggggaagctgcccccatgactcaattatctcccaccaggtccctcccataacacgtgggaattatgggaactacaattcaagatgagatttgggtggggatacagccaaaccatatcaagctgggagcacagcagcagcttcagcccacatgtgagggacatttgtactgtgccccacccaccagtgtggccaggaggccaagcgaccatggaggtcgcttgcctccacccctcttgcttgcccaggctgctgtgtcctttcctctgccaccattggctgaggtcctctgtctttgttcccttttgggactgcctcaccctagacactggcctgcctaggactctgggagcttgggcattgatggccaaacccctacatgagtgtttatttattgcccccataccttcagtctggggacgggagcccatgagaagaatatggcagcagatggcagcagatgggtcgctccaccatccctgagcccaagctccctggaatgatagctgtctcaatgaatcactgattccacctgttgtgctgtgggtaatgtcagaggggctgcacatgagctttgtgagagatgtgctcttggtttcattaagtgaatggaggaacatgcaaacaataatgtaaaaaaatgtcaggatctcttaagtaggtttgggacaaatactattcaagtaaaactaatgtgaaaagtaaacacagaccattacaattgggagttgattaacctgtgatccatggttggacttcaggggctctttatgcctcccaggaagttaatagatagatagttttacctgtatgtgtattttttctagagaaaaaattaatattctcaaaaaagaacatgatctgaaaaagttagaaatcatctcctcattcatctgctcattttgtgatgggcgctaccaaggcacaaagaggctgtcctgaaatgcaaataacatgatcttactcctctgttgaaagacttcagtggctcctgccactctccagatgagatacaaagcatgacatgctaggctgcatggggctctggcctcagctcatccctccaggtccatgcccaccactcatcaacccagctgccctgtggacacaaactgagcccctcacagctcctcaacagaccacactccctttgtgagcacatccccaccccctgccatctctcctaaataattttatttgactggttttttgttttgttttgttttgttttttgaaacagagtctcattctatgttgtccatccaacatctcttcccttataaaaacttccctgactgcaaccttggttctccagtccctgttaggagacactcctccttgtttttgtagatactcacgtcctcctgtctcatagcatatatatcatcccactatcatagtaaatttgcttatctctggatttatcgaccctgtgggagccctcccccccatccactctttgctctatcaaggtaggatgtttttaccttcacattccccagaagccagcatagcacctagaacagtctaggttcgccacatatgttttttatatgaatgaacgaatgaagcagagttatagataaagataaagcactgaacatcccatactagcccaagatgccacatagctagtctgtgatagagcccgaagtaggaatctgtctctgattccagtactgtttctatgacacccattgctttatgtctttgctctggaaaaaagcaggagcatgtttttctgcatcttttaaaaacataagtataaatactacttcttcagtcctcaccggacagagggagctgtttcccacgttcccgacaccctttcaggagattcataatgtacatgttggttaagggtgagcacatcactagcgaagcccttgatcttcaggcaagaaagagcggggaggaggaggagtcagagaacaagaaaaagagaagggggaggaagaggaagagagaagaaaaaaagaagcgggaggaggggaggagagagtaagtttatgtaacctttccttgggtcacagttgaaatctagttatcttttgaatgggttaactggtactcaaattctcagatatttatatctaaagttaaaactaaatctcaagttacctcaagtaaaatatagatcagttcgccactgatcttggaaacccaaccacgcttttttttactgaaagtttgtttcagtgtcaaatgaagattgagaatcaaatgcagtggagagcaaagtaatgccctccaggcactggcgtggcagcatttcagcctgctgggctccctagagcctctctgtgctgagctttcatgatggttccatggggagtatcggaaatggctctgttttgatttcctctgcaaacctgcagctgcttctcttctccaattcactacaacatgctaatagggtgactaaagagacagctttgctatcgctatcacattgactcctgttcatttgctgtaacgtgccaagaggcaaaacgggcatcaggatcaagagaaaactaactctccatattttaagacattctgtaaatggactgagtgtgcctttagaaccttcatcctacccagcaacttgcagtacacacccagtgtagcctgttcactctcacctccctcttgtgagacatcctgtttccgtgcttaaagtgttcttccttgccctatccccttctctgaatgacgcctgttataccaagtgtctcaacagagaagttacttgccagcgcctttcctaactcctccagagaggtactcccattgtgcccgctattgtgactgcctctttccctgtccctgtccccaaaaattgtcagctacttaggggcagaaactgtgtccataggagacactcagatacctgaaaagtgaataactgaaattgtttcatctgaacagattcatgtcattttattttagatcagtgtctacaaaaaatgacatcaggccccagcaagggcaaaaagaccatgggatcctaataagatccacttggactgaatgataattaggataaaacaaggcaccaaaaacaaaggaaaagttttgtaagaagcaattagataattttggaaaatatttaaggagctttacctttagcttcttggctgttacaataagttttaattcagcttggttggatgttgtagaagaaaatcgttgagatatttaaacctatagcaatgctaccagttttaaagaaatgggaaaaaaatgaaagtaaatgaaaaaccaatgtgaatgtagcatctttaaagaattataaattagctggaagcagcatccaaatagcagttcccaagatgtcactatgtaattatagctcatcagcacatgtcttgcatattccaaaataacccgttatactaccctctctttcccaaaccggggaaggaaagatgacagcaggcctcagaaataatgactaaatagttcctttctaacaagggtggctatcagcttttagtgtccaatatcttctataaaaatacatcacacataaggaaatatgtaagcacattcctagaattcaaattaaacagtctaattttcaaagactttcataagtttttaaagacaaaatgatttttcctattgaattttaaataaagaagaaaatattaccctaaaaataaaatagggggtacccagtaggttttgttgagctggggatatgtaggagtctttttgtccatggcctctttggtgtgatcacctaaaatgcttgacagatgggatgcatggcttcattagcaactgtatcaggacgcatggagaaagggggcccacttaaattgggtgtttggctaagtgactcttcctggaagcagtagccttgtggattcactcagtactagctgtggctgagggcagggtaaattccactgagcaaacagatgtgaatgttataaagcagatgctgatctttagtatcacactattgggaaaacctttttttcatggatacagcaagaaatacttgtacatttttactctaatagatgttaaaaataaagcatgttaaggttatgacacttaaaataaacattttaagtgcttaagatgaaatatttaggtattcaggttaaatactctaaagcttttcagaagtaaacgtttgctatctacaatggaaataaaaattcagaatcattatttcctacctactattgcttggacctccctttcaaccaatcaaacttaaaaagaaaaatcactttttatttcatgctcactctgtccctgtgaggaactttataaagaaaaactggtgctacaattcctatcactgacacccttctaaccttgtgtttcttggtgggtaattgtttattttaaaaagtctttctaaaattcctagcaggagtaattattttgatagatttttaagtgtaaatgtagctctaaaaaaatccatgcacatatctgttaaattatataataatgatccaatatagccaagtaaagccaaaatttagcacccactaacaggtaagcattatgttaggcagtggattctcaatggttgaataacacactttcactgatatttggactttttatgaagcccatagtagttcatgtttaccttattttattgcttttattttgatgcttttattttatatcatctcagaagtcagtgattgattgattgatttttaagtgaacgaaaggtctcacgtatttattactgaacccagcaaaccaatgcgttcataacagattcagagagaaaaaaatatatattcccaacaaaacatgtccaactctccagatagtggtgacattttcagcttgatatggtaacatgattgtgaccttcagacagcataaatatgtgtgccatctcatgtgcaattcctcatagacccagcttggttcttttccaatgtctccttttggagtttcacctgactttattaccagttttcgtctaaatccactggggaatgggatgattttgcttttgtttcttggccaggaatcctaaaagtcttttaaccctaaaagtcttgtgagaagacatggcgagaagcgcagtcaagcacacaccacgatggcagagaaaggacgatttattttaaaaagcagattttataggatatttctttgagctttagtaaggtggacttactcattttaaagatggagaaatggagtagtgagcagtgaaaaattatgtagtatcataatttgatgaataggacaaaaatttagtctcaagtgctaagggtttacataataccacattttcttcttcattccttaaacacatgaaaggcacccccaatagagacagtacctaatatgtatgaagattagagagagattatgaagtaattcaataccaatattctcattttatgccaacttttataaaaacatatacttagttcactttttacaatatcagaattactaatttaggctctacgtattttcatggactctaatataattttgttttaaataataaatgttagcacagataaaaatatttctagtacagtatttctggacataattcatattgcttttaattcatgcagaattgctaaaattcagaatttgtttaagaagtgacctatagggaaaatcagaataaacactcttagacagtgaaataattcactctctggtatatggctctgtttaacgtatttgaaaggccaaatgtaagaaccaggggaaaaaagttgagtgtcatttaggggcagaatcaattcgaaactttattctttccaaactggctgcatatcagaatcaccaagtgaggggtgaaggcttatataagctttccaaatcgagaacccctagaggttttctctttcctttttttttttttagcatatctgagatagtcctaataatctgtatttttaaaagaattcctatgtacttctgaggtataataaattcggggaaccaattttagatggattgagatcaaagctgtttgaatcatagctctgtcatttgccagttttgagagttggtgaaacaatttaagactcatgatactcatctgtaaaatgaagcaaaatagacctttctcatgagattcatactaggattgcatagggacaatgcagtgctgaacactgacaccaacgcaaagttgaggctcaaaaaaagtttgcattctttgctccttctccataaaattagcatctactattgacatggaaagcatgaaatatataaagcacgaaaactggccaaaattaaaagttctgaccacttcagctgattgagttatatggctattagatcgtctgtgttttttctagtacaataccagacacttaaagcatatttctacaaaccaaataagtctaagggcctcatttggtcctatacgatttggggttctatagcagaaaataacacacttcttgttgtttgagtagggattttataaaggaattatttacgagtctttacaggttgtacagaaaccacaaaggatagtaacactatctgggagctaaagatggtgggggactaaaacacctgagtcaaaaagggcaagaggggagtggttatttaaacctggagtcagagaagtttccctcagaggaaccatgacctgttgtcaagggacacagctggtacacagtgactgtcaggaggagggtattaggacaaaatccccaatctcactcttctcctgctagttgtttgatcatgcagcccattggccaaaggtcaaggtcagtctcccagggcacagcacgggatggagaagagctgagagtagataggaggaggaaattggaggcatatcatgtaagtcctatgtcattctgtatcataaagaaacacagtccttcaccccaaagtaattaaaaatacttctaatacttacttgtatcttttgaaaacattaaaagaaattcaattcataaccaaaaaacaatttaaaatgccttttctctctctttaacttggcctctctcttcctttctcattctcatcctccatcaaaacttccctccaaaacaaggtctccactaccctttatttctccattatgtttttgtgtaagtaaattttggcgctttctggtataaactccttaactctccatacccatttctgctttgcaaatgctcagaaacagaactgccaggttcattatctcttttagcaaacatggcgggaggtgaggataagggaagtaattgcaagcatggacacactgatatgcactgttgtcgatctccatcagacttggtgaaaaataatagcgcatctgaatataattcaagcaaaaggcagaatccattatggtcttctataagccatgacttgggttttcttccatatggaaaaatggaagtgtttttccatatgtaaaatgtaaatattgactgtacctgatagttgcattagaattggtaacattccagattttcatgtcttattctgtttgattctcacaaaatagccttgtgaggtaagtaggaatttttatacccttaagactgagaaaaatttaatgactaaatagaagaatcacagctggtaagtgaagaaatcaaaattagaattccagaatacatttttccctgagaactgaaaacactttacctaagaactgaaaacactgaaaagtgcttctttttcaaaatcaataaaaatattttttaaattgatgcaaatgcttactttgattactctattttgaagcatactaatggagatttcctgtaaaatataagaagaaaaaaaaatttgtttacttcctgcattgtcatttaaaaaattgattaaaataattaagaattagataaaattacaattgcaatgaaattgggaagctatgacagccccacaaaaaaagactaagaagactattgcaaaataccaatacaaaatgagagaaaaaataagggacaactcatctctctagatcttaaccaagacgcagatttcttaaaagtaactggtaaattcaaaaaggtctaattagtgatcctttacttggggtgagaaaatataggctcaacttctacttcccagaacagtagaagaggctgactaaaggtgaatgacaaatattggccatttttgtttttgttttcccattaaaactcctgacaccaaaaaactgccaaagatggagttagatggagttagaagagctgaagagagaggaacctccctctttgtaattgcataccgaggtcaccatatcagtgataagcaaactctaaattacaaaataaaaacctgtaatttaaacatccaattacaacaaggctaatcctctttgtgggtgatctgctcatctcaaagagagaatacaggagggagagaaagagaaagagagagaaagaagcaaagatcagataaataccgcattttataaaagaattgctcccaataaacagaagcaaatttatatcaaatgatattcttaaagaatataaagaaaacatgcaacatggaccatggattctgggtaaagaattttaaaaagatattaaacatataaaagagggatcaaagaaaacagagataaaacatgaactcaccaatttcagaaaataaattgaaaatatcagtatagtcatttttcagatgaaaactacacttgagaaagaaaagagtggaatatatactgctgaaatcagtaagaaaggtaaaacacaagcttgaaaagcaaattacacaaaagtaaaggaataaacatataaactcactggagacagaaaacaatagttacagaagacaaaaagtaaccaaatggtcaaaattgatattcttgaagaaaacaaacaaaaacaaagaaacagacaaaatttcaatagtttaacaaaagaagtctttcttgaaataaaagacgatgaagttaaggaatcacactgtatttacaaagaaatgatgtggaaagttaactgaagattctagtgaagttactggaccttaagacaaaagataaactttcttttttttgtaattttattttattattattatactttaagttattcacaactattgggttagaattatgtccatgaggcagatgaatgatttggggctcaaccacaccctagtcggggagcttctcaatgaagggacctgagacttctccatctttgtgcctccagcactgaacactgtgcttagaacagtgtggtggagaaaaagcaaattgggagcatttcagacatcaacttccaatgaccaatgcagtggagaaatgctggcaaaattctaacagaaaaaatacatgactcatacattgtatactcagccaagatttttcagtcaagtgtatagacaaaaataataatttttggaacattgaaggacatatgaaatgtattggccatttttaaagttatgtatcatacatgtaaaggatatatgtatcatatctatggttatatatatggctatgtgtagagagagagaaagatatcttcaagcaagagataaatttaaataatgtgttctctataaaggatgactgctagtgctagatcaatataaatgaaaaattagatttaaataaacaagataattatggttacagaaccaaatgtaaatgttataatccttggtattttacaatcatgtaaagtactaaaatttgggggtaaaagaaaatacaaacatagtaatttctaagtttcaaagcagacagaaattgtatacagttaatcaaaaaatagttattcaaatgtattatctaaggatattgagaaaactactaaaagaagctggttaggtgagctgatgtttttcatgcctcaaaaaatacaaaaaaaaagagtacattcaatttagctataaatagataagaaggaaacaataaatcatgaaatacaatcttctaagacatcagaataggaccacacacatttatgaaatcaataaatgtaaatggaataaaatttattctgaatagaaaagctgccataatagtgaaaaacatccttaaggacacaaaaatgtgagcactttgaggacaaaatcttggtctttgttcgccactgtctccatgacatccaacataagtccaagcacattgcagacactcggtgtcattgactaactcactaagggttagtgaaatagttcataataatccacacaaaggaataatgtgtagttaaaaaaaactttttccttattgtaaaaaacaataaggaagatctaaaaatgactgatgtgaacatttttgcatgataattttggtgaaaacgctgcagaataatgttatactatgatatcatttgagtaaaaccaaaatatgtagacattatataaaagttatgtaagttataatacattatatacatatataatgttgtggatacaggaaaatgtctagaataatatatgcaaatacatgtgaaaatctcaatagagtttctaataaaggaaactagggatgatgggagaaagagaatttcacttctcatttctgacctgttatattttaattttatatgatgatggtgtttttataatttaaatcatataaatcaaaacttaataaagactacagatgttacctggaaatttctagtcaaaaatttaatcctttaagttaaatcactaaaatacatgaggggaaaacatgttatattattcaaatagaaataaattaacaaaaaatatttccatcaaaagactgactaatcttttgataagtttaatgataaactcaccatggcaaccaattttatctgcctctataacaagaagatcattcaataggttactgagaagatagagatgttatttatgctggcaaaataatatttagcttgtgtaccatatcacctaacaattagcaatctggagagatacaactttcttactaaatggtgaagtaacattcaactgagaaaaacataattcaagcttaatgtttgggtgatacagaaaaatgtggtctgaaacaggcagtgaatgacttgtttggcacaaatattggaaaagtgaaaaacagttcatcaggaaaaccaaaagccactaagtcctaggtggagaccaactggacatatgcaaattcaacagtcaaggcaatttctgctaatatatcacaaatttcacaatcagcaatagactacaattgtaaaacaaagttcttcgtgttaactctgaaagtgtctgtcagcatggatagcacaggcagattggggaagaccataaaaagcataattctgcttttaattttaggtgagctattatataaagaatggtgataactgtttgtcatctcttataaaaacagtattaagaaaaattatatgacagaattttattcagatgtaagtagggatgtggtgaatttctgaggcattaaattatcagcctggcaatctttattttattttgtattttattttattatattttattgtattttagggatggagtctcaatatgttgctcaagcttgccttgaactcctgggttccagtgatcttcctgtctccgcctcctgagtagctaggactgccaggcatgtgccatcacacccagctccaccctggcaatctttaacacaagttgatggaagtcagatgtggtggcacatacctgtaatccccgctactcgggagaatgaggcagggggattgcttgagcctaggagttcaaggccagcctgggcaacacaatgagactcaccctttcaaaaaaaaaaatcagaaactagtgcatagataccatctgtttggaaggcctggttaagatggtgtccacaagctagaggcctgaccaggagctttgcatctcaccacgcccgagtggagttgctgttcaaaggcagggaccagtttttttccattatttcaccagtacctagtactgtgcctgagcaagtttaaaaaaattctctggtcttaaatgtttacaatttaaaatagaattaatctgttatctgacaataaagttgtaaaattttaagtaaaatgatgttataaaagtattacatgctgcttcaagaaaatatgaaacattcagggaaaaaaaaataaaagaaccatattccttcacttagaaacatccatatagtaaatgtctttcatctctctctctctctctctgtgtgtctctaaggtatttcatatattttaagcataaacataatttttactctgatttttattttatgctgtattggaagcatttcctatgttactacacaattttaataaatcatatttcaaaatctgtatcatattacatgaaatgactttaccactgaatctcaaaacatttctctatagatagaaatttcagctgttttcattactgtaacactttgcctacttaggtttgttttcttaggatagattctcagaaacagaattacttaccaaatatataaaagcttttaaggatctttacacatattgtcaacctgcttgccaagaatttacttctgtaaacaatataagttgaatttcacttacatgctttgaactgtaagtgagcataaatatatagacatatagacatatatattgtacattgcattgtattttatgtctgggtatttgtttttccttcttgctgaattgtctgttcaagctgtttgtcatttatttgtttgtcttaatgtttttcttattgattattatgaattcatgatagagtaaatatattagtcctttgtcatgtttgtagcaactggtgtttgggtatatattctgtgtaaagtgctttcaaaatttgttgtcagataaatttgatttaatgcaagtatcattgttaccactgaataaatgcattaaagtattatttccttgcttatgctgtttgctgaaagaaatgaatgcatgaacatttatacaataagcagttaacatggttttaaaaggacacagtttctgtattcatattagctagttactccacatgctctacagagatattattagtttcatcttgctatgtgaaggagtgatttagtcaattacccttggttttgtggtaaatacttatcagaattaatattacgatatacagtttttggttaatttggtgtctagtgaaatttttcttgaaattaaattctgaatctttgccaaatttttaacaatttttatatctcatattggtttgccagttccccagcacgccttcctgcaaaataaaactccatcatactcattcttctcttcaccattctgtctcgtccatttgccgtgttccagtcacagccattcatgtaattttctctaaatactccatgaacatttataactctgagccacgcacctccattttctgtccagagtgcatttcttcccatttctcaacataccaaactccaacccatcatcaatggaagctaaaatcaaatattatttctcccacgaattcttttggaaagccccagatgagtgagctcctttgagtactcgttccatctatttaggttcactggagttaatatcacgttgtgtttcattaattttcatatgtccattttccctacaaaactataagtttaaattccaaataactagtacagtgtctgggtctgcaataaatgttatgaatgacaatcgctatcatcgagcacttttggatgtctgtctgatgtgtggtcaagtagacagcatggcacaaaaataattccaaaaatttaatctgaatctttcctcttctttccaccctggctcccacctctgtagaccaggtcaccgtcgtttctcacatgggccacgttggtagcctcctaacctaagtctctgcttcttcctttgccccaacccaatagtctattctctagtgaggactcagaagaatctttttgaaacatacatgtgatctgtctctcctctgcaatggcttccagttgcaaaaaaagtaatactcagactccttagcctgtccagctgctctccacacaccaaccctggccgaattttttgattccctccactttgccaacagtctccagccactctgacattttttcttttcctcaaacaccccttaggttttcagtgctgtagcctttttaccgacagttccctccccattttccctctttcactttcttggcttgctttttattatcatgaaatttgagtttaaatatcacaaacgcagagaagctttcccggacaactcattctaataaacccctttgtcttttaatcatttcactctatgttacttcatgcatttcttactctttgtttatttgacttttttgcttaaaaattatgattacttgtatctcaccattgaatgtaagctttaggatagaagataccttgtccataatttatttcacccttgtaagtccagtacttggcacaaagcaggtgcaaagtaaatattcctaaatgtggatatggtgatggcaggaacggtagtaataatatctaacatttattaaatgactacggcacacaaggtcctgtcctaaatactgcatatgtgttaatttatttattttaaataaaaatgcatacccagatgaaactctgcagtagaaatggtagtcattgtcattatcccaattttacagataggaaaactgagacacaaagctgtgaaataactagcccaagatcgtatagatattgagtgatatatctatatatatctatatatcactcaatatagatattgagggccagagtttgaattatgtcacactgacaggagacccaactgtcttaaccactgtactatgtacatctcattttaaaataaggaaagaaattcattgataagacttttaaagatagcttcaaacgtagtttaatttaataaacaaatatatctcatgagttcacagaagattttttaaaaataaagcaggttaggctgtcattgttgatatcatatcctatgacctgtcacgaaataaataaaaactagttatgtgagagctaattccaatgtctgtccttagaaaaaggcaaagacttttcctctagttgaagggaatataagggacatcactacattgcattattttgaaaaaaaggtagcaacgctggacatatggtgtggttcaagcccgtgctgagtaacttttggacagggacactaaaaaatagacctaacctagttaataatagcaaaccactgatccgtcgactaatcgtgtttataggaaatagaattcatgacaaaaagaaatagcagcatgggacagaattaatccacaacatgtaatttccttcctgtgcatagccttcaccaaaaggaaatctgaagactcgccacctgttcagaggtttgcttttcagaagatttggaatggcctcccctcaaaacgactcaaggcattcatttatgccacatgataaaaataagcactgtgcttgctgaaaagtgaattttgtgatctaaagaagaatgaagtaaaaaatagttacattttcaaacttaattttagtaacagattgtgtgtgtactaatatagaacacctgaaatgtcataagcagaaattagtgatttttattattttttaactgatcaagctgttttcctaatttatagtaaatgcttttccacctcttaaaaatctttaatttcttttctctttctacaggtccaggagtttaggaccagcctggcaacatagtgagactccagctaataatacaaaaattagcagggcatggtggtgagtgcctgtagtctcaactacttaaaaggctgaggtgggagaattgcttgagccctggagttcaaggctgcagtgaaccgtgattgcaccactctactccaacctgggagacagagcaagagcaagaccctgtctcaaaaaaaaaaaaaaggaagaaagaagtctcaaaaatgaaagagagagagaaaagagaaagggaaggaagggaaggggaaaagaaaagaaaaaagaaactgacagcaatagtagtcaccttgaggggtttgttgagagctgtagatatcatgtggaaaactgctggcacgtagcaaatgttctatcgtggatctgccattgccactatcccttgcctgtgcctggctagctacacatggggctcccaccgcattctgcaattccctgtatcattcattctcttcaaacatgctttttggatacttaatacaataacatcactgaatcccacagtgaatcccaccttggggcacctatacctctgagtgtcggaaagattttgatttttttaagttccataaggaatgctgcatgtatctgtggcaacattgtacaaactaaaatgtcaagttgctttctaatggatctggaattttattagttatttatttgtcccctacccccacccacacaaacccatattttaatattcatgaaagcaaggatgctgtctctttggattttgaatgctgtgtccagcaaaatgcaggttgcaggtgatgaataaacaagaagaatgaaatgccaattttataaaatgttgctcagaagttctgattaacactcatatatataatatattttttaaagaatgcagcttgtttagaatgttaaaagcctgtcaaacaaggggttcaaacccacacatacacacatacacatacatactaaaagaagccattggcccttggtggaagaaatattgaaaaccaatgatttaacccatattctggttatgtctgacttggagtattctgtctttgatcctcagatatggaatgtagaaaccatgcccatatatcttgtaaccaatgtagagttttagttttgtttttactcgtcattatttaataaataataaataattatttattaaataatgacgagtaaaatagcattttactcgtaatagcattcaacatggtaacagcattcaactcataagtatctataaaatccaaaataattaaatgtatcttgattttctgtgaacacatcaggattgtattttgcctaggacagaatcttagcacatatttgaagcattttctcctgtatgcattaaattatgtcctatcttcatagcaaatgacagagattaactattttctctgcattttgaccttgtgggtaatacttcctgtaatgtcctgcagaagctgctaatctgccaactgagattaggcagatttctctctctctctctctctctctctctttctctctctctctctctctctctctgccactctaaaattccaaaggggtcatatttgttttggtatttttataaattaaaaaatatgccaaaaatattatctaatgaagaatttaaatcataacatctggacaaggggctattatatttttttacaacctctgaaaatttgtatttaaaatagaatggatttctctcctaatctttacatcaaacataacatttgaaatatttgaaaagatgataaaaatgaatttgaaagtaaagatccaagtattcagccataaaggcattccattgggaaattacttgccaataatctcaacagctgaaatggatccttgcaaagaacattagatatagaatcgggatctcagacttttatgcctaataaactagatttcggaacacaaataggacttctaaagttctgtcctgtgagtagtgtgagtccaaaggattctggatcctccaagaaaatacttctttccaattgtcacctctgcttagcttagacaactcaggctccaatttaactccctctacaatcttcccaagagtagcaaaaaggaacagttatttaaaatgaaacatatatacaagacagaatgagaccactgactgatctcagcaacataataataaaataattgtaatcttaaattgagtttaagagcaatgaacagtaaaaaaacaaacaaaacaagcttccttcatacctacttcttgagctacttctctactactgtaaagattaaagtggaattttacttttaggaagcattgtagaatatgaaatgactataaaagttagtaattccctatgaaatgttttcagcaaattgttcagtctgagacgtagtttttccattagttaagtagagactcaaagttggcctgagaattgcataattctgagataatgtaagtgaaaaccattgcacagatgaaatctcagtcaacagtgcttttgccttaactactgaataatactaactagaggcttctggaaatctctgtcttcctaacttggaaatacacacacacacacacacacacacacacacgtacgtgtgtgtgtgtgtgtgtgtgtatatatatatatatatatatatatatacacattattggttcatcatttctgaaatcagaagcacttcagcaaagatctcttgaaatctccaaactactgacatatttagagtatggaaactttcttaatgttcattgcatctgacacagaccatcaaacagaaattctccagctctgaaaagattgtttgttcactgtcagttcaaagaattatttttccttttaagaagtttgaaagcctttggtgcattattcaacttgcctacaaaacatgtaagtgtcacggtatgcagtcttctttctgaaacagtataaacaaactacaaagagatgtgtgtttgagccctaatgttttcagagaattttttatttaagcaacatcttatgtaagcaaccagaaacacaggaatgatatgtttagttactataacagcatgacattttaaaattgacagtaaattatgcaaagagttagagattatgaggcctcagtgttgcaaacaataataggataaagttactttgactaacttggtagtatgttcacaggtatctgtgctgatggtcacctatctaaaattaatggaggccaagaagcaaaagttatgaagctaagggtgcttgctaaaagcatgtcaacctacaaagatgatggaaggattaatatgttgcctaactttcatcattttaaattgtaattcctttatctgttcaaatattttgtagattaattttatcaactgccacattactagaatatggccaattttacccaccttatttttaaacagatgccagagattgtggttgacgaaaattgtttttagaatgactatcaagaagatctattttagaaatcactattcactttatattcctatttaaaacaactgcagtgtctctttgttttaaatttgcacattcctcattaattctaaagttgagcttaagctgaaagttattcaaaacttggaaaaccatgactcactgtcctaaaggagagaatgtccccctctcagctatctctgggaagtgtgcagggcactcaatgccctccctcccaggcaagagcagcatgctggccccaccgcgtgcccactggtgttatgtagatgattcctcatcagcttgacttaccagcccaacctgcagcctttagacactattccctttcccaggggagggacctggaggagctccaggcagatcgggaggccagccctgggctctgctctgctgcctcccattaccccgctggacagcatcccaagcaggggaggatcccaggagagggaagacttttcataagctcaaccatttaccagatcttcttgagaaacaggaagaaagccaactactgaactctgcttttcacactaattttacagccattcaaacccttctctgccacatgttgacatccattacagtgaacccacaaaagtgctcctgcattcactgagttcttagcctacttttgtaactgacctaatttaatgtgtatttgtttatttacatccttaatatcaccatccaagtcattattacctgtattggactgcaaattttgcacaaatgggatcatatctgctcaattcactttgcaaaatgattgccccagaatcaaatacaagccttagagtacatgcttttctcttgggctgactgtggtctttgaagagcctcattaaagctgcattcaaggtgggagcccacctactattcaacggaagtggctctgctaccagcttccataattgaattctaatgaaataacacaaaatgtagctaaaatcctttagatgatcccactcatatccatagcccattaaaagaggcaatgagtcacaggctaagggttctgaagagtgcctttcttcacatatgacaaaacaatggaggcccagtgaggtaaaacggtttgtgcagaattagagctgactggcatccatctcctgaggctcagggttgcccttcacagaggaagcagcggacaagttgaaaactggaaaggtggcttcaagctaagcgcaaacaatacagtggtatgtactgacatcagccatagccattcctgaagttggtcttttataaactcatgcatttcaccatctgatgaggtagatgaaacaggggtgattgaacataggttcaaaatgcatcattccttctggaaacaaaatcaagttgctctaaaactcaggcttttagatgtgtgaccccaaaatgcaagtgtaagcaatgtaagtgtcactctacatacattttatgtaatatatatatatatatatacatacacacacatacacacacacatacacacttcattaagctccagtgtatgcattactctgaaaaatccctctctgctatcataacgctcatttgttacattttaagataaatgactgaaagcaaacagcaattgtgagacaggaaatcaaattccatcagatacagaagtctggtaccatctgccgagggtgcaatgatgaagtataaacacagagcgcattttgagccctccatagtgaccttgtacaaaagtgcccaggaaacaaagatgatgtgacacattttgcgacttatatataccagctggatataaaagtcataaaaagcaaaggtgatattatatatatttgacatatatgaactggattgttttgttttaatttatttaaatgttattttatgactatgaaagtactgagaactagtggaagaaaactggacaaattaaaaatttaaattccccataatccctccatcaagagattattttgaacatacagctatattttcttccaaacctctctatacttatgtatgtttgtatagatagatagataaatagatgatagatttaataaggtttatacaatgttttcattcttctcccaagtaatatatttacatggaaacatgttttatggaaaacatggtattttggtaggtaccatcatacataagcttatctgttaactatttcttattgttgaaggttcaggttatttctaccttttggctattaaactaacactacaactagcaaaattttaacaaaatgcacattacatttaatcaatttagttgccagggtttgcttcttcacgttccaaatttgagttatatattatgtgattgtttttaatatattatttgtgtctattactttgttcctcattttgtatattgttgatcactaatttgtaatactaattctagtaaacgtatgccaggcaccgttctaagcactttccatatatttgcacatagtacaaaataatgggcacagtgcccaatgcatactcaattatattttttctttcctcagctttactccccttaaaaaaagtaagttaaaaaaaaattgaacccttcttggaaacaacacagtctaaaagtctaagctttataaactaaccattaacatcttgttcagaataaaaccctttgggaactctatttgaaatacatctaggctcccctggaaaatgcctggccatcagttctccctgctgaatgcacagatgccttccaagtcttctccctaatattatacagattctttcctgcatttacatctattggaaacagactgacttggagacatgctgcccagagaccaggcctaaagttatattctgtgtatgatttaatatattagggaggaagttgtatacatagtaaataataattacaaatatcatttaagtataatgtggatgcagtgctgtagatattaaatacaaattatttttccttttttcactcagttcaaataacagtaccttctcagaccacatgctgcaggaaaataggcaattatttcagcattatccagacatgtcagctactaaagaataaatagcatatttatctttttaaaattatgtagcaggttggaaacaaatgtcattttaacagctggtaccagagtttcccaaagagagagaactgcctttgtttaggaaaatacctggagagactgttttaagtgggggagtatgacccaaggaaatgttttatgtgaaaaactgcacaaccaactgatgctgactgctccatgagatgctcatagaatctggagggtggagaagatatcaagaaaggagagagggcaagccatcagtgagagtggagggggcagtggtcagcaatggaacaggatgtttgatcatgtggaaaaggaggtcaatttaaaaaattccagtgtcaggaatgcaggacagcagctgaatgagtgtttggttctgcaaggtaaactgccttagtcactgcaaaccttcagtgaagccattatacacaccaatgccttctttgaatggtggtttttgttttattttggagtatgcatgagataaagaaataagaacagctccaagagctaagatttaacaaacaaacaaacaagatctagagtttaataggaatatgaaaacagatctagagtgaacatgagaacaggtgcccctgggaaacaccagaaatcatgggaaggacattgagcttcctacagaatataaagttgagagtttgggtcaactctgtgtacatttcaagggaacctaacatcatagttccatgaagggatagatacaatctctagaggaggagtataaaataaacaggataaaaaggtgctttccaacgtgcttggagaactggacttagatttcatctatttctgctattactttcttttattcctttttttccccaagtgcttgagtttcagtagtaatattttcacaaggccaaacataaaataattttaaggaattctaaatgaaatcaagccattgttctgatgaaaagtaagattttctttttactggttataaaatagagtagcatcaaaactgagttacctgtatgcaggctctgagtaagctcaggaggtagtaagggctgtccctgagcctgtgctgccattggtccttgaatgcttttctggatttagaaatgtccagtaaagaagaagcaagagtggccctctccctgaaaactctattcatcagcccagcaaagagagggtatgtctcatcaatgttctagcatgttttggtcccacctcatctccctcctcacagttatccactcttcaaagcagaggaaacaagcccctaccgctgtcagtgctttgacctgactctactccaccatggtcaccaacaacctcctaatgatcaaaaccagcaatcttctcttcatttccatgtctccacacttgctcctgaagtgtagtcttgtcataaaaactactcacctcaccttggaatctttgactctgtttatcttacgtattccactattgctctgatcctaacttcttttttttttttttttttaagttcagaggtacaagttcaggggtactgaaatgacttccaaaaacatttctccagatttctcatctctcccagcttcaagcctctatttccaaaagcatacactacatgtccatctagatatcttactaaataactcactatctatgtgtcccaaacagtggtggcaacaagggatgaccaggtcaagattgatcatttctctactaggcacctctcacaactataccaaagaaagaaaatcatatgtccgtactgcaaatgcagcaacttcttctaccatcttaggccccacacatataaattcagaagatgccacagaggctgaccttgccgcttctcctaaccctgcttcttttttttttttcttcctttgagatggagtcttgctcttgttgcccaggctggagtaaaatggcacgatctcggctcaccgcaacctctgcctcctaagttcaagagattctcctgcctcagcctcccgagtagctaggattacaggcatgcactaccatgccaagctaattttgtatttttagtagagatggggtttctccatgttggtcaggctggtctcgaactcccaacctcaggtgatccgcccaccttggcctcccaaagtgctgggagccaccacgcccagcctcctatccctacttcttacaggttatcacataaggaatctgagccacttcttattttgaaattatttcatctgtcttaatgtcagtttagtatctgtaacaataacttatttcattttctttccaatgaaatatatctttatctccataatacttagtgttccataatgatatgtggaattgaagggctctctacaacacaatctcctcatgcccacacctaccttcaacatttatcttaagctaagccactaagagctttctcaagttgtgcttcctaaagctgcagttctcaaaatccaccccacatacctatgaagcccatataggaagccccattttaaaaataatttttgtaatcgaataaatattagaaacacttcacacctcctcttggagattcattccaaccactattaggtcacactattttcactcatattccattggccaaggctgatcacatagctatccaataaaagttctgagaagtcatgcaattaaaaaaaaaaaaaaacctctctagcttctttatgtcaatgttttccaaaccttttattaagttatgtttattaatatctgaaaaacgttaggattcagattatctatgttgaaaactagtagtggtttagataaggtaggcatttatctctttctctgagagagcacaatcagcccaaagcttgtatggtggtttcaaggctccttctatcttgttgctctgtggtcctgcaaaagcaacttttcatccatgactgccccagctcctgccatcacgctcatgttccactcaatggagacaagaaaagaaggggacatattgcactcttttgagcaaatgacctgggaattggttacactattttcactgaaattccattggctatggcttgatcacatgatcacaactagctacaagggaggctgggaaatgtagcctttagcgacatgatcttatgctcagctgaaacctcttttattactttaaaaagaagaagaagagaacagaaaatggagaagaatttgtagtctctgctataacaggtccagaaccccttctggtacatgctgggctaaagacctgatgaatgagaataagattatggaggatgcatattaagtgatctagaaggaagtgttttaccagcaatatctaacatcttcaaacgttcacattgaaaaacagtcctttgccatcaattttatttcaccatttcttcaaatttagtgtaaattccaaccattcttagaaaattcctttattaaatatttttaaatattttcaaagatttacagtaaacaatttctctgaacctactgtccactgtaaccatacttcattgaaaaaatgcaatcaaaatttcttttctctaacggtgtgtatacaaaagggaaacattcaattacattaaataatttgtttcactccctaatccttaaattcaggtctgccactcactagctttgtaaccataagcaggtcagttgatttttccaagtatcaatttctgagtctcatttcctctgtaaaatgaaaataatgcatactgcagtattgttgtggggtttaaatggaataatgcatatatatgtcagtacgtagtaggtagtcaatcatcgttggcacttacttttgcaggcaaaaagtaggtattataactagatgatccttaatattctacatttctgtgatttaaaaaatagtaaagggtgggtaatgcagaagtgctggcactggaacttcaggcaacactgtagtaaattggtgctttttcccccgcaagagagagcagctttcttgatgtcatctcaaagtctaggaaacaggtcttgcatacacaaaagcatatttcagatggcatagccagaatgtctccaaatcgcaactctgacaaaatcaattataaaacttcataagattatcttgatcttataaaggactgcccctcatgaaggactctatgaagtcctcaataaaatttgttgatgacgggaatgacttagggttgctgggtaaataaggcagaacctaatgataaatgtagcaaagtcttaatgaaaaaattcattagtaaagtttactttggataaagtttaacctttgcataatatgagcaataaaggaataaacagtgcaatgacctctcacattaaaaaatgaaaaaaatattatttaaaaataatgaaattggtctagatgctctctagatttttttactctaaaattttaagaaatttacaatattaatttcagtgtgaatttttttagattaaatacaattctatgcattaagtacaagtacagaaagccatctgagttcgacagtcagctataaaataatagaaacacaaaactaaagcattccagcaggaatatcaaacataaatgcttactcatggttttgatgcagacaatcctacttttaaaaaattaaatggtattttttaccgaggagtaaagaagaccctaaataattaatataatcattggttcttattgcaaatagtcaatgtttaagtcttagctctctctcaccctgtcattcttccttttctatttctctctctctctccccctccgtctctctctccctccctctttctctttctcaccactttgagctgtatacattacatttttcaaaaagaaggaaaagaagagtcaccaaagacacaaaaagtacagaaaaaagaatgaaccttggaggactccatgactgaacatatttattcatttagaaattgcagccacaagaacacatctacttatactttcctaatgtcagaggaaattttttacagagcaaaggataatactcatgagtccataataaatccctctggtgatctgattaatgttcttggtacctggattaatacaatttttttggttatacattctgcttcgaagtgaagacttattttattaagaagaatttctggaatgtgtgatgttatataaatgtatttctggtagctatttttctggagataataagaattatagaaaactcactttcttggaatggtttacatccgtgaatttcaggaattagactgaactgacagttggtggggtaaatgctagttaagacttatatcaacaataaactcggttcttcaataacctggaaggttacactaagagttaataccacacaatctctgccctgaattcttctgtattttgatattaaactgtttgagagtacactacattccaacatttctaatgatttttcttcacaaactctctacatttttagacctgtgtttattcagcaaatggataagataaatctctgtgaactagccaaataatatcttgatgccttttaatacattgatagcatttaatcagtacccagcactgttctaaatattttaaatacttacaacttacaatagggtaggtattatttttattcccattttccaaatgaaaaaatggaagcaaagagaaagaaagtaatttgcctaaggttacaacagcttgtaacacatgaagtcaaggctgatacttcaaggcaaagggttgcagagttgcagagatcgtagtacaagatagaggattggtgaggaagactaaggagggggtacccctcatggaacaggattcaatagcaaagcagcatcaagaaggaaggaaaactcactggaatttatatccagaaccattggtctgagactcctaaaacatcctcagagagcaaaataggtctcattgttcacaacaggctccaacttggtagagggaggtaagtagtctcgttcatgaatgtttttatttaggggccagcgttcctaagcaatcattgccatattctcaccaggtttgtccacaagctctctcctgcatgcattatgagcactaactatttagcaccaacttccctgaccacgttctcccccgcccaccagtctgccccctcccgctgcccagaaagaaaccccctgctgcccaaagctcacccatcacataggaactggtcaagttccacctcttccacaaaatgccccctttcctcttaaatacctaaatagctacagcatttgtcatctgtactttacactcagtcacatatttcattgaaatgtttttgcttctctgcatgagtaactaacctgggaattctctgaggccaatgaccatgtagtattacttctctctatgtataagtattgcttaactcatagtgctcatcatggtgtttgctcacacaaattgcctaatgggtacttgttaaataaatgtatccgtgaatgtcataacttccatcaacccactatttgtggtgcataagaaaatgctcaataagtccatactgactaatgaattatttcactgttgagtcagtaattgtttgcagtattacaacaaaagactgtgatcctaatccagtactagttatttaaaataaataacatttaatatgtgtcaaaggcactttgtataattctacaggagccacactatggactaatccctgggattcatttctaaagaaggcaaacattttccttattctctcaagcctagtgagaatacattgcatccctggtcattccctccctatctttgacacatacttgacaatggttgtgatatttgagctttaatagtcatgggggagggggagggggagggatagcattaggagatatacctaatgtaaatgacgagttaatggatgcagcacaccaacatggcacatgtatacatatgtaacgaacctgcacgttgtgcacatgtaccctagaacttaaagtacaataaaaaaaaagaacaaacagaaaacaaaacagtatttcagagaaaaaaatagtgatagcgattaggaagaaggctagtaactcaaggctacagtccctggctttgattttgctttgaccgttctgtaaatgtgcatgtacacagcatgcttgcatgtactgcgtctggtgtaatactaagacaatgaaattaaatgtgactggaggttaaatagcaaagccaccttagtttatgacattatttggatataatcactataatcactatgaacatatctgtttcctagtaactacttaaaaggtagacatgcaatttaggggataattctttctgaaaacatctctattaaggccatgcctttttttcttctcctctgcaaaatgttttcgacttgtgttttatttaaatttcagaccagaatagtacagcagattacatagtaacttatatctccacaatgagaaaataccttagttgatcaaatttctaatactgaatgtttaatttttaaatgttcttgtttttaatctgaaaggctgaagaagagctaataaaatatatcacatgaaattttaaaagtgagagataaaatgtatgcagacaatattattccatttacttccatgctaaaccccttactttattacagacaactttggggggataatcctctggccactggagtccaactttttacctttgtcttcccactacctaagcacagcagaaactctctaatcgtcttcttattccaaacatcagatgcagtgcctggcacacagtaggcattcagtagttgtttgttcaataaataaatgagaatcttttgaagccacacaaatgaactaataatatcttttgaggatgaatgataaaaagcatttgcatcagagaataaagtagtctttgaagttgaatctctctaagagtctaaaaattcaaaggctcttctacatgaccatgacagtttattttatttcaatactactttgaaacaatgacttcattttctccagcttttttattttcctcaatcataattagaaaaggctaataaagtggtcatgtttatgtaatattgccaactaaaatctactgcaaactggtgaaaacaacttgtcacaactaacaaataatgtgagccttattctcacatatcctgttattcacaataattaacagaaaaactggttcaaagatctaactttgtattaattctaagtgcagcataagagatttacttttttactattccataataatattcatagaattaaaacaaaacaagtactttgactctctcagaagaaaaatattattcccataaattttaaatagtcctttcatgacacaaaagtatccactttttgcttatttgtggagtaaaatacatttcctatatttttatatatctatacagctgatgtcttttctcatttttttaaatttatttaaaatttttttatttttatttttgagatggcgtctcactctgtcacccaggctggagtacagtggcaagatctcagctcactgcaacctctacctcctggattcaagcaattcttctgcctcagcctcccaagtagctgaggttacaggcgcctgccacaatgtacagctaagttttatatttttagtagagatggggtttcaccatgttggccaggctggtctcaaactcctaacctcaagtgatccgcctgccttggcctcccaacatgctgggattacaggcatgagccaccactcctcaccctcttttctcatttttaaaagcttgtatccttcaacatttttctctatattctgtgaatttgtcaggtttctttttttttttcaattggagtaccaataaatgccaaggttagccaatgaaagcctgggcattataggatgtcactaaattgatttattgaccctttgccttacaacaccttcaacatcagagaagtagggattcagtcagaaactcctcaacacttagtattactagaattatgttaccaattaaaatttgttcatcactccttgagtgtggtctcttgtgagccctgtaaagaattaaacaaaaagtgatgaaggttttaattccaccatgggtctgcttgccatcactatatttctagatctcattgtacacattcatacattgatacaccattcattcccagcatttcccacatgcttacttttaatggtgtgataatctgattaatggctttctagaccattagaaaacccattgaaactcttttggtaaagagctaaaattaaatattttaggctttgtgcaccaaaagttatttgatgtaactactcaagttggacattataacatgaaaaacatcataggcaatatgtaaaagaataaggatggctatgttatgataaaattttatttcagtgtctgtacccctaaattaaattcacataattgtttacatgacacaaaatactagtcttcttttagtgtttttcagtcttagcttgagggttgtacgaaaaccagtaggaggtaggttcagcttgcagatcgtagtttgctgacccctgcattagactttcagacccataagaagagattctgtgtcatatcttaatttgccaacataggtacaggccttagacaatgctctatacattgtacatgctcaacacatgcttagaggatgaatcactgctaaataatttatggttctcttaataccatggttaccttgttcgtgtgtgaatgatttttttggtctctctctctctctctttccctccctctctctctctctgcctttctctctctctttctttctaagattctagtgaagtcagaacgtggtagcctgagagggttattctattcttaaagggtaattcttactttaaaaggtaagttatttctattaagttcaggatatttagaaagagacttagttttcaaagaagagctcagttgagtaactcaaatggtacaatgaactgaatgattatgtcccttcaaaattcacatgttgacagtctaatccccaaggtaatgggattacgaagtgagatttttgggaggtgcttaggtcataagactgaagccctcacaaatgggattagtgcctttataaaggaaacagacagctctcttgtcccttctaccacctgaggaagcaaggaaaaggcactgtctaagagccagagtatgagccctcaccagacacctaccctgacagtgcctggatattggacatcccagcttccagaactggacaataaacttctgtttagcttataagctacccatcttagggtatgttttatagcagcctgagcagactaagacaaatggtaataagccacacagcacatcatcaaaattgtcactgctaccttcctggagcagcctgagtgcaacagttaacagtctcctaagattgagagaaacatatctttggctctctggacccgatctactttgttctggtgccaactaccaacttttccattaaattctagtgctgtgcctgagcccagcaccaatgtagtattgtgtccttctgcatatgcaagacttggctgtggtcttcagctttattctggagtaagtgatagggtacagccccgagctaggtccagggctactgtcactcctaccagagcagatttattgctgcgtccctccacaatccttaaaatcatatagtcattttcaccctacgcagttgtcaccagcccttgccacagctaccatgcctacaaaatgacataccagcagcaaaggataactctgtctttgtgagacctactctgtggatctatgcaaacctatatagtttgaattgttctttaggggagcataagatgttgcagaaaccaagtacaaattctataaccaataatattttgaaaaataaaaagaaaaaatcaaaacaaagagagagttaaaatggagcaatagtattttatagctagtaagctgcatgttttcttgtgcatgactctaaaagcagtaaaaagatgctttgctaaaaagcatgactgatagaaattttctaacttttcagccacacgctgttgaaaatatttctaccaacgaaatcaaaccagtcttataaattatctacattccttcatgaaccatcatttacaagttacaattaagccttttcttcttttgaaactgtctttacaaatattactctggtaattttatatatggggtttggtcctaccttcagattagagaaactgtattttgagttctgagtagaaggcagagaggaactcgctaacatgttcataggatttgggaggaaaaaaagtctagaagttttcacagtggtgctaggagaagcttaaaggagtgtattccttccccgtgtcaagaatgtgttctctattcaccagagtaaataaataactgcataggtgtaaattaaaatagatagatcaataaataacattttttagaaccagaaaaatcagcatccatcaagctgagagtccccacacaataccatactgtggggtgtgctatactgaagaaaccaaggaaagaatgttaaagacttgattggaataaaatcagaccctaagaataaggctgggaaaaaaatacagagctcagagcccagcagctacgtacacctgaaaggattcaacaggtcccaggaaggtgtctgcacctctgccctgactcctccaatgctctggtttttaccacctcaaaagggaggtggtatcacttattgtaggaccccaggccgaccctcctgcttgtccacatggtgcctgtggtgcctacttggacttaaagtataaaacttggaagcatttaaagggtaagagaaatgcttgagagtcgctgcagtgagtcagcacattaatgctgactccacagttatctggattagagccggccttgtctgtgacctggactctcactttgcccaatcccaagcgcttgcagaatggctggctggccggagcccccgccaatttgtttttctggcttgcatttcattatttaacataaaccaggagtcagtactaaaccagccttctagttctcatatctttcatcatcccagaaattgacaaaaactgacagagttgagaggatgtctcattttacctgccaaatatttcctaccttatactctatagcaaaaaaaaaaaaaaaaaaaaaaaaaaactgacaatttcaaagcattttcaaagcagaagattttaatgtattgttattcttgaggataaatctttcaggatattaccttccagaatttctgatgtaacaggaaagagtaagatcagtatctgaagcagtttccacagataagactagatcattatattttttaaagatatgtacatggacatcagcttgttctgggctctcgcatatatctactacagtgtcagacacctaccaagtgcttaataagtatgaattcttagcttttccttcagggttttgggtaagcctttgcaattcccaagtcgaaagtcagcaaaacgttatatatcaaacaaaagaaaccacctcacctacaacaatgggcctgagactcagcaggatgagaaatatctttttatgaatacagtttttaaaatatggagccaccccacataataaacagcaggacaggtcaagtattagacacaatgaatgacaatgggtggcttgggcgtgtcttctgaacacagtgggccatagccatggtcctcatttctttctaattggcacatgtgacatctggacctctctattagcctgaagtcacagcactttgtgcaggaaccacagatttaaagagaccttggtatgtattcataaggctgaaatgaagatcacatctgcgcaactccaccagccctttcctcaaagtctctccaggatcgatgattaaggaaagcaagatgattgacaggtagtactacaaggattagcaaattgcagctcccttctcaccaccccactgtctgtccatctctggtatccattcctgcctctcacctcccaactaccaggctccgtgtttcttcccctagacaagatgatgaaagcaagagatcaggtattcaaaattgccatgaaggctctctcttccttgccatgccatccctggcatcttgtcagttggcttccaagtttcagcattcactctgtaaaatgaattaatttatgtgaaatttgctgatagatgcaggatcagcactctcaaaaaatgacaaatcttcctgatggaatttgtcttttaattgtcttcccttggagaatacatattttcactctccctattgctaccataggtactgcatttgtcctgatcagcacagtaacataaagaggccgtagagaaggcatatggccggctgcacttttcatttcctggttctctgttgacagtattgcttatttccagatggataaatagtttgcaccttaatgtaatcaaagactgaaaaaaagatgccacttgaaaaacatttgagaaaagagaaaagaaggggaaaataggcctctgaggtggtatctataatgtggtactgaatttcactctatcttcacaaacaataaacctcatgttttataacattttactgaagcattattttctaataaatccccttttgttttgattcttgttgctgtataataagcaaagaagaaaagaacaatggctggaaattctgtctgtgtgatttgaagtgctctcacttgcatgctgagaagtgttataacgaatatttttggcatcagctgatgatagcagcttggtactagcagcacttgattcagaatgtcatatgatacaataatacacaaattgagtgcacagagggggaaaaatcatgcaacctgtcataggtacagcgatattccatgagtattcagggctggagatgtagaagtagaaacctgaaatctgaaatatgaaaaaaatgaacaaacacttaacatccacaaataccaagcaaaaattaacaaatgaaacatagcagttgttatgcaatcataatacaagaggcttctctagtcaaaatcttatggcataaatctatgaatgatctgctacaactaaagtactcaagtcaatgggaaaacatatttattcaaataaaatgtcttttctatgactttttaacaactaattttcttaaaataacaggccttttctccattgcttaatcttcatcttccactgactttttaacaactaattttcttaaaataacaggccttttctccattgcttaatcttcatcttccactgcttttttctagaagactgtttggtccaaaaaaaaaaaacaaacacatcctgaatgattaggaaaactactaggactgctttatttaaaaatttatttaatatcagcagggaatttatttcatgttatctctaaaaataaacacattctaaatattaactccaggggcattcttttaaccccgtggcatccacttggcttgaactctgtcacttgtgtttgaatatttgagtggttgctgggaactagattgtcaatttctgtttgccctcccctcctttcttatttccactatttctccagtggtcaaaatagctgtttccttctgataatattagtgaaatttttctagtttcacttttccctagtctatatagttagactgccattgtccaagttctggctccctcagaaccatctgtgtgacctctatcaaaagacggctctctcagtgcctcagtttcctgatctacctcctgaggttaccgtgaggactaaatgagttacaatagcacttagaacaatgtctggcacagagtaagctctgtgttaatgttctcaacttgaaaattgaagtgatttcattgtgaatgctattattcaaaatattttaaaatacctactttgatttgtttttctcccatcagtttgtggattactttactttaagtagttggtatgattattttaagttggccacccataggagtttaaaaccagaaagaaccataaaaatcatgttgtccaacttctacaggaggttcttcatcattatgattatcaccaggcatttgttcctcagttagttatacttcttatcgattctggtgccactggagcgcatttttatctaagctcggggcatggagatgttctcaaccgtatctacaaattcactttcgtctctgtccctctcatcaacatcttctgaacagtaaagatcatcactccaccatgcactgtgatatctaatggttcgtggtgtaggcaaagaggattcctagttactctagacttttccttgccccttagcagccttaagtttttttcttgtcctttgacttgtacggtactgtgtggtttgtgatacctttgcactgtgtggtttgtgatacctttgcacaattattacacaatggatcctaaaaccaactttctaaaggtcggcgaagcaggcataattattccctcattctccctcagggcactgaaaatcaaaggctaggatcttgcctgagattacagaattagaagtaccagagagaaacataaagtccaagtcttaggattttctctccaaaggttttttcacagcaccacattgcttttacccaaaacacattgcttcatacaaccatattagcagaagcaaatacctccgcaatgggcagcgaccaagaaaatgacagaaacgataaaataatgtctgaatgggcagtaaaatatttacaccattcagcagctctgggtcaagttcacactgaggccatccagatgatgcagagattgcgaaaatagattcctgagttccctatccatccaaaatggagttgaaaaataaagtccctttgaactatagaagaaaaaaaacagaagaattgacctcagtcgtgttgctccttaatgttggttatgtagaactgagtttgcattgtcaggaccactgtttctgttccttttggaaggttagaaaaccattgttatttgtatatttcaactctacaattaaaagttttgcatccccttcagatatttaggtaaaatgaagttggtgtgacatttctcatcatgtctcccaggcccacaaagaaaacagatggtctctgagttctagagatctctttgtgttctatattaaaatgttttccaatagattgacatagtgtaggagtctggctcttcattaaaaaattgtttcttaggatttctgcaacttcttctgaaaagtataagattttgagttatcgtggtttgcagcttggtgcacaaaacccctctgcacaccgtattggaatcactttgcatttttggggtggtctgcagaatagggcaatggacttatggacacttcattggccttgataatccctgatgtactgcaaggcaattagcaactaaatttttgctaagtgcacttaagagtaataagaaaaattaaaatgtcatcaaaatgctaaccacagattcaactaaaactgaaccaaagaatggcatatttagtcttgagcttgaagacctaaatcacacaactatagaagcacaattgtgcatccatagttctccatttctccttccaaaccacttcccccagaaaagcagctttggagactgtctttacttcagttagatgctaaagctcaagaaatgtgaaacaacccagggaaactagaattcagcagcagtgctaagacaaaattaagtgcactcctttcagctattcatgaaatcctcataaagaggccaaactattgcattctatcatggagataacatagctgaaataatttacatgtttccattttagtgtagtaaatcaccccagcataaaaatcacacaaatatagcagaagttatcttacccatgatctacctactagaatcatttaatcaacaacaacaacaacaaaaaaagtaattttacagtggaataacatgactatgctagctcagacaggtgctcaaagtcaacatcaatggtgataagtcatactgatagtattggtagataaccttcaagtgatgggaaaaggtggcattttacctcggattttcctccccccagaacccataatactcttctaaacatgaagaaaatatcagacaaattcaaattgaagaacattctacaaaatacttgaaccaaagctcttcaaaactgttcaggccatcaaaaacagggaaagtttgcaaagctgtcacagtctagaggacccctaaaaagacagacgactcaatgtaacatggtatcttatatggaaaactggaacaggaaaaggacattaggtagaaactaatgaaatcctagtaaattgtgggctttagttagtaataatgtatcaatattgattcattagtagttatgacaaatgtaacatacttacataagaggctatgtaagaggaagctgggtgtgggatataatgagaactctgtactctctctgcaacttttctgtaaatctaaaactattctgaaataaaaggtttattacaaataaaaaagggcataggggttcatgcttataatcccagcactttgggaggctgaggcaggaggattgctttagcccaggagtttgagaccagtctgggcaatacagcaagatcctacctctataaaaaaaaaaaaacaatcaaaaaattagcagggcatggtggtgtgcatctgcagtcccagctacttgggaagctgaggtgggaggatggcttgatcccaggaagtcattaatgactgcattattaaatgaaccaaaactattttttatctcttctgttttacagttcaatgtgatggtgcccgtggaaagctggccacagtggctgggatgccctcacagaatgtgcatgcagggaagttctcgtctcaacaacacatggccgtaattttgtttatacacattgtactgttgcagtgtaagaatttttgaaatcacaagtataattgcaaaagacagagttatttctatgaaaaatggattggatgatttggcaaaacccggtagaggcaaatgtctaagagtatttatttaagtacatgtgttctcatgccataaacgactgggggaaaaaaactcatgaaaatcaagaaggatgctgcactcagcttgcttatgttcttcaagttctgctccacttaaaaacaccaaaattagaaatcatagatcgtgggtgtgatttctgcaggaactcagatcagttcaaccctaatcaaagaacacagggtggagctatctcaaagtactgatgaatgagcatttatatatttaatataaaataaaatgttcaaggcatgtgtgtatcatttttaataattgtcctgttttactctctatttttgtgaatttatcttttcaattaaccagttgctcctgatcccaattgactaacgaagacattctattgaaggtgatttttcattttaccttttatgtgttagtattttacagtatgtcttttaccatatgtcctttatttggtaagttccggtttttattttacactgttttataataaatgcgttgtgcacttctgtcacctttttttccctggtggactctagacacaagggtgattgcctaattatactgtgctgcttataagaagcagattagttaagtggcttcttagatgaacagtgcaaagtgccacatgaaagctggaggaaaaatatccccaagaacaaaagagctttaaaatgttgttttattttttaaaattccggtgtctgagaaaacatcatttcttcaaaattaagtgactctattttctaagaactcttaagtaggagcgaagatgagaactgaataaatgtgatgtgcttctctcttggcctctaggtaataaattctgcactatacagattacactagacgtgaatctgtttcttgttttatgctgagagcaagatcactaagacatactttaccttccttaacagaatctatctttctcaatgatggtgataaagcagatttttctacattggtagaaaactcattctaatcgaagttgaatagttccaagctgttagaattttctaagcaaaagaatagcaagatgctccaaggatacaacaaatgaaattcaacggttatttacaaattcagctgttcaccgaaaacgaaaagcttcttaaaaaattagggtggttgagtctgaagtatggtttggagaagtgatttttttaaatagggtatttataaaaatatacttgagaaaccaatccaggggagtcaaaatggatgcaaccaaaccttaagaatataaagcagtgcaaacaatccaaaagcagtgcttcttaggattaagccatgtgcacatttaaaggttaggagaatttcagcgtgtggcttggctggaccttttctgtttccattacgatcatactattgtcagaaatcccagctagcaagcaggcaagagatcatgaggaaaatcaaacaggagtagaaccactggggctgcctgaatttctacctgcacctttcccgatttaggcaaggagacttggctggacagcgggaggtggagagggaaagggatggtgacagaaggaaggaggaggccccggaagcgaggtctcaggatagcataggctccctgtttcttttcctttctttgcttcctacaagcattaaccttgagcctaaaagcacaatatgaggaaataagcaaacaagatgaggggcagcaccaaagaaatgctctaggccctaggaaggttagatttttgagaacacatcaacttgggtaacacaaaatatgagtaaaaacaaatatgagagaaaaacatatatgtaaactgaacacaaaaattgaattgaaccattaaaagttcgctgatcttatccctaaacaaacttctgggatatgtgtatttcatcattcgtgtgtttgaaattaaattttatttaactggtatttttaagctaactgttctaccaccaaaatcagttttaaaatacacttctagtttctgctacattctcatataatttaaaatcagccgtgtgaagaaaatacaaaccttagattcaaagcctagaatcaactatatacctaaaatataccagaactgattgttttataaatgagcaacagtgagcattcttctctttagaacctggctcataactcatctctcccaccaaccttcttgttgcttcctcaaatcttcccttctctccagctgaaaactacagcatcatcatacatatctgccttcttctcatgttaaatgtaatctatgcctcgagaatctcacctaatacctgctggacatttctaaacaaatgtccatatgtacccccctcagcaaattattcaacagctgaaaagtgtctttctccagatttgacagtcttgttgtattccctaaagaagttaatgccaacctcatcctctcagttgctcaagagcaaaacttctacataatcttctataaccctttctccctggcccctcatctctaatcagttaccaaagtgtgcccaatctatctccgtacggactataatttacaaccccatcagattttaagctctatcatagtaagaatattagatttgtttgaaatactgtacccattacccagtaccatatctggcacaagaagatacacagtgcatatttgttgactaaagttatatattactatatctaaaggcaattattttagttgttagcctttatatttcacataatcacacatgagaggattttcagggatcttttgcccatcacagaacactgatctaaatttgcttatattccctgttttcctgacgccccaaagtccttaccaatatgcacacagacacacacacacacacatacacacacacacacacacacacacacgtttaaccttaacaacatttcaaattgataatcactatatagaaattatttttaaaagaaaaaggctattaggctattatctttttttcatcttctaggctttcctcaaaataaagtggaaaattggcaagcaatgagtcaatttgataaaatgtaaacagtcaaatgaaatagatcaggccaaatgctttattgaaatatttagtttcatccatctacttaattgacaaaattggccatattgttaaaagtttaatttatctcagccttgctgatatatctataatcaaaagcagcattttggaatggaatagttccttatacatatttatatggagttgactttttaaaaagagttttcaacaaaatttcacataatgtagctgatgtataatgactaagaaaaataggaaaacacaattcaattgacagttatgaatttcctactttgcagacaataaaacctgctaagagtatgttggaaacaccaaataaaacatgggctcctcagctattggggtaggtagataaaaatgtaaattaataaaggaggtggattatagtccatgacaaagtggaaaaacagaaagctttgacttctgagcttctgtcctctccctcttgccctctcatcttgctttacccattccctcttgaacttggacttaccagtcaggactcactccacctctgcatgcatgcagatgagcacacctgaggggaaacaggcagctccacaagcacacttttcttcaatctatgacgactaacctcaagtgcgcctttagtgctggaaggcaatcttacagtattccctggagatcattctatacctcctttcttctcaaatcttcctgtacttcacacacacacacacacacacacacacacacacacacacactttactctcagataatggttttacttctgccttcactgagaaagaaaggaagtgtcatcggaagaacacatgcccaccaccatatctgacagccacctgcctctgtgtccagacactctgtcttcctttctgctacttttgtcaaaatgtccacacttttagatagggcctcctcctccacctgtatcccagatccttcctcacactgcttgttcaagagcattaccacagcagtttttctccttgagtattctttgctttcttaccagattaaggagaattcaaaaggtttttaaaatactatatctagcatattgaattgttttctgcagagcattgaatggagtgccagttaaccatgttggagatatattagtggttaatcctcagttacatctcacttgatccatcagcagcgttttatacaattaatctcccctctttattaaaacactcttccatgtggcttcaggaatcatgcttgctcattcctcccatcagatgtttttccaggttcttcctcaaatccctgtgctgtaaagatcagcctgcccaacagtccagctccaaaccaggccttgtcactatctatactgatttccaggtggagccatggactcagttactaacaactcccaaatttacatccccaatcctcaccctgtgccccaaattccagactcagaaatccaactctctgctcaccacctccacttagacatctcttaaaagcttcttaaatgttgcatgtctgaacccagacatttgctcccaactgccagatatcttcccacaaactcccaaactcagtgataactctctctgcccagttgctcaagccaaaataactcgaatgatctttgactcctgtcaagtctacttccagcatatgtccagaatctgacctctctctactctctccaccaaaaccacccttgtccacccaaccattatcttgtgcctgcacaatctctagtatttcattctaaatctggcccctgccatctattcctacacaatagccagagtggtccttataaaacataagtcagatcctgccactccttcactcaaaacccttcagtgttttcctgtcccctaggagttaaaggcaaacccctcactatgtcctacaaagtcctaaatgagctgcccccagaagaacatcctgcttctctgacatcatctcctaccactttctccccgactcactctgctccacccaaagtggacttcttgatgttgcccaagccaggaatgctcccacctcggcatctctgcgctggctgctccctttgcctagactgtctgtgttccccagacacctgtatgctctttctgccactctttctgtcctctgggcaaatgtcagtgaggatttccttaaccatcctacacaaaacagcatctgctccacagtgaaagcacttgctctcctccttttctgttttattttctttatagaattgatcaccatcttaaacactttgtattgttgtgcttactttatggttataaacacaccatgaggatggggatttgatcatttttttcagttctgtttcacagatttcaaaactataaataaaaggaaatcaataaagaattgccaaatgaataattgagtggaaattttaaaaagatatttatatgaataatcaaatctaacatttattgggtgtttgccatctatcaggttcattcagtattttgcaggtactgtaaactccaattttacaaataagaaagttagggctaacagaaatcaaataactcaccaaatgtcccacagctatagctagtatgtggtggacttgagacagacactcaagcctgcttcacttcacatcccaacccattgtttttctaaattgattccatgtatcttatggttgtgtcactgccacgaacctagataatgaccttagtgtacattaaacacttaataagcatctgcaattagtgtctttaaaattcaaactgcacacagtaggtaaagcactgaatgataacttatcagattcaaaaagctgtgtagcttgctaagcaacaaatttaccaacagcgattttagacaattagtatatctttattcattgctaaatgaatgctgtgactttggaattagcatatcttcaatttagccctcaaaagttggttggtgtttattgatgcaaatgttcaagttattaaaatcagtttgccaagtcactactgaacccaaatcatcatcatcatcatcatcatcatatgcacaaacaagaaaaatctattacattattttctctaatgataaatagcaaggtatacaccttgctttcttctctgaaacccagtccctagagtcctgtcttcctactgaaccccacgaacttcttgcttaaaggaagcagctaccctgagatgctacttggttcaatacctactctgttttggaattgtcttcctgcctcagattcctgttgctactctgatcctaaattcagccctactatgtccaatactgtcaactctacattctaccagctcctgattcttccctaacacgggttctctattcaaccctaaatacattgaaattgtactttcaaattttgcagaatcaccattactcagtcagataggcttaagaagtaagaaaaaggaatcggtggtcctaaccagccttcaagagggactccagtgattctcacttctggatattcacattcttctatgggcccctctcatatcaaataagataacctgtgtagctgagattaggccatagaagacactgggctatctgccttgcacttagattattctctctggaggaagccagtgatcatgtcatgaggacacaaaagcagccctatgaagtctacttagtgaagaactgaggcctcctgccaacaaccagcaccaacttgctatccaaatgctggcaccatcttagaagagggtgctccagcttcagtcaaccttcaggtgactgtgccttcagccagcactctaaccacaacctcacaaaagactctgagcctgaaccatccagctaagacactcctgaattcctgacccacagaaattgtgtgaaatgatgaatgtctattcctgtttgaaactactgagttttggggaaatttattatgcagcaaaaaataactaaaacagtgtgcatacaaaatccatttgtaaggaaagtaaacctgaaaagtcatgagtcctatgacaaagaaaattgtgtagaaattcaactcagcactgaaaatgtattggatatataaaacagataaaacaatgattttgtctttttacaaagcttagagtttttattatgagtctttatgaaaagcttttagctgactttttcttctgtcagtagagccctaaatatcagtatttcaataagtttgtaaaatagcacaaatagcctaactaatttaaaaaaacagagctccaatgactttaaactttaaactctgaactttaaaaaaaaattaagaagcataattttctgctgttaatgcagtagccctgctttaaaatataataataaccaatcaaatgtggattgcctacgatagaaacagatgcacaatacagaagcttaaagacaatgtcagggtgtgattatgaaagaaaatatcaagaccaggactaaaacagaaatatttgccttaaggatgaaagtttggtgttaatatcagaatagcattgtaattacatcagtattttacttccttatataaatacaagtttgctaaaccaactagaaatttgaacataaatcattccacatatgagttcagtcattctaaactaatttttcttcttcctgatttatgacatcctccttggagtgatattacagagagtgaactcagccaagtgaacccacattgtcaactgcagtcaattttcagatattgaagtaaacagatgaaatagggtatacccaacttatagatgcacctaaggttgccaatatttactctggtcttgttatatcacacattacagagaagaactgctgtaaatctaaaattgaagacaacagacatgaggataatatttggcttctcttttgaagccctggggaagcatttaggagataaatgctaaataatttcaatgccctgccctgcccacaaataaagcatttagcattcatcccctaatgaggaatatacaactcattttgtcggagaggtaccactttgatgcttccctagaaattgggctgtaaacccctaggttaccagaactgtgtctatttatggctctgcctctggccccaagttttgcatcctggttttggccaatagatcactactgagtgacagattagacaaatactcttcttctaatcagtacactggaatacagccaacacacattgcatcttatcttctaccaggcactgtatttggtgctaaggatacaaagaagatgaagagccattcctggctgtggagcagctcatgatcagtgggagattcaagcatacgcatagacattgcagggcagggaagacatatcatgcttgagagaaggcagatgatggaggggaagacaaagagaagaatcaggccttctggaaaaaataggtactaaacaggctgaacagagcattacagaaaaaggatgtcatgaaaatcatgaccttggagtttggtctttaggcagaagctcatcaatggacagctggctttgacaaggtaagaggggaccctatgccacaaagctggagcttctgcaaagtaagactgtgtgcccaaaacattgcttaaaaaataataatcacataagtatttctcaagggcccataaggccaaaagaatgaagaaagaaattagcatacctactctcaaagtgttcaggccttttaaccttttgaacaatgaaatttgcagtgcacagtatacttaattagaactatccaccatctatcagaaaaaggccagagtcatatattttcacattctaacttgtatgcacaataaagaccaccccctgcaaatacgtccacgtcctaatttcagaatctgtgcccatattatcatacatggcaaagagggtgctgcagaagtgattaagggtaaggacctcgagatggaaagagtatcctgaatgacccagggcatttctctgggtccaatctaatcctataaagtgggcccagttcaatcataggaggccttaaaagtggagatttcccagctgtggtcaaagagatggcagcgtgacatgaattcgatgtagcagagcacaagcaaggatggcagagaggcttctagaacataagagaggcctccagctgacagccaacaaggaagtggagagctcaatcccatgaccatatggaacctaacttttccaacatccaagtgagcaataaatgaactctgtctgagaacctccggaaaggaacgcaggcccctgatgccttcattttagccaggtgagatccacaggagacttctgacctgcagaactgtttgatcataaatttgtactgctttatgccaccaaatctgtgggaatttgttacagcagcattaaaaaaactaatacaccaataaattctgtttgtcacttaaaaatggagtcacaagaactggcttataatttgagtttataaaactaaattctgtacaatatccagaaatgttggtaccacttatttttatgaacttttaagactaataagtggtaccatttattgaggacacaccatgtacttgttattgtactaagtgcttcacatagcaataataatcactaatatttttagtatatgtacatgtatgttaggatgtgataggcactgtaccaatcattttcatgtattaattcatttaatcttcacaacattcttataaagcaacttctattacgattcccattttacagatgagggaattgagacagaaaggatatccataaggtgccacggccactcaacccccattgcagctctctaacaggagcaagcatttattaggaatatactgtgttctaggtaataggccaagtacctcccattcactagtgcactaatgccccaatagcaccccattttcagataagaaacctggggcctagaaaattttaataactttcaaggtgtctcacaatgaacaaatagtgctgctaaagccagaactgacctcagaacaggccctctcagacatccagggtgtcctcgagacaccagaaggctgggctggcatcaacaatgtgtggctacctgaagatgtcctttccctaagaaccttcagaagactatttcagttaacagatttccagacgttggatcaagccagatatctccctaagatactcaagatcctctccattggcagagggtgggctgcacatccaccaagtggacaactgaggatatttgtgtttaacaataaaaagtttcaatcacgttcccactttttacattcaatcctgattacaaaagtgactcaacatgtattggatgtccactatgagcagatcaatataatgagcatcaacgaacatccaaacaggtataatttctccaggggtactgatttatactttataactttcaagagaagttaaaagggcttcagtaacacatttgggtaacaccacggccctaaagaaacttacaggatgtataaagggggaagtctgatcaacttcttataatgttctagtaaaattcaatgcaattatgtcaggaaaaaaagaattggactaaaaggtagcagacctagtttctagccccagctctgcctgagtgatctgaacaagtcattttacatgtctgcctccatttcttcatctgtaaaataaaaggatcagtctacaatatatcaaatatcttctgagttctgagttctgcgattctgctctttgaaatctgccaatctgccctcacacaagagagtggttacagtcaggcaatgtgctaaacaataagactggagtgggacctggtacctggggtgttattgggggcagaagatggcaaacatccagacttcggagccactttgtatatgaactaggagggtttcttatacaaaaaaaaaaaaaaaaaacacaaaaaaaacagaccctagaaaaagagcactccaaagtatctgcagaaatgtagtgagttttccaagacctgaataaaaatgggacaccagaaatagtaaccttgctatgttagtaatggctgatgtacttgatacttggttaatgggattaaatgaaaagtaaacatgcacccacacaaatgcatacatgcataacatacacacacacacacacacacacacacacacacatctcgcacagtaatgcgttgagtgcctcccagtccttcaagtggagcactgagccgatcaacatggtgctattacacaagcttgctgcactgcaccaaactcgctgagcgcacagcatgcctggaaacgctaccacgttctcctacaagcataaaggagtttctggaacttctccaaagccccatgctttcatcagctaggtaaaggcattcacttcaccggctgaaatgacggggctatcagcctgcactaaccagccctgggaagtgcagttttatagtttctggtactgcagagtaccacagagcaaatgggattctgcctagatctgctaggaaagaatcaaagagatgagaaagttgcattttactgcccacaagtgatttctcttgcacaaaaggaccatacaatttgggtaaaaagaactgaatcatgaaaaagtcaattcaataatcaaatgcaaaaatcggatgagcactgaaatgtttaataaacaatatgctaaaattagtgctgcctattataaaattgcaaaggatgaagcagccacatatttatccatcaaagggattatataaatgaaaattctcagaatttaaaatcttcttagagcacatatcctggctcttttcccctccttcttcatatatgatggcagggacctctctgaatcttcatcctgcatttgctttagcctttgaatctcagcaactcttggacaagtttcatttgaacctagcaatctcatctggatagaaacctctgataaggtctccatgacctttaattgttttttacccatgcacagatatctcttaaaaatatataaggcatccacttccacaaacatctctgtgtgactctaagctgtcacttcaccagtttagaactccttttcttaccctataaaatgaaaaggtttgcttccttctataatagctctgtcattctggcatcagtttatctttaaatggcttggctttgaattgggaaaactttggaaaggctttaattctaacaagcccagaaggtgagaagaaggaaaaacaagaggatagttttactcttgccctctttggtcttggttaaaatgaaacacacgtgtgtgtgcatacacaaacacacatccttccccctttcctcacttagagtatatttttactgtttgtttgtttggatcaccaactatttaaagtgagaaatcctaacaggcagaattcccgaattttaaaaatagaagtgaccttgaggagcacaaggaatgaatggaactaataagtattaaaggagaagagaacttactttttgaaattagaatgaagtctttttgctttaagtatgagctgagcttccatatgcatctttgttgtatctgtcttcagagtttgtgcccacaagggactgaaaagtgtctttctgggccaggagatagagggaggcaaggaataaaaccttctttcctttctgtctctctcttcccgtttctctctctctctctctctctctctctctctctctgtgtgtgtgtgggggggggggggtgggggttgtttaactgctagaaaactcccctttcctttttctataaggtagccagccccaaggtctaggtaaaggaagcttggcctccagcaggtctgaagtccctggtctcaggagttaactaatcatttggggccagattccagaccagattgttctcccttgggggtgggaagtcactgccagggtctcattttcaggagctaagaactgcatccagggcgtgacctaattcaagcctgtgtccttctaccacaccagcatcgcctctgttaatatgatcagctgtgtcccatatggcccacttgcatcaaaatttacacacacatacacacacacacacacaatttaaaaaggattcggtcagccattaactaggctagactgctccgttgcaccctcattcagtgttcttccattcattacattcagcatggtccaagggaagaggttatttcttaagggtgtgaagaaagatgcatttggacatgcattccttagggagaacaaggatgttcttttctaagagggtcatgaacagatcacactgcattaggagtttctcttggcctggtttctgggccctggggagttgagctttatgacatactaggggcagctatctgatcagtcttgaagaaaatatcttttctatgtgagctctttaaagtaaaactaagttttgtcaatgattctccccaagaaataatggtgtctttaattctagctacaatgcccctgctggcaagagtccatccttccccacagctgaatcgggccgatttaaaagtcacctcatgcatttgggacaggttggaggtgtggaaaaacactcccattacaattcagaagtgctgtcatactaccagaaccaaaaataaagctgtagaaaaggagagaggaggagaaagtaagcagaagagattaagggtcaggcaaagcaaagggcttaaaaagacagcgtgtaacacaggatatttgaaacgaacaaagaactgagctattttaaagcacaactacaaacacttctcgaatatctgtgatcatagatgagagctgaacaagttatcccccatccctttatggttcttagaaatacagaaggcataacacaacatttgccagaagaataaataagacaacttaccgatgtgctaaaaagtctctttcaaatattgaggtaagccaaagggaaatgagtatctcaatgttactagggtctcatattttccaacatttgttcaatttggcccacacattttaatgtttcatatttatgggttaataacattttaatttgggaaccaagtgacctgagttttagtttagctgggccgctaagaactgcttgacgtttggtatgttacctactctgagtttcagttccctatctgctaaagtattccattctctttaaggttgtctacgatttatgaaaccattattgtcctctcttttgtactctctgactttccattttattacataatgaacaagtacaagacctaaaccaaaaaaaaaaaaaaaaaggcaaactctgcttgctcatttaaatgaaagcagaaaaaaaaaacttaagtgggagagagcttatattagcaacctacttctggacaataccaattttcaaaaatactattttcaaggaggtttcatttacagcgttgtctttcattcttacaacaaactttggaagctaatatttattactgtttaccaaggagaaattcagatccaagatcaccaaactaatgccaattaaaagaataaataggactgatacttgggccaagggtttaaaatgtctgtatgttttataaaaaatcaaatccactagaaattgtattccccacaaacacttatgaatggcattataccactgcactattaatcctagtgctgttaggaattccaactacccccctggatggcttaaagggatagagacatcagtgatagccctaggaaaaatataagaattagaacttataggagaaggaagtgtattgttttgttttgttttgtttttcagggcatggatttgaaagcttctgatagcagaaatttcttgctgattgttttctgctatcaacaacatcctcagagacatatgaagaataaagaaacatttagctcttccatcgaagccctacttctggactccgtccacagccccagatatccctttcagtccagagctcggcaggtacatcactcaggggctgtgtgaaaagtcaagtggggtagagaggagacacaaccctgacaaaagcaagtgagttctcctcctcctgtagcggaccaacctactccttcctgagccacagccataggagcagacatttagttcaaggacaacagagcaccttccaagcactgatagccttacagttctccagggaaaaaggcagggccaagcaaggcccctctgcaaggttcacattcagctatccaacaatcaattcaacagtgtcttccacctcactgtgggcagggcactgctcctggaaggcaccaggcaatgtcaaacccaatcctgagcctggaagcactcacacacagggaaagcagccgtggaaatagctcaattacaattatgtgcctagtctcttcatcaattacaacagaagtggagaactcagaaactgagtctcacgaggtaacatttaaagtcaatcttgaaagataagcaggagttgtttgttggagccagggaagggcactctcgtctcagggaaaggcataaaagaatgcagatcatcactgatgaaacagtcccgattttacaggaaatggtgagaaagtgaaagtcaaaattgtagttggtggtccaaacaagatactctttgggaattctctcagaaatactccatttaccttttaaggcgttgggcaggggaggggggtaagagctcaaaacagttcacattgttggttttaatagatttttaaactaataacataatgaaattaaaatgtctattttcagccccaaccccaaaagaaatatattcttgtttgcattaaagaaggttttcaccaaaactgttcaggttcatttctatggaaaatcattcaggcatcaaccctcatgacttcttcaacagtccaaatggaaagcaacaacatcacgtcacaaattcctccacaaagtagtactagacgttcaagacagagaaattaaaataccaattattttctctaaaactaccaaacgtgttttccatcactcaggcagaaaatgcagccattacgaaacaactctgccaggctgaggccggagaacacagccagcacacagacgaccaagatgttcagtccacttaagaaaatgcacctcactacttcaggggccacgcaagccatcttcatgaggcattacgtattgaaaaaaaatggctaattttctgagaggtcagttgaaatataagagacagaaatttctttctgctgcttgtacagtcaaaatttattgaagtcagttagcaacaatgtaatttgcctgacctgatcatcttacaaattgaagtcatcaataaagtgtattcacttgtgtatcatcatgttttattcagctggaactgtctctctccaccgatggccccaaacatatattacatgcacaaattaagcagcacccattctatattgactacttactagttccttctgaatatgtcctcaatcgcgctatacatatttcctgaactgaagggaccattccaagtgtcttcacggtatatgttacttcaacaaaccgaacatattaatactatatggaatgtctgcattttccagatactgtactagatacaaggatccaatgattaataaaaaagctttcctgccctcagagagctgaaagtatagttttattatcacagaaactcacaattattcatagtaaacactcagaaaatatttggtgaataaacaggtagacgtacatgcaaataaacaaatgccaatcactctttcaaagttgtttacaacaagagttactgtttttattctgaaagttaatttctgctatcaggaaaaaaagtcgtcttgtgtattaattcaggaatttcctgcaaagctctgaaagcaagtacttgctcacacctgccagaagggtttggtatttctcgacatgggagtaaatataatgttttattgatctcacttctattagctttggctaaaaatttatatataaaaatacataataaatgtacaaaattatacatattatattaatatattatataacatatacattattataaataacatattaatgtataataaaagattcacataatgttacacacacatacaaacatgtatacatatatgcatatatacataggatatacaaacatatatgtacaaacatgtatatatgtttgtggtaatgtggtaatatatatgtatattgtgtgaatattatatcacacacacacacatgccttccctaataaatcggtcaaagaaatgagtagcaaggaaaaaatattataaaatctggcattcctcctttctgtaaaggggatctttttgaaaagaaacacatattgctctaagagtcagtcacactttcacagacagaagatactgcttccaaagtgcctcccagcctgcaccccttcaggggacagtagagcagttccctgaagccctacctcaagttcaaaaactatcacttctctcaaccctcccctgtaggcaatgcctgtaacatttcactgcattttttgcgggcctcttttacttgactaagttctctgagagccagcattatgaaccatttgtgtttaaatgccttgtatttggcacagtttgggtcataacccaatactgcaaaaagggaactcaatggcatgggttagtttattaaattaattttaaaatcattttccttttagctgtcttgtaatccttcttgaaatagttgaggatcccctagcatttcacaaaacaagagttggaattttctgtcccaaatattattgcatctaaaatatatcagcttgggtcctgtgtaccttagggagaaccccaagcttgaaataaactaggtaagacctcaaatacagcaaggcagtgagcctaacacagatttattgaagctttaattccctcttcttacctttctagcaaattactcctttttacaatatcccaagatattttaaaaaaaacctgttgtatattacattacactctttcatgaatataccagcactgcaaaaaagcagaaactaggacatgactacttgggtgcataatgagccctatgcaatcccacagctacactgtgcagagaagaataaagcatttggccagtgctgtctcattaggggaaaatatgtcctgccaggaggcaagggtctaaactaggagcccccttggagtcccatattaaacccagcagactgcaaaataacagaaattaacagaaggataagctttgtgactggagaaaaatttaactttctcaaatcctaaaatcctgacctttctgccacagtactcaaccaagttttcatggcatactatcatgttacatacaatcagttgtgggacatgtcaaaagcaatgttaccaacaatagtctctcaacatgcacatcaagggttgaacattcaacaaaaatgtggtaagttgatggggtgacagatatgttaattcgctcgcctgaatatttctacatagaccaaaatatcacactgtaccccatacatatatacaattattatcaattaaaaataaatgaataatttttaaaagggaggatatcttgcacatagaaatcccacacatcatgcaagttgactatgaaactaaacatgttaaaacattgagaaccacttaggacaacttaaacaaaatacatttacaaattgccttgaatcactctcttgaactatctctgtatatgtgtgtgtgtatatatatatgcatataaaatattacaaatattggcgtgtagtttttcagccatggtattattgtaggctttaacctttttgttcagatgtcctgaaacagaccactttaaaaatcagaatttttgaaaatattaactcctttttgcacggttaatcatacaacctctgaaacacctgagaaattatagtaaaaataatgtaatccattctcagggttatcatcatgattactgatattaaatgctggcatctttcaggatgattgagatgtggaaagagtagctctgacatgcagtaaattcacctcatgatactcatgatacttcttttgattgtatggcttttttaggccattttccatctttttttgggccattttccattcattaattcatttcattccatcacgtaccttctcagacatgtgatatagacaggcaccgatgtcagtatgcctgcctctagcacagatgcatttctcctacactaactacttgctacatttattctgcaagaagccattaatttacactatacagtcactagctttgtgagaaaataagagtataaaggttctgagtaagattcttaagaccttttctagaagtaaataatttgaaccatacataaacatttgcaagatcgattcagtaatttatattctttcgttattcctttattcccacctgcattctgtatagtggtaataagtattagaaaaaaaaagatccccaaaaacaagaggaattaaatatatatatagatattatgaaccaactgatatgttccttcctcatttacacacattgaaggagttaagaatgtttcatcctttctcctggttttctgcttctgtctctgttataaattatatcacttaaatataaatgaatgaatttttactctatagctttgagacattctggtttttaaacctttgttttttttctaaacactttccaaaatataggaccaaatttttaacatacttgagaggcttgagtaagctgagaaccaaggagagcagcagatccctcagtcctggacaggacccgcccctcccttcactactggggaggaaacatcccaccccttctggcttctaccaaatgtgacaacttgcctgcttggccttctgttaagagctggatttcctgtccccctcccacacactgggcagcagccagactgcaaaagtccagtttgaccatgtggaaacctttgcttggttcctgccagagcctttcagtaagctgccctatttagagtccagctcagataaatcctccccttccacaatctggcctactacaacaattgcaagaccatagacatcggccccagtcatgcttgatttttaatttttgtttgcttagactagggtttattcatcatgttaccatcatgtctgaaaaaactgataatggtatctggcattttcagtaaatggagggagttggaggccccagccacctgggtctttcccaagtatcttgaaagctgagaggatcaacacctcagcacacctgcagacatttagggccaagcagtgggaagatctaaacccctggaaggagccagaattcagtttgaaatctactcacatagggagtgccctgggtgccataggagctgctggcagcagggggtcccaactgcgtatcctcagccttagagcacccaccctacccaaactgggcactcagatgtatttgtgtcctaggctgctgtaacaaggcaccatcagctgcgtggcctaaacaacagacatgtattgtctcacagctctggaggctggaagtctgagatcaaggtattggcagagtggactctttctgagaactgggagggagactctggtccacgccttttccaagctgctagtggtttttctgcctgtcttcagctttccttggcttgtagaagtatcaccctgatctgtgtcttcttcttcgactggcattctccgagtccctatctgtgtataaatttcccctttgtgtaaggacacagtcatattcaacgaagggtctgccctactctagcatgaccttatcatgactaattacatctgcaacaacagaatttccaagtaaggtcatattctgaggttctggggattaggacttcagcacataaatttgaggggggcacgtttcaacccataactccaggaatgacattgatggctacctgtagatcatctgagacagggtttggcacacagtaggttggtactcaatacacatgtgagttaaataaacgaatgcatgagtgaatcatcctttctgagtgccagtgaagaagtctttaacttggggtgtcgtgattttcatgatcaccattgagcattgaagactattgaggagagaagccgttgctgcgagctttctgaggctgcttgctgaaagacgaaggcactccttgctgtctgatcacagcagaaggctctgaatttgaagttggagtgctataaatagcagttagtcttatccttcaaaatgtcatgtgtactttttaaaaagattttagtgtcatatgagagtccctgagtaattcaatttataggaaagggagatcagaaagaactaaccatattataattaattacatatgcaaatgatggactacatctagatgcatgaatccatgtctaatcatagttggcaaaggttggcaactgcacacctggactggggaacacaccccctgctctgcttagatacagacgccatcaacaacctctgaaaatttcccagaaaacctggaaattcagtcctgtaagtgccaagcctcctgccttcccccatccctctctggggcttgcccccaccagcacacagcagtgcagacaccatacagcatggctgcgctatggtgaggcatggccagtgggaggaaggccaccaattgcatacaataacaactttgttgtcactgctaggagccgaaccagctgcgatgccttacaattgctacttaaatgtaagcagtgtcaggaaagtctgaatgtaaagaagtttctcagttcttgagccaaatgaccggttgcttgtgttcttctattaactctaaaacaattaactctatcagcttatgctgatagccactgtgcattttttggagcacctgggcactagctaaggatagtgactgatatgtggatgatgaaatatataatagagatgatatagacatagatgtgccaaatgctatatatacatgtatgtatgtatatattcatatatatgcacatgcatactgatgaaagccactttgctgatatccccaaataaccactgaactacagattccagatttatagagcatattgttggtgttgtttctgagagtacctaccatagtattcctgtggaaagatacacacctatatagtttccattttcaaaatgcatgcatgtgcctctgtgtgcgtgtgtgtgctcccaaagcagcagttgtaggggactgcacagaataatcgttcgggagataatcaggagtcctagatttgagtcccagtcttgccactgatcaaaaatggaaagaatgagttctatcacccaaagtatgagcatgcaattaaagagattatgtgaaagaaccttgaaaactccaaaaaaaaaaaaaaatgaccctcatgagacttcacaagtcaacaaaggtaaaaatcaatggcaaaagtttcaggcaaccttgtgttcatccaggtggagacatgcttaatctctcctgaccctgcaaacacttctgggcacctccctggcatgcattcagttggtgctgcactggagttgccatatgactgcatcctgagtctctgctgtgggactggagttatcctagggaaaatggtgactaaaccaatttcctcttcagtgttctttttcattcccatttcctcctgttttggagacttattttgtcatacagtcttaaaggaaagggatctggtttgctggttcacaattagaggtaggaggcaaggtagctcctcccctaggagtttgtgctctttgaaagccaatgtgggaggacctccctagaagcacatggagatatagctgagcagcatctatctactcacctacatattcccttgaatggggctaaagatgtgcatgttatgccaaaagctgaaaaaatagcaacatgagataggagaatggatagtgaatgttcattgtgaactctttaaggagcaatacctcatttcctatttccttcatccctcccattcacctttcacactgaattcttagccaactctacataaaatagactcccaataggaccagtatggctatactcaaaatagcctctctctaatatgggctcaatttataacctgggtagctggtacagttcatacgtagaaaagttttggccattcaaaaatattggaatgtctgattcctgcttgatattctgtagaagtaagggcaccaatttgcaagtcaggaggccagaccacagtgtctccttaactgccaaatgtctatatatccttggacagaccccttcattgcaatagagcacattttttctcaataaaatgactgaattgaaagctatagctctaaaaagctttcaattcagtgctggaaattcaagttatatggactgttttaatttccatggtagtcgataaataatatggtatggcattttggttaacttgaaattaccatgtaactccatatatggagttactatataatttgcaattctcaaagaatcataatgcaaaaaataagtatttaacaatgcaacatatagaatacaatttttaaatgaatttgaaacataatgcttcccagggtcattataaacacaaattttcatttatccatatattttaaattgctaattattggaaatttttgataaattcttgttagtggcttttccatactctattgtttaaagtacgtttgtgtgcatgtgagattattacaagcaaaggtaactgaatagggacctactgccaaaatctgcttacatttcactaattttgattaggccttaatgtgttttctaaacttgggtagggcataccaaatacaacaaaactagattccacatctagttcataatcaggagcattaagtatatgatgactctatcaattctcagtagtttggattccataactaataaagaatcatgttttatcctgattaattggttcagattaatttagcaccccctgccaatgtcccattttaactgtcttcaaacccaaaggtagaaagtggcatttaaatgtttttcaactctgtactgggagcagaccaaatttcctaagtcagatccaagccagagtggtttgacccagacaggattagattgagcctaggaagggtgagattggagagaggcacccaaaccctggaacacaaggagggtggctgacaagcccttttccttccagcattcactgtaatgaaaaactaatgggctggagatttgccttctaggaagagcttaagcattgctttactaaacacacctacatattgtctctaaatgtcatgctaagatgtacagggtattgccatgaacttcttgagcagttaactcagtggcttaatgcttgccgtgaagcatctttaaacggaaacatcctttactactaagactgaggcttcaccatggtatcaaaggaagtcagtaaaatgtaccttggcatagagtgcaggaacatatttattactggtgggaaagacctattaggcctgtctgtcacaatgccaatgtataatttatccctgaggcttttggggatcctataactgccatgattttaatggctggtggtgagtcatgggcatttatgaagatagagcacttcaccgactactgattggactcctaagatgcacataatccttaaaaaattatccaaaactttgtcttaaatttgaagtcttctcatacttataaataaagttgtggttcaatagctctttctctgtcttctgcatgatttccttttggtacaattatcatcattgacttggcaaaaacaatgtaaaacacagggctgcatggaacttctagaatttcagaggatgaatacatttgtagcttcatactaaaatgtgtctaaattattcctaaaacatgcattataatatgtgttctaattccacatccctattatagaaacaaatacacatacattcccgtactgtcccatctctacctcttccagtctatcaccaaacttaacattaaaaaaaaaaagttgccatgtgatattgaaaacaaaacaaagtataagctaaagaaatatcctactttaacctctttgatccttgcttttctcacaaattgatccttacgctagcatttcttaaactggcaaacagcttaaaggtgaaacagaagccctgtggtttctgctcataaagtaaatttggttagtattgactccaaaggcttttgtttccatttttgcccaagtgtaaggttaaaaaagttgctgcaatgtcaatttataaattattgttaatctgtgtcagcatttgacacatcgcagtatatgagaaacactgagaaaaattgttccatgtcagtttgagaccttttaagctgcattagtcacagatttctctaagaatacctggaattctgagtcctcaaattaaatcaggattatatgtagttataaaggatttataagttcatattttctgtagttcattaacttgcttctttttatttcatttcctgtctttgttattgatgaagtaagctaactgaatttcattaaagtctgttttataattttcatataagttgtctaaccaataaatacataaaagactggtttcaccatttgaaaggcattgatatgacattggtaaagatcaaaagcttatctcagagacaaattgaaatcatatcatttgtgtagtaatcaagattaaatttaccaagagtcctttctttttaaaaactgtattggctcctttgtgaatatagcagtaagattttaccagacgtccctctatattttttgacctttgagccttgaaaagataaatgacctacaataatcaatattctatcaatcattaagaacaaattggaattaagttaacctcctagtagcaataaaatctcatactcataggagatttgaattcaggttctgagattaatttgctgctctcccacttgtaatgtacaactaaaggaaacaaatttagttcaggtcagtgattatttcattaagccttcaaaccactgcttaacagaatgttatatatcagatgactctttaaaggatcccaacgtgcagtatgtgtgtgtgtgtgtgtgtgtgtgtgtgtgtgtgtgtgtgtgtgtgtgttgctgtacatgtgctgttgtatgtgagcacaggcacacatctggaggcattatcatatatatccttgtctgattttatgggaaaaagaaagctatgataatatttttacactcaaggacaataatcatagctataaaattcagtgtgcctaatgccatatcctaactctaagataaaagtggaaagaagcggctgtgggcttaaggaatggagggagagaaccctctttctagtgccctccctacaacactaataagagcctcatatgtgttgtgatgaagagcttgggctctagggttagactgactgggttcaaattctgtttctaccatttactaagtatgtcctttgagtcatttatctaatctcaccaagcctcagtttcttcatctgtaaaatggggcatttatttttactcattcaacaaaaaaaggtcttcaatgtctgatacatgctgggcgctatgcatcctgagatgcaatcataaacaatacctagctttcttcccaccccttgtggagctttaatgctagtggtccttgtcagggttagatcagctcatgcatcaaagtctttgacacagtggctagaacagagcaggccctcaaaaaacgtcagttcatgggaggataattatcaccgggtgtcaggtgacatgatctccaatccccacaacaatagggtaactgttattaactttgttttacatattaggaaactaaggctaataagataagatgtctggcccatttatagtttgtttttctctattaaagacagatattgcatttttatatgagaagatctgtgtgttcaaaacgtgttacaaatgtgaatacacttaaataataactccttaaaactcacccccttttcactgtaccatatcgcctgctaaccattaattgatatttgtttttttttgataattttgcaaatgttaaaggtgaatttttaaaaactttactgtgattctcaattcaatatcataagcacacacatacatatgcacacacagcaccatcaaaagatttttttaaaaaaagaggaaaagatccttgcaatcatagcacatcaaagagaaaatgctcaaaggaaatggaagaaacctgaaaataaaagatgggaccagacttctacaaacagctgtcaaatagcctacagaaacaaggcataaaggatcccaaaggaaagatgaaaaaattatactgggtttttaattaaacctggaattttttttttccaaagaattttgaaaagaaatggagagcatcctgttagatcaaggttatgaacagaagaaaaaaattttagaaaaacgttgtgaaattatttttctctttttattaagaaaaaacaataccaacagtctttacaatattgcttggggccattcaaagactgtacttccttttcatgatcattttctgtctgatcttgggtcttaccacaccctcttgtgcaccccactcagccattgtgggcaccgtggtattatttgaatgtgcaaagaggcatactaacaggctgtttcctctgcctggaattctatcgtctggagtgtatcatgggtaaggcccttccttccttcaagaggcctgcactgtccttacaatttaaaatttcaatttgcaacctcacccgtattttagtaatcctgatcccagttacctaagctttatttttcttctaacactaccatcctcggtcacactatgtgctctacttatctaccatgtttatcttttattttgtctgtttcctcctgcctagtccaaaatgaatataagctcaacgaaggcacagaattttgccttcatttgtgtttgttttcattcatctgttcactggtgtactctggtgaatataaactgtgactaatgtgaacaaacaaaaagtgtttgttcaataaatcctaaatacctataatttttttcatacttgctccaatggacataggtgatgcttaaaagcaaaaccaaacaaaatagcctagcacttctgattgggcatctttaagagtaaaggaaaactaatcatctctgttacttgtagaattgaaatgtgagatgaattcagatcactatgagtattgttcaattcaaattttaaagcataacctcaaataataactaaatgaaatttgtaaataagcccagaagcccaggaataacaatcaaagcatcaaatgcaagcatcaaatgaaaatgcaataaatttcttgactgaaaacatgtcagccaaaatactgtattgaaaaatgccattaaatatgctaaagtgacaaactgcacaatgcaaataaaactatcagtataattaagccgaacttatatagaattattatatagcctaagttcaatttaaataaatcaaacccaaaagaagaatactgacctcttgcttatgattttcttggcccagtaaactcttttcttgggacatattagtgattggtaaataaataatgaatggtataaatatttagcactacttcctcatcgctgaaggaagaaaaaagtacttatctatttataagttggctatgaaatggggtttgggggatagaagaaacatgcacacaagaaaatagctcaaaaaggaaggaaggagggaaggagggaaagggagggaaagggaggagaagggaggggaagggaggggaagggaagggaagggaagggaagggaaggaaggaaggaaggaaggaaggaaggaaggaaggaaggaaggaaggaaggaaggaaagagggagggaaggaaggaagaaaaaaaaggaaggaaggaaggaaggaaatatatatgagcaaaccaatgtttcagatatgggaaattgtgactaaaaaagagggatcatgaaaactaaaatatatgaactagtagaatatgattttgaaacagtcaagataaccccaattattccccacggaaactgaacctgaagggaaagttctgttcagctcatgtgttaaaccataataatagttcaacccagcataagataaacacagaaaaaatccaaaagcccaaattgaaacaagttaaataaatagaatttcccagcaactatgatcacagttcaaggtgtcttcatcaaaataaagttcaaaaatgccaagtaatggtctaccagcctacctggtgtagatttctggtcctccaaattgcataaactatttaagtccctatttctttactttcagtaacattaatgttaatataaaattataaacacagcttctcacatttggctggtttgcaacacatctgttaggatccaaggtgacttggcagggagcagtgggtcaagtcaacacaccacaacataaaaccacttaaaagtcaccactaattattattgttatctcgcataagcttacaccaatatacaatgcaagggcaagtatccattgaattactaacagatgcctccaactccaaacaattaccttaattcaaataaatagatttggccaaatcacttatataaatctcttttatctaacagagggcgactgtactacgatcatgaaaacagaggagatcagctgggtgtggtggttcacaccaataattccagcactttgggatgctaaggcaggaagatcactcaaagccagaaattcgagaccagcctgggtaacatagtgagaccctgcctctacaaaaacaaatttaaaaacttagttaggcatggtagtgcatgcccgtggccccagctacttgggaggctgaggcaagaggatcacttgagcctgggaggtcgagactgcagtgagccatggtggtgccactgcaccccaatctgacagagtgagaccatgtctccaaaaaaacagaacaaaaaacaaacaaaaaaaaaggatatcaagaattgactcatttccaaaaaaaaataaaaataaaaataaataaaaaataaataaatggtttataagcaaaaggcaggataaaagaacctggaaggatcaaaaaaaaaaaaaacagaataaatgctggaatgtgaattagcagaaattcttcactgctatgaaaagaaaaatgaaagtggcctaaaactcataagtctccctattatctcaaaccagagcacgaatggtcttctccattctcccttctggaatgaaaggcagtgaagtctcactgttttattttgtacttgaattttaacataaacaaacatttgcaacttattcaagttaaccatcttgaaggttgaagttcttcataagtacatttattatttaatcgcttatttatcaaaaattttgaccattaactatgtataaacctgtgccaagcactaactgggcagaaatcaaattctttgcaagtggctataaaattctgtgagtggtctggctaaaataggtgaatttgtcttccagatagactattttatcttccatatttctagaaaaactgacatctaaacatgtctctacctcctctattttcccacataaagcacaggtttctatcctccttgtagttatttgctagaatattagtctgcccctctagactgtgaactcctcaaagcaagaattctgtccattcatggagctcccacctactcccacacttaaagctctagagcactgcctggtacattgtggatgcttagaatagctgtatcgtgtgatacacgaaggaggagcaataacgtagagtggtaaaggggaaaatgagttccttagtataaatatcttgtataaattaagatacattatacatgtataaattaagatggagccctaacaaataaatggagccctaacactgctcatattccaggagttataagagtattccagatattctggtgttccggtgaaactgatgccattatttgtaggaataggaaaatcctgaagccctacatgctcttggcaaaccctccattctcctctccccttatcacaccaagcctcaccaccataatgtccctaggcctcctacagcctaagtttattttccatttttaagaagcctaggagttccagttcgttcctgacctctcagactgtcaccccatatggttctgtacatcctcctctctggccctatccactatgacctaactgctgaagttctttcactttcaactttcagttgagcaaatagagggttgcattaatacccatgagcttacatcaaagctcatggctactagtacaaaagctcatggttattagtacaacccactatttgatcaacttctctgactctacccttcagcttcttgctccaaggctgagagctggctctcctctgaagatttggcttcttattagccctgtgagtgaaggctgctttttttccacatgaccccaacagtagtgtcaaaagcctccttgttctttgccagatctctctccattccccctcccgaaagacctatagctcttctgcactgcctgtgagcaggactcaatgtgagcagacctttgtcattcccttaaaacccatcaaccacttgctctgtattgcaaccacctgctgaccactcccttccctgttggagttcttcaacttttagttcatcatcaatctacccaagagtattcaaaataatccttggtgatttccctttccagttcatggtggcctttcagttccttgcatctttcctccaaccttgtgctctgttcaacttcagctgctcagacctgtggatgtatccaagaagactgaatctcctgaatgacctcattactaagcacccctgctcagatcaacacctcctgttttccaccttactcctttaatcttaaccctaccatgttgtacaatccattcatctcctcaccctttccatggcccttacgcacccccaccttatgccctcacttctcagcttatatttcataattattagctctttattacactcttctggcaaaactctgatcacatttaaacctaaattttcaccaactaatctgtgaatcctgaacctgacttgagcatcatgttcacttccccaaagttaaacccgcaatcgtgccagttattctcactctgatcacacaaccgctaaccccaagtggacccttaatgctgacaggcagggagccagcagagacgtgtttctgtcactctaaccctcttctagaggacaattcagtattgttctccactccaaatttcagcagagcctccctgtctgcactcagctcaagatctgattttgccttcacaatgagaaaatagaagtaaacagaagagaatgccctcaactcccacaagttcatctcttcacctaccagcatctgtgctcctatccgctgccttccttcctattattgtgaaccaattttctctgttcttatctatgatcaagtcctacacttttgtactggatcccatcccatctcacctattcaagaacattgctatagcaattctcaactctctctcctgcatcatctatttttcttttaccaattaatcatactataatatctcaagtcttacaaaattaaaaaaatcccatactctcttgacacaggaataattttgggacacctaactccaaaacactgcctatattcttgctccttccagttcttcctccagtttctctttagctatctacaataaagtttcaatcccgccccactcccatttcaagtatacctctgttcatgcctttgctgcaaggtgactttcttggcaaggccttcctgaccaccctactcaaaactgcaagctccacacccctgatcatcactccctcctcccttcatggcctcattgtcctctaaagcttccgttaccatgtgacgttccatgcatgtatttatttcttcactatctgtctcccctctacaagtaggaaagtgccatgaaatcaggattctttgtctactttattttctgcaatttttctggcatctaaaatagcaatatgccaataaatatgtgttaaataaattaatgaatggatgtgagagaattatagcatagtgcttaattaacaccagagctttggaatcagaccgtcctccatttgaacagcaactttggtgcttggacgtgtcattgaacctcactgcaattcagttttcttcactgtaaaatgtggataataaagtatgtcataaaattattaaagtaaataaaatgttatatataaagcagtcagaaaattccttgggacacagaaaacaaccaacaaatgaatggccacttttacattgtcccagatcaaaaggtacaaagccgttttaatgattaaattctgaactgctccattttctcatattttaatatcccaaggcccctaaagacatagtttcagcttatgcaatttaacatggatattggtataatcccaatagcttggacccatattggaaatgctgttctactccatcacatgtgtgcatcatcagcttgcatgtattggttaaacatttgacttcattattgtacattcacactgtagttcacaatgctcctaatgtgtgggtgcacataccacccagaaaagcacagaaaaccacccacaatgatgtgaagagacctaaagcaaaatgtcaacatctgattaaaataacttcactcttcctttgaacaatgcatctccaaggggattgatttatagcattatttctcatgccatctttaagaacaaggtgaaataaaataactgaaacacagtataatgaacacaagctacatgaaacgcacaatgaaggattttagggttcaaatgcatttttcatacataattggtggacaagagaatcataaaagtttcgaattggtagtatagcatccttacaatataaatgagaaaagtgaggcgatccactgagtttatgtgaagagaatgggcattaagaaaatccttccccatggaagggaaaaacttccacagagtaaattccccatagcagagacagacaggcagcttaatggaatagaaagggcacagaaatagcaatcagcgcagcacccaacacaataaatatttgtgcaagaactgaattaagggtatgatgacctgaattctggttgtggctctgcccaaattctccttgaataagtaactttacttcttggtgtcctttttctcctctttgtactaaacggcagagtcagtagggttaagagcatgttaagtgactgattgtaatttgtagagataggaaaagatgggaaactttttaaagtttttttaaagactcccagagctgtggtaggacagtggatcctaaagatcacattctatttcaataaatagaaaaattaaaacatttgaaaaaagagtaagtatgaaaaagagttgactgtccatttccccaaagaaaatgcataaatgatgcagtagaagtaaaacactcattattctgagatgccattgtatgttaatattttaaaaatatatcttaaatctaaaatcacatttttaatcatcagagattttattaactctgtgtgtgtatgaaacattaatgagaatccaaaaatgcaagagtgaggatcccttctgccatgtttgtaaaactaggaaaattccattttcccagaatttaaggctgcaacccatgatttctccagaaagagctttaccaacatttttttttataaattcaacttctgtgcatcatgtcctcaaatacatcatccacagatgatgactaactcacagcagacctgtctcctctcaagtgctggttgaaatgttaccatccttcttgacaggtctaagtatgtcagttattaataataatttttacttataagtttcttaacacttataaaagaagaccccccaaaagctttgcaagttagacagctctagtttgcatatatattttaagcatcagtgaaaagacatgataagtgatacttctcaataaatagctcagttacaaacaaatcagaactaagaccagaagtcccattttttattccttgatgtgactgtcccataattcttctagctaactaatgagaattaacttaaaggagatcacaacatagaactcttatgaagatatttctatatgcggtatttctagaaacattacaaattctatgtgttaagctatgtaaaatttgggaactagattatcatactgcactaagtaaatcttgggatatccaacatgccacccacgggccatatgaaacttccaaaattgaaaagcctcttgattatatatatgtaattcatgccaaaaagtaaaacttcccttctaccttaacccaacgtggctctcacatatgcgaagtgttcattgtttgaaaacacatcaaatgtccatgatttataactagaaaatcagtgtgtgtctgtgagaatatgagtcatagatctgcaagcaaggtaggaaggtctttattccaaataaaagaaagctggcccataaaacagtctagcccagggtcaacttgttatttgaagatcaagcaagatttaaagcttatgtcattggttctaaactgagtcccctgctataccgtttcctatggactcactgaagagtcaaaaccatggatgttacgcaagaagaggcccctgggctttcggtaaagtaggaacacaaaggcaatgtcagagatattcagcatggttcttgtttatgatttcttgtgttctgatgatggaacatgtaaacagctgtcaaccaattaccaaaaatactgaactcattcagaaaggacgtaaagtgtctaggagtgaataaacaatgctcactccaaaccagctgctgccacttagggccaacatttgatccaggacaaagaaaaaagaggtatttggtcatttgttatggtaatcaccagcgtgtaaagggctcttcccatcagagaaatcacccaacagccaccacaggatgtttcttattttgacgactgaagggtgcatgctgggtctggaggagggagccattgatttattttcaccacttttccctggctgacagcaatctaaaagagaaggaacaagccagatcactcatctgcctgcttggcatgcctggtagtcatgggagcccatatagaggccatctgttcaggtcccagtctctccaaacatgcacagaaagatgacgtcaaaaggggtgtgcttcagccccattaatgagccacccaaagtaaaccggaagactcagcctgagtagcccacccatttatctcctctgttagcagccaagttcaatcaagtcatggattggggcaggcacaattatttttaagtttatttccctaggcaaatgttaagttgatttgaacatctgtggtttagtcctatctgatagacatataggtgggtagattccgtgagtcaagaaaaatgcacgttgcttacaacctactaaatgaaacccacctcagaagacatgatgttcagcattagcctgatggtttggtagtgcaccttcaaactcagctttcaaatgcccctaaattactgcagccagaaaaattctctgcagcaagccatgcagatgatggccactcttcagaaacagcagtgtcatgtagctctactcagtgaaataaaacaaatgagatgttctcttttgcctcaagatgatcctcccattgcaccaagatttatgatctattacaaagaaatgccaatcactacagattagttgggataaaaaaagtgttcgtataaggcttctgtgatcagaattctaacttcatgttatatgcacagtatttatgaactcaaatagaaataatttggctttctaagatgttttgaatttttgctttttgtaccctaaaacgtgtcttgcatttttagttatccttgagatgatcatgtgaaggatgtcctagatttttcaaaataacccattatgataacaagagaacttctgggatctaggaccatttcagcagttatgttggtagaggcacccctccatcctcaagaaaggacctgttttcaatccacagtaagaccccaagtgaccaagcagaccgtcactgactagaagccacatcttagagtcattgtcacatcttctgcttttttcccgtctataccctcttccatcaaaccctactttcctataattgcatatccatattccttcagggccctccctgtgtctctgtacgatgaaggtagctcatggtgacttgttaatacatcacatctcagtttatatctctgcattccaagctagactccctgttttacttggcccaatctctgaagctactggaaagagagacaacaacatcttcaccaatgcacaaacatgccacactagccttcatttcattattctttgatcatttcaatactattattttgtttggtctttcctgctgaaacccctgttagattttggacctcatggattttctaaattatctctaattgctatctatgcatctacatctatgcactggcctattccataaataaccataagggttctcaataagagtagtcttttgttaagattaagtaattttagcagacacaacccaaaccccattccaccaagaaataaaatatagtgaaaacacttcacagaaaagaggaaagaaaagcccgaatgcctatgaaagaaagagaccaagaaggtgcactccattttaccctgaagaacccacaaaaagcctaggagttggaagtaccagatacaatgcaagggaggagtacaggcatgactcatttgactgtgcctctctttaatgcgcttcacggatgctgtgctttgttacaaattgaaggtttgtggactctgtgttgcaccagtctatcagtgccatttttccaagacaccctgtgtctctgtgtcacattccagtaattcttgcaatatttcaaacttttcattattgttatatctgttatagtaatttgtagccagtgatctttgatgttactattgtaattgttttggggtgccccaaactgtgcccatgtaagaccgtgaacttcattgataaatgtgataggttctgactgctccagcaattggctgttcccccatctctttccctctccccagccctctctattccctgaaacacaagaatattgagatgaggccaattaagaaccctacatggcctctaagtgttcaagtaaaaagaagagctgcatgtctctcgctttaaataaaaagctagaaatgattaagcttagtgaggaaggtaggttgaaagccaagatggctgaagctagtcctcttgcaccagtttgccaagtgtaaatgtgaaggaaaagttcttaaaggaaattaaaagtgctactccagcgaacacatgaatgataagaaagtgagaccgccttattgctggtatggagaaagttttagtggtctggagagaagatcaaaccagtcacaacattcccgtaagccaaagcctaatccagggcaaggtcctaactctcttcagttctattaagtctgagagaggtgaagaagccacagaattaaaaatggaagctaaaagaggttgattcataaggtttagggaaaaaaaagccatctctctagcatccaagtgcaacgtgaaacagcaagtgctgatgcagaagctgtagcaagttatccaggagatctagctaagatcattgatgaacgtgtctacactaaacaacagatttttaatgtatatgaaacagccagctattggaaggaaatgccatctaggactttcatagtgagagaagataagtcaatgcctggcttcaaagcttcaaactcagccaagaggggctgactctgttgttagggactaatgcagctggcgatatgaagttgaagccaatactaattcatcattctgaaaatcctagagccctcaagaattatgtacctgtcctctataaatagaacaataaagcctgaatgacagcaaaactgtttatagcacagtttactgaatattttaaactccctgttaagacctactgttcagaacaaaagcttcctttcaaaatactactgctcattgacaatgcacctagtcactcaaaagccttgatggagattgtacaggagattaatgttgttttcatgcctgttaacacaacatgcattctgcagcccatcagtcagggaatcatttcaaatttgaagtcttatcctttaagacctacattttgtaaagctattgccaccatagatagtaattcctctgatgggcctgtgtaaaatacattaaaaacatctggaaaggatccactgttccagatgtcattaagaatatgcctgattcatgggaggaagtcaagatgtccacattaactgcaatttggaagaagttggttccaatccttatggatgactttgaggggttcagaacttcagtgaaggaagtaactactgattgggttgaaaaagcaagagaattagaattagaagtggagcctgaaaatgtgactgaattgttacaatctcatgataaaacttgaacaaatgagaaagcatttcttatggatgagcaaagaaagtgtttttttgagatggaatctactcctgatggaagatgctgtgagtgttgttgaaacaacaatacagaatgtagcatatcccataaacttacttgataaagcagaagaagggtttgagagaattgagtcaaattctgaaagttctatggtgggtaaaatactatcaaacagcatcatgtgctacagagaaatttctagtgaaaggaagagtccattgatgaagcaaactttattgttgtcttattttaagaaattgccacagccaccccaaacttgagcaacgaccaccctgaccagtcagcagccatcaacataaaggcgagactctccaccagcaaaaagattacggctcatggtaggctcagatgattgtcggcattttttttaactaataaagtatttttaaattaatatgtgtacattgcttttttagacaaaatgcttttgcgcatttgactgaatacagtatagtgtatatataactcttatgtgcactggaaaaccaaaaaattcacatgactcactttatttctacatttaatttactgtgctcgtctgcaatatctccaaggtatgcctgtacattcaagggaaagggttgaaaaacatggtaatattttgtctggttttttttttcttgttgttttttcaaaatcagatgacatatgcatacaagggaatattttgaaagtctccataaggaacatttaatttcttgcatccctacttccaacacaatctattacatgattacccattgttccttccctcaggaatgttgagaaatattaggtggagaaattgagtctgagattcttaggaacattggagggtgacagtgagaaacactgacatccatgcccccccttctgcccagcttaggatgtaaacagttaagtttctgcttccttaaaaggagactggagaatcctgctctggagagagtgggggaaaatgtggacatactgactgacatttggggacccccaaccaaaaatgatctggctggttatagaaaagctgatcaatgaactaatgtaactttctcacaaagcttcccatccatgtttaatgaacataagtagaaaaacaaagattaccacgtttgagaaagcctccaatttaaaatagagaataaaataggaaacaaaagtgagaaacaaaactgaaaaattcaaataatctatcattgatatcatcaaagatgtgatgttgtgcccatgaattaaaaacaagatatcataaaaaggaataacaaaaaaataagaaaagggccaggtgccatggcttatgcctgtaatcccaacactttgggaggctgaggcgggtggattacttgagactaggagctcgagaccagcctagccaacatggtgaaaccccgtctttaaaatacaaaaaattagccaggcatggtggtgcgcacctgtaatcccagatactcgggagtctgaggcagcagaatcccttgaacccgggaggtggaggctgcagtcagccaaattgtgctactgctctccagcctgggcaacagagtaagactctgtctcaaaaaaaaaaaaaaaagaaagaaaagaaaagttccctgaaaataaaaatataaatatgtaattttttaatccaataaggggattagaagattaaaaacaaggaattcttgagggtgtgaacaccccgttttccatgatgtgcaaatttcacaccgcatgcctgtatcagaacatctcacgtaccccataaatatatatacctactatttaaacacaaaaattgaaaataaaaaaatgtaaaaattaaaaaagatagattcaaggaaatttgttccaaaaaagaataaaaagacaaaggactcataaacaaacaaacataaagaaattatttagaaaagccatgagttccaaaatcttacaggagtttcagtagaaaagaccaaacaaaagaatttgtatggaaatgatcaaagacataattttaaaaacaaaattttataactgaaagatgtaaatctctaaaattgaaaatgtctaacaaaatcagtaaaaatctacatcatatgcttaaaaattccaaggggtgaggtgagagcaaaggtcccatacaaaggatttttttaagtggcatcatagttctcaacattattgaaagttagaatcgaatgcagtgatatcctcaaaattccaaggaaaaacaattttcattctataagtctgcacctagcaaaattatcaatccaaaaggaggatagaaaaagacatttttagacatgtaatatcacatattattttcctttatcaagaagtcatcatggtgagagataataggaaatccaagagatagaaggtcccacataaaaagggttaaagaagtttgaacaatgatagcatgggctacgtaaactcacagtaaaaaagaataaaaaaggaccacaccatctaaagtgagttaagcactcaccacaattcattttccattttccatttttactagcttgctaggaggcaactggaggcaaaattgaggttaacgacacacggaataagaaaggagcctactagtgtttggataagagattaacagaatttcaaaggcacttggacttgtttagtttatttttgaaaagaaagaaaaaaaacacagtaattagtatcttcagattcctactagactaatggaaacgcaaccaaattcagctcatttacaattctgtctagtagtgcccagccctgaatttctttccagttgcaatgttttcagattcaaattgcccatccccacatcttttgccattttggcgaatcccttagaggggagccatgtagtttagaatcagaagcaattgcgtttcacatcaaaaaatatttttatttcagagaaactaagacagaaaagcatagccataataatcttgcttctcttttgagttacatctaggattgctagctattctttgcccgcacatccttgccacagtacaaacacatacacacacacacacacacacacgccaaaaaaagagtgttcatcagttccagaaggttcacaaaatatacaagccttttaccctaaaaccttgtgatacatcccaaaatatcttttaccatcagagattagctcatcagtccttttgtctaactatcatatttcctgattctgaaacaatagctcacaactagaatgacctttaaatatgaaaagaaatagagaaagtgtccaacaaacaaaacttaaaatctatatgtggatcaagaaggcagtcataaaatgcaaagggcttcttattacagtagctaaaggcaaggtaatcagttaaattaccatgatgaatgtactttcgtgggctttcagagtttgtaataaaatggcaatcagatttacccaagaaagcaagaatatcccatgcatgtgtaatagtttactcaatcaagaaggatttgctaatcagctactatctgctcatcactgaatttgatgctgagatttttattaagtaaaatatgtgctattacacttgttgccggtgtaattatggtaagaaaactaaatatgtgttaaatagaaatggagtaaggtagaataaccaatgagaagcttcaaggaggaggtgccactttcactgtaccttcagggcaaaattaacaaaagtaaaaggggggaaaaaagactcccctagcctgggaaaaaacccaacttttgtttctgacaattttataacaaaaaaaagaagtaggatgggatttaatccagaataaaagtgaatagctttacagagtagagaaaatgcttttatatgagactagagaagagtaagaggacaattatttatgcaaataaaaaagaaagaaaaatcattccattatgaggagacaaatttgttttgggttcctgcttcattccaaataacagaaagtacatatacaatatccatcatccattcatctacccattcattcattcagcagacacttcatagtgcagattgtgtgttgaagacaatagcaggctttgaagaatacaaaaaacatatagttccttccctgaaagtgctgctgatgtataattaaaggctgttcttttccccttccccaacctacctaccatccctattgtgagctcaaagcaggaaggctgacaaagctgttatttgaaatatttgtatgattgagaaggcgaccacctttcaaggtttccaagacacggcatttttcaagaactgtttatgtccttcttcctatgaataagacagaaagctgacatacagctatggtattactcttctttttacttgaaattgcaaaatgattaaagccatcaagcaacaatagttgacctactgagggaaaataccagataggtgccctggagagattgatgagtgaatatatttagaaaggattcccaagactatttgcatttgtctctgagactgctttctctcctttgcctctgtggttagcttctccatagctccatgttgtcatccaaactgaacctacttgatatggagcctcctaagctacagggaaacaagcccactcatcaacacaagtaataacagactgggaatcttcactcacgcaatcaaagtttctgttgatttcagtagaaaatcagtgttttctgatacttttaaggcaacacctacaagtttaaagccatttagataaagccataagttacgagggagttatgtgtctcaatctctccattcattgaggacttatcgttcctggggcacttttctgcaggggaacaatgaagagcaatggaaagtaagcggtggcataactcccagctccaagcctgatgtctcctgaatagtccctacattaacgtgctactggaatgattctcaaatacaaaaggggaggaaggcattttggaaatgctttgcatggactcagggcttcatttttaatttgccatgaaatcctacataagttacttaagattctgggcctcagctttctaaactttaaaaaaaaatatgaaagaaaaatggacaaaattaacattctctgattcaacctacattccagtgatggtgtctactttggtaattacttttaagcctgcagcaatggcaatgactaattctattactacatataatactgaacatactaatatatgactttatattatttcagtaactcagaaataacaataatccagtaatcaagatcagtgatagctcaaggaacaaaataacagaaccaatcttaatagtcacaggaagccaaacaggagtctagctaaaaaatgttgatgtcattttcctctatatgcttcctacaaaattctaaacccatctcagaacaccagtggagggcaaaatgggtcaataggcacatttccatagataaaatgtggggtgggtggggctcaaaattgagaattttagcaacaatgctgtttttcttagcctaaagtattttcttctgtaggaatataagtatttgagtaagaactgaaattagaaacccaagcaactagtctccaatgttttcaactacaacattaatacaaaatcagtaagagtaagatgaagactattttggaattgcaggcaaaacttccacgaaggatacagtttttgagagtaggcacagtcaatagttttgactctgaggtatcagtgaatctatttataaatcaactcaactaattgtcatgcagggcctatccacgcagagataataagagcttagagtcaaagagggaagggtaatgaccacgcagagataataagagcttagggtctaagagagaagggtaattgaatacaaaaattgttaagagtggcttgaaagaactgtgatgtaaaggcagattattggtgcaaaggagggattggtcaatccctggggaggatgaacagagaccatgcatttcaggtagacagggatgactgcagtaagtagccactggctgaggaattctaggcactgtgagctgctcccttatagctcaaacatggatttctagggcagttgttgcaaggcctgctcaagcaggacctagtctgccaagctaaggcatctagatttcaccactaaagggctttacacagatgaatcacataatcagattttcttttagaatgataactctaccagctgcatagagaatggattagaagggtgtgatattacagacagtcatatgcgagactgttggcttccaaactaaatttaagtgacccctttctacgaattctatgggtcaaaacttctactaaacatagctctcacattcatattgcctctttagaagcatagcagaatctaaacatattttgaaggttaatatgttttttaatatcctgttagattcccttagcaggaaaaagaaaagccattcaaggctgacattaagatacatttttcaagcggctgttatgatcattctaaccccatctttccctgactatactactaaatacaacatagttaagcttttgcaggaaaacattctcataaccatattctctgccttgtgtttttcgtactctgtcacagaaagaatatggagtgcttttaaagctgcttatgtaattcacagcaagatctgttccattcttagttatcagtaaagttattaagttagcagcaatccacgtacttttttctacttctaccagaaaagaaggcatgaaactcaatcacttacgaaatgatcctccatgaataaattatcctgcggctatgatatttttaaaattacctcacacctattaaaaactaaattaatcaaatcacttagatgtcagaatattttttaaaagagagatactgtcaaaatgctacgatttctggtaaagatcctccaacttcttaaggaatctgaattaaaatagaactgcttctctaaagaaccctacaaaacctattagctattgagattataatacgtgttgcttctgggtaaagaatacctatgtttgcccacttgggcaaaacactaattagatgtgtaacaacacaacatctattaccagagcatttgaaaaatgtatttttaaaaatcaaactaaatttccttctaagtagaatgtagtccaagagtattatctgttggttgattgagatttgctctcatatcctgtttgatataagacaacctgtcagtttaagccactttcatagtatttgagctctcactgcctgtcagtctctggatgtacaaaggatctgcagtaaggaagaagagaggcacataagagatcattgccctctcaaggacaaggtccagggctagcatagtcatgcacatgaggttcaaagaaggtttcctggagaagaagacttagagtttgacacagagtagtgtgtccaggtaaagaaaggtgcaaagagcattttatatagatgaatctacgtggcctaaaatatcatacaaaggtatggagcagcattggtgcagggaacaactactggtagcttgatgtacctagaatgagaagctgtgggaaaccacgctgttgaagcagggaaggcctggaacctggatgttcttctagaacatgaggctggctcactctcctaagacaggatgaggaaaaattttactgaatttcaagtgaggggccatgtaatacaacctctggtttatggtcttaattccagcactaacttgctataaacatctggggaaaatcacttaggttttctacatccctcttccctttcaagagatactctacctacttactcaggtatattgaagaagtaaaaaggatttggagaacataaccacaatattacttaagaatattgtcattttaataataagtattatgcatcacatgaactacccaaggcaaacaagaaatagcaagcacatacatcttacagcatgtgtggatagcacctatttctataaagcaaatgcgatgatgagtttattaaacatggcactactttggcatgtcctcccattctttttttaaaaaacagtgctgtcccaagggaaaacaaataaagcaaataaaaattctctccatcctctctcaacctatctttttttccattctttcctttttccctacaaagcatgccttttcccccatccctttctaaagtaaaaagctggagcatgcttgtctcatatgtatatgttggtatagatctgttgccgtgggttgttcttttctagaagagttagcatcttcacccatgtggccatggctcctacgttattaagaaagctgtgaacatttcagggaggcagtatgagtttactaaacatgtattagactaacctaactttatttacttttatgaaactcttcttggagaggtaaaatgtaagaatgcaacaaagattatatattctatttcttcagggctccaggcaggatttctcttgctctccttttggactggaaaagggtgttaatcaggagcagaccaatcagttggatagattcaatagccaattaataacattaatcaaagtgtactggttattagtgtattcatatccctaggacaacaatggggagagttactataatggtaacaatgatggaatatatagttctctactacatttaacatttttgtctatcatttggattaaatttctgattatcaaatgtgtagtaacacacagattcaaaagataaagattgaaaagtatctttaaattatcccaaatcctgaagtattttggttgaaatcaataaaataaaatttaacaagcacaaaaataaaaaattcagcttcaggattcaaaaattgaatggtaggataaagtagacctaatttaaagacattgtaaataggtatattcataaaatgaaatactatatagctaaataaaccatatggctattataaatatgttctataactacataattccatatactatataaatgtataactaactataaataactatataattgaagtttagaaaagattagtaacccatcccaggtcatataattagtaagcaatgggatgtacagcctagggccatctgaattcaaaccctagattgttatccactatgtcacattgcttctcaaggcagaatggaactctgtttactgacataaagagactatgtcatatatggcagcgtacagagccatatatatttatatatatagagagagagaacatataagctcagaatatatacacatacatatacatacacacattacacataacatatgcatatatatcaataaagatggctcatgggaaaagtcttcaaggttataaaatttcaacactggatgtttctcggtagtggcattaattgctgattttaaattattatttttcatctgaattttctagtttttatagtgatcatgtattgcttgtatagttaaaatgcatcatgtgactagcgaggcattgcagtgatcagaattttagtattagtcaacaatatgacacaggtgctacaatcattaaagcagttctgttgtgtatttaagaacagccatattctaatggagtggaaaaccactttcacgtgtcttgcactgatgcccagaacaccgtgttcaatagaacatccaaaagtggatagccagcatggtaggaggtctggagcccatgtcctatcaagaaaagctaaggaaccgagcagagcccaaaaataaaggggaaatacatggtgagatgcatgaccatggccagttaaaatggcaaagttcagaagctgggttcgttagtgttattccagaagtggacaggagaagcagacctgccagtcagtcaatattgaggtccttctaggtaccaggccctatgctcgacatcagggatttacaatgactcaagagacaatcactgccctcagagaactcatgggtgagtaactcatcacagtattgctaataattaaataattctaccgtagaaagtgtcctaaaggagatatgcaggtgctgaaggagcacccagtgtggcagcttgtcatcggtgtcacagaagacccccctgagatggtgaggtggatgtgtacaagctgacacctgacacatcatcaggagttgacatggccaggagggggctgagtttgtaaaggtggaaggaggctttaggaagtgtgcagagtgggagggagtaaggcctgctgcggaaatcaatgaagccctctcgcacttttgcataagaagcaatgactcctaacagcgctggcaatcccaactgccctggccatgaaacacacctaacaggaacatgttgcaagatccagagtgacagaactgtcagctttacagtgggtcactggggtcagccactgaagcggaatcaggcctcggaacactaggtgatgctagagaggaaacagtctacttttaacccgaaattcgaatggaatcatatgattctgttttgtcatggatagggagtcatttagcaacatgcagcaaagggaatgtttataaaaatataaacagtgatgatctcccaggaggcaatctctatttataacaaaaaatctttaataactaagaaaaaatagatacagcaatatctctaagaatgcatacgaccctaagtaagattttctgggtaaaaaaaaaaaaaaagcaatctgataagcacatctcatgaggatgtgtgagtgggcaagaaattcgcagataagctttgatgtgggcaagtgtaaaattattcatttatgcaaaataattcaaatgtcccctgtagaaagatgagttccaagaaatcagttacagctcagaaaaggatctaaaagtcagatattccctaaaaatgtgttactatagtcgaaatagcatataaaatgttaagaactctacattattgacaaccatggtatatgtaacctagccttaaggaaccagtttcctaaaagatcagcagccttgggagatgttacgggatacagcatgagggaaactgagtctcctgtagtttgaagcaaagaaaaaacagacaaccagtgagagatgaaaaagaaagaagaggcatttctccctccatccatagtgcagaatgtgaattaaggaagacaattaaggactacaggaagtgagcaatgccaagatgaaacagaagcagccaacataagaaaaactaagggtagcaagcctgggcatagagaaaatcacaaagataatcgagaaaagtctaacaccagatagcagcaaaggtggttattccagagcagtggttctcaaaatgtgacgtctttgcaatgcatcagcatcacctagaaaccacagtttgaaatataaaatccctctcagccccacctgggatcaaatgaatcagagagatcaagaaaccaggaaactgaagaagaatcctccccgagcccaggctgagcaatttagccgggtgttgggtttgtaggaggccacatcagacacgggaccacttttctttaccaatcctttttctctctaacctcgtttgcatgcctttagcaaaaaggtacttcttactcagcaatcttctcttcctggaaactgatgcccagatttctatcccagtgctgccctctggttttatctagaccactggttctccactctggccattttgcccctcgagaacatatcacaaagtgggagacctttttggttgtcaaaactgtgagagtggggtaatgatactagcacctattgggtagagggcagagatgctgctaaacattcggcaattcacaggaaagctccccacaacaaagaattctccagaccaaaatgtcactagtgctgctgttcagaaaccatgatccagatcagttgccccggaaactacattcacaccaagcatcatctctttgctcctccactcctccagctcaaactagttccactagcactgtgaaatcctggttgtgctgacatagtcaacttccctttatacccaaacttctccatgtctgctctccataggctcaatttaattacatgtggcttttctcaggcgacacaaccctctcagctacattctccatgtcaatgatgaatataatattcattctattgcttacaaaccccaaaagagaattgatgtcatgttattagcagtcatgttttctgatttgaacgtgttgaacaagcatattaagagagtttccataataatgccacttatcaggagtcataaaaatctgcaaactttagctccagaaagataataaaaatgcatctctccagaaacagttttgactttctttttatcaatagaaacttaaaagtcagaaggctgagaagtgaatttttctagaaagaaagttaaaaaccctgagcatgtttgattccttggttttacctaaatataacatattatgaacccatgggtttaggttaaagtaggacaaattctgggaatatgtactttcactatatgggaaattgtggtgcaacaaatctataaatatttttcaaatattactttcactaatcagtagtcccatggaaatgatgaacctcatttttctcctcagaataaagctgatactaaggggggaaaattataattacacatgtgcgtgcacactgaattatgctgcactgttttcaaatacaaacctgagaagaaaatggagaagagacaagagtgaatatggactatggtgacctgttaaaaacacacacttgtgaaaacattcattaataataaattaacacacatttaccagatccttatatgacagcatacagcaggtaatttaacctcaaaaattcagccaggagtttgacatcaatctgagcaacatagtaagacctccgtctctacaaaaaaattaaaaaattagccagtgtggtggcacatgcctgtagtcccagctactcaggatgctgaggcaggaggatcccttgagcccaagagtttgaggttgttgtgagctataattgtgccatcgcactgcactccagcctaggtgacagagtgaaaccctctttaattaaaaaaaaaaaaaaaaatcatctccccaacaggcttaaagaaagaatccatcagcttcacagaaatgtcctttgagctcatgtggagcaaaggcagacgccttgttatacttcctgcccatgtggaaactctgatgggtcttgttttcccatctctcttcctatcttgtgtagttaacttgcacaccctccttagcaaactgcacaactttttaggataaataaaagtcctctttgtacttggcaaaagtcaagctgcctgccatagcctttgtatagaacacaggaaggggatgaccagtcagccgacaagcactgtacttcttgacaactgtccacgtattcaggtgtaaaatgatgatatggaaattcaaaggacgctatgtgggaataacagagcttccactgaagtaaggagtggcgtaagatgcagccatattcatacaagtttctctcgaatgtctattcatctcctgcaagctttctacataagcgtggtcactggacacggcctccctctcaccaaactccaggtcattccaacctaacttgcttcagggagcaacagattctcctcttatgggggtggaggtatccaccacaacacccacgttgctcctcctcagacctgcaggccagcactgggtactcccttctgcttctcaccactaactgctaagggcctcctctcctttctcaggcctcgtggaaatctctccccatctccctttctacctctcttctaactcttgcctcaggaaaattattcttcctccttctgaatctctcattatatttctttcctatgtgaatcaaaaagactaaaattttgtaaaaagtacagttacaagtataataaaattatacccagttaaaaacccaggatttccctttggaacctaaatcataacagaaaaaaaaaacgatcttcttcctcatctttctctaattaaatgtgctttctttcccctcgaacatgtcttcaaattacattctttattcaggtttacagtgtctcctttgcctgaaattatattttaatagtttttcattggaaatcttcagagagtatttaaattgaattaaacagggttttgtgggtgtattagttatgggtaactagttcctgcaaaattcagtggcttaagacaacaaagatgtattatctgacagttgctgtgggtcagaaatgcagagcgtcttagctgggtggttctaggcagtgaggctatcagcaggcctgcagtcttctcaaggcttcacagggactggcaggtccacttctaagctggcgtcttcacatggcatttggtcagagacctccgttcctcaccatgggggcctttccacaggccgcctgagcatcctcaggatgtgacagctggctggccccagggtgagggatccaggagaaagggagaaaagagagccaaggtggcttttgtcatctagtctctgaagccacattcagttgcctctgcttttttcttttttttctattcgttagaagtaagtcactaaatccagcccatgctgaagggagaggaattagctctaccatttgaaggttttgtcaaagaatttctgaacatatttcaaacaaccacagtaagcaggacttgaatgcaagtcccacttatgacattatttccactggggaaaaagtgttctgcaacctaactacaagcaaatgtttaaaacgcagcttttttggtaaaggagatacacctcatattatataaatatggctgggacgttgtcaaacattatggtgtattactgagcctttgaaatgtactgaaagctgcaagtttatagatttcatcattataaaatacccaaacaaccacaatatctgtacctttatacacacacacacacacacacacacacacacacacacacacacacacacctgcaacattcatttgaaaattgaaatacctacagaatagctatagggttccatagagaataacaggattggatgactccttgaggaaaacatggggggaattttagctactaaggagacaagttgttttaataaatggctcataaaccttatttacatttactcaaacaccaggacaagtccatcattagccatcagcaattacataaactagggattcttttaagatgttaagatattggccgggcgcggtggctcacgcctgtaatcccagcacgttgggaggccgaggcgggcggatcacgaggtcaggagatcgagaccattctggctaacacgatgaaaccccgtctgtactaaaaatacaaaaaattagccgggggcggtggtgggcgcctgtagtcccagctactcgggaggctgaggcaggagaatggcgtgaacccaggaggcggagcttgcagtgagccgagatcgcgccactgcactccagcctgggcgacagagcgagactctgtctcaaaaaaaaaaaaaaaaaaagatgttaagatatagttagccagaaaacaatttgtctttaggagagaaaagttttcctctcaaaatatcctctcttataatagactgctctaattctcactcctcttccccttcccattgcgcacctctgctatcctgaaagagtcttgaatcaagagtttagatttactttcatcttctataaacactatgtgaatggatatagtttaaattccaaaatgccttgtctataataattggagtccagtgtcaagtcacaaggaattgaaaaccattatatctaaaaataaaagcaatatacctagtaaaaatgtatattggactcatggaaaaatattagacatagtcacgagagcagtgaggcataaagaaaatacagtttgctaataaacttcttgtttttctgtcttgctgtgcattctctctcaatctctttgccatctccccttcaccatccaagtcttcactgttggtgtcattcaaagttctgtgtatcatttcttgtcttctcatctaaaatacttggtgatctcatcaacccctgtagcttcaataccagttcaatgtgatcaccccaaagctgtgcctccaacctaggcccctcttctaagcttctgacatagatacccaactgccttctgaaaagctttaccacaatgtcctaagctgaaagcattatcttctccacggaagttcctcctcaggtgcctcctggtacaatcacgctgtaattcaagcttccttttcacacctccagtcctctcaaattgaatcagtccccagtactcccacactctgccttcttgcaaagtagatggatcacttcaatccatcctcacttcctggacctcgctacctcccacttagactactgattgcaacagtctcttcattcactcttcccatcctacactctcgacccctcaaatctattctccaccctgcagagtgtttttcctaactgtattagtctcctatttaaaatccttctgtggcttccacttcaaccatcaggctcttctaagttcattttgatagctatgggaagcctactttgacttcattctcatttcttctctaggttcccttctggtagcttcccaccctgagcctacattcaccatgtctgttgtatagactttttgaaaggcaaatgaatctcaggaccccaaaatcactaagccaaagggaaatgtcaagctgggaacttgctcaggcaaagctgcctcccattttattcctaaataagataactacaaagattaaaaaagctacatacctccctcacaatttgcccactaggaaattccttttgggactcaagatctttatcttaaaggagttcagttggatttcaccttggcaatgtaaattgatagcttatcttcacagctgcgggacaaaggacagaactcaaagtcatccctctgctcatctgaggcaaatgcatatctgattgcttcttctcacctattgtttatacaaaaatgtacattcactgagccagactaagacaaaagtgactcttcctctaccccctctctcacatgtaaattctgtattcagtgaaaggctgatcaaagactcaaaagaatgccactgtttgtctcttaccaatctatgacctgaaagcctcctacccactgcaagttgtctcacctttccagaccaaaccaatctacatcttacacatattgattgatgtctcatgtctccctaaaatataaaaaaccaagctgtaccccagccacattgggcacgtgtcatcatcttgaggcccacaaagaatttccttgtaggcaaattgtgaggaaggtatgtagcttttttatctcctgaggctgtgtcatgggtgtgtctttaaccttggcaaaataaacttctaaattgattgagtcctatctcagatacttttggttcacaacttcatcaatattgttgaaagaatcatttgcacttccctttatataatgtgttaaatacacacctctgttcttattctctctttggagagaaagtgttttccttcctatatatttggtaaaatctgttcatccctcaagacctagtttgagttaccttatttgtaaaaacttccttgacctcccctcacatctcagctgcagctggtcatacccttctttgtgcgatcaagacccatattcttacatattttgtagcccatttcacactgtcatggaactatttgcctttgtgacagtcttcagggaaaaaggtacgtctttttcacctctgtattttctgtatctactacctattacttaaaaggtacccaatgaatgtttgttgagggatgaatgatggaagtagcaaaatgcagtaacaataatggaataatagactgacatgttttctaacacagattccaacaaagcatggacttacgtagatcctgacaaaaaacaaatgcattaggctttgtaggtcacattaacgactgttcaatgaaatttgcacaaccattatatttcacaggtatccctgcactcacaatactgaagtcctccatctatagttggttggatgctggtgacacattccgaagaatgagtcagtgagatatgtccagactaacaaggtgttgctgtattactgaggcctcccccagatggtgattccttggaaagttaagtatgtgctgctggctggaagtttgcagctttgacacagtaggaatgtttgccttaggacagtggaaactccccatctcgtatgacacaaggtgtgtgaaattgttaccccaaataacacaatctgcccttcccatgaattcatacaagcatgaggtattctgtagaaggaacagaattttgagtaactctactcaaattgttaaaaaattacaatttattaataacagtatagtctccaccgtagtttgtgtcttcatactctgaaaaccttgtgcagaatattttgaacataacgtatgtgaatatatttaaaataattcttccttcgattaatttttctaaaaattacagaaagtactcatataaattcaacaaaataatgcaattatagattatcttaggactaattcaagcctaagatttttttccatctcaggtaacaacctatgctattaaaacctcatgtgactttgcacagagagaatagcagttgagttagcacaatgtccccgtctctcccagacatcaatttaattgccatttagaagtcacttgctcaggattattatttttagaacttttcacaaaatagtttcactacctaacattaggtcataacatttttaagtggagaattggagaaaaataaagagatgaacattttaacaaaggtcaaagaaaggagacttaaatgattacttgctgataagcacttaaaacatctcagctgaatgtaaagctagacccagaaaacatcacttcttccttaatacaattctttgctccttactaagagcaaaactttttaaaacgcaaccatgcaactttaaacaacactgaagagttcttcgcaagagaaggataactctgaagcaattagacataaatctagaacttcaggtgtgaaagagttgtaattgctttaaaaatataggattcagaaagttaatgcctacctcttgcctgacaaaacatagtgaaggttcatatgtcagtcaaccacatagagtacattaagcttccccaccaaaaagttatatgttacctaaaacctgtcattattattaatgaaaaaccttgaaaatttgctaaagatctgatggtctaagaggcaggaatgcaccaatgcctgagggcaagattgtgcctctctatcctcaatgtccaagtcccactgtttactgtcccattgaatcacacaactgggacacaacccaatttccaatagcagggcattggttacataaattatttgattacttttaatagcattattatttatattaaaaagatttatattctggaatacccagcagctgtttttaaaatgagctaattcccaatatactgacatggacttctgagactggaagataattataacttattaagtaaaaaaaaaaatgccagaacatgtaaagtatgattttaatctataaaatgcatatatatatatatatatatacacacaaacagatattcatatctgtagatacttcttaaatatctagaaagttccatttcacactgttaaaagagactattgctaggaagtggtggaggagcagggactagtgtacattctaaatcataaaatctgagctgtttaattctaacacaggctacttccattataatgtttttttttttttaatgaaagcatctgagctcttaatcatggtaaactcctcacattccaacaaggacaccaggttgcacacctcgagggtgtaggatgtacattatacatcttacgtccctcatggtccttcacagtgtactatgtaagatctccaggaggaaggagccacacctgcatgcacactccagggctttctgaagtggggcccagaggtctcctctgggagagtgtgcgagggcactgacaatatgtctgtcaggatacacggaagttctaccaatagcagtagccaaggtccagaaataacagaataagaactccagaattaaatattttaatatttatttgttaaatatttgtttgttaaaatgcaactcaatgtagctgttaaaacagtatgttctgcagtcagactgtctaaatttgaatcctgaatccatcagctattagctaggggactttgagcaaattaaataatttctctatgtttcaattccatagcctataaaatgtggacagaaataatagggacattgtggagtttcaatgagttagtatagatgaagtgtttagaacggtgcctggacaatcatgtgttcaataaatgtcactttttgctagtgttcttgtctggtaggcaaggtgttattattgaaaatgggttcactgattatactcactttataaatgtctcaagaatagccacattcacagagaaacacacacactagccctcaaggtctagcttaccgtcctctagagcaaaatgtacatatctgtagatacacaggaattataccagcagttacacaccaaacagttgtatgggcagagatatcagaagggaaagatttttcaccaacagcaatcagattatttctattttgaccagagttatttccaatttgacctcacatcaggaaaatcttatttttaatgggcaaaattttgaactttatatttaaaactcttgaactttatattaaaattatttacctttaaaaattatattagaacataattttttaaacccttggtgtcctctaaataatgattgcatattaacagttgaaatatgaatcattaacaaaaatgtgtttcatgtatatattttcaggaatacattaattatatgaaacaagtaatttatcatcactgtctatgaccttcactgagggccatttttaattagtgtttgtacttagtagacattgacaccataacagttataaagattttatattccaatacatcccagtgaacttaagaggtttcctaacttacaggcttgtaactacatactgttttgctaggaggactgaaaacagtttggtgccaataaaccagcaaaggtcgagagtgcagtgaagactgcacaagctgttaaggcccagttcactttatgatttgaggtcatcagttaatctacaagtagtatcgtgtacatctgtgtgtgtgcgtatgttctgatctgtactccacctgaaaacacaatatagtgtgtgtttgtttttacttccctaacacaaaaccattctctgcatggaccacaaaatacgtctcttaacaaaaattaaagataatgaagatattggaaaggttgcagattataaaattttctttttcaaatgttttaaatgctcatctgagattaactctataatgaatggagttaaaccctagaaaaatcttcattagtcagattcagataagatttataatctgatacgtgccagccacaaggaaaatgtgcatcaccactattcataatagtgaatacatggaatctacccaaatgtccatcagtgataaactggataaagaaaatgtggtacatatataccatggaatactatgcagccataaaaggaatgagatcatgtcctttgcaggaacatggatggagctggaagccattatcctcagcaaactaacgcagaaacagaaaaccaaacacagcatgttctcacttgtaagtgggaactgaacaatgagaacacattggcacagggaagggaacaacacacattgggacctgtcagtgggggtggggggaaggagatcatcaagataaatagctaatgcatcctgggcttaatacttaggtgatgggttgatagatgcagcaaaccaccatggcacacatttacctacgcaataaagctgcacatcctgcacatgtatccaagaacttaaaattacattaaattaaaaagaatatgtgcttcacatacaacagacaagaatataaactattgttgcaccttaatatttctttccatattatcataatttttagtatataaatttctggccacattttgatgatgtaatcaaaataccacagaaatctgaattcccatacatcttgctagttttcacttttgcatttctttctgcgtaacaccagctaaaaggcagctcttccactattcagtttccctaaggaaaaataatatgatcaatttgaaaattggtaacagtacatgtgaagatgtacagtggtttagttaaagttataagctgctgttccaaattaaaacttcatttttagccctttatatctcagtgaaattctcttattaagtgaaactttgcattaagtagagtaggaaaaagagaattcacttcctttatatgttaactttctgaaaatctcaacataattccattgggaaactactatggtggtttagaagagaaataaaccaaaatcaactttatgttaaaaaaaaaaaaaacagtccaaggggaaaataatttgctgtgtttacaatttttttctaagccctaaaaataacagaaggaaatcttatagtatacagaataacatagaatgagtagactggattttgaataaaaatataatttcaaccaaaaaacacgatgatgtctttaaaacaaagctaaagagctataaatatcagaagtagctataacacataaaaatatggattcattactcatttgccccttcagccattctaacttcactcttattaagcaataattaatactacttaaagccactatcttggcatacacacaaaaaggatatgctatgtgcaaaatcctcatttgaagaaggatcaagatcatccctttcgtcagcttgtggtgattttaaaactatggcatagcatacaatttccagatgatcttgttgggaacagtctacatatttgaaaattagcctacaaaataattaaattacttgccccaaaatgtgtgctacttatatctgctcaaaggtaaataaacccaagcatgttgatctagatggcagcatcgtgactgaaaattttccctgtcatggatgaggtagagcaggttaaaaagaaatgacagagcttgactgtgtccattaaaaattaaggaaataattatgagacaaataaaatagtatcccatgcagtactagctacttggtaaaatgattacccttaagagatagtacaagatgaaaatataaactctcaattagagtttacataaatcacaggtaatacctccacagtaagttgagaaaaattagcgagaagaatacaaacaccttttgaagtcaatttcaaggagcaaaattatcagactgtccagtcaaccattcacacctgtctgagaacacttcttagatggacttttaccctcagtcaaaatacaattcttatgtcctcgtgtcttaaccaagccagttcccactgtatactccattctaaacactggacagtacacatacttgtgcgtgcacacacacacacatacacacacacacgagccacaaattgcaaagcaaagaaggccataaattacaaagcaaagaagggattagattgctgtatcatttgaaggtaattctaaaatatctcccagtgaaattatatccctgtctaaattggagaactttaaaaaaaaagagtgcatgttaagatctccaggtaaaaattactaagcaaatggtatctcagtgtcttgattgtaaattaaaaagttatataatacagcaatattaattgatatgctcttttttgagcatctcatttcaagacagaccatcaaatcagagcggtttcaaagaaaagcaaatgtcatcatcaacagaaagtcagaggctcagcactcttcacctggacttgtctgtggtccaggagaggaggtgagccaagaacaggcagaatattattcacctgaaggacatcaagttggaaaagacagcatggagaagaacggaagttaacctggcttcaaagcctgatgcccaaaatgttcaaaacattcaggtgccaaaatgtcttaggaaatggtgcttaagatgtagactggccatggggattttaggtctcagactccagccaagctgtgttggttgtgaattttctttcatagcacacgtacaggccagtactataggaatttgtaacagaatccacttccagaaatgctgctctgttttccctgaatgttttctgcaccgtttgccactccctccttatttgccttccctgcaaatgctgttgttcttcagttccatggtttcagctatgaattcatgtgggattcgtttccaaacttttgtctttacctttgaacactattttgaattctagacccttaaaacaacttcagatttcacatcttccaaactgaaccaattggatgtgttccttgtattcattaggttatgattttaactgatataacagagaacctaatagcatttgcttgaacaagataggattttttttttaatctctcaaataacagtgtggacatgaaaagcagtccagggctgacatggtggtttcacggtgtcagtagcccagtctccttcagtcttcattgtctcttggtatcatgtcctcttctcaatttccatggccactgccttggttcaggacttcatcttcttatttgaagtattgtcgtgcccttcttcctggggccactgctgctggcagtgtcctcactactgccagaaactgatgtgatctgtttgttccagaagactctaaattcattgccatgatagtccaggcccttataattatggcctgggtttaaccgtttcatctccatttctagccactcctaacactaggtcacccttttacaaatactttacaagctttcattccctcgtgattttgctgggactgtactttcctcctcacccctattttatcctttttctggctcattattattcaagcctatgtcaagtattatctcatttgctgaatgttatctcctctatggactcttccaacttctctccaccaaactgaattcagtaaatgtttaatgagcataattcaaggtaaggaatagagatattgagataaataaaagtgcttctgctctaagaggttaaatatttagcagaggagatggaaactttactcattataatatcttatcaacaggataactgcaatatgaacagaatgatatggggtaagttaatcttgcctgcaggcaaaatcagctgttacctctatgtacaatagcactttgttgacttagcacttgtatgttcaataaatctgtgtctctctttctcataaaattatgagtttagtgagaacagaacccacggtccccacaccactattttatccaatgccaaaagaagaaagaaaagaattttattttggtattcatttctaaagtccatacaagtatagaaaaaaaaatcaaattttaaataacgattttgcagggtaaaattttcaaaatcagattaaaataataactatctttatctaatcatatcatgaagggaaaaacttacatgttaattaaatccacatggaaaaggttactttattgaagtgttgaaaaagagaatgatttactttctataggaaaaaaactcatgaaaaatagtgagcatgttaagaatattaaaccattaaggcataaaaactgacttgactttaataatatttcattgtggtaacatgaaatacaataaaattcaatgttttaagcgatatacacatctgaaagaaaaatgtttaagtaacaaagaaatcgaaatgtaattttgcaccaatcacaattaaaattaatatactctgaaattcaaattgaatggctaatcgacttaacatttagatcagttgtgacctccagttattagagttgctaatttatttatagagaaaacatactcttattcactgatttagaaagaaaatattcatttgggatggcattaatttcctcattttgcaaggaaaagaaagtgattctgagagaggttgagcaagtttctgtatttcacatggtcaactgggaaatcagaaataggactccagcctatttggatgagataagaagtattaagagctttgtaaactgtaaagtgctctaaaaatgtaggcatggtacatgctcaattagaacactatgtgttccagtacaccaccactgcattccgttagaaaaggctctttttcccatagcaggattctgccattaagattaatgtttattattatcatgcaagaaggaaaaacaaaaggcatttcttgaaccagagaaaatatattattctttatttctctaatgtgatgtctccatcatctgcctgtgaccgctgttgggagctctttatttgtcctgttgccactctgaatagtttgattgatttcttctctatctgtcttccacaaatgtatagccaagattctttaccttcatgtctaacatttaacagggaggtatttccatttttcaggggaatggaactcagtgccctgcaggatccggtcaagcatctttcaatggatcttttcctgaagaaagatcttgactaccattttgttgcatttgaatatcttagcccccaaacacactttcagcttccttgtttgcacctgagatggaggcagaactaagctaacaattttagatcatttgggtacccaggtacgtggttgtggatctgaaggaaattgtgttattgctacttttttattataaggaagatgccgtaagtgccactggattttacactaaactttttaagtcaatttcaacaggacaaatgtgcacatctgtaataatgcaatgcaatgatttccttagtgaacactcaaatgatcaaaagcacttgtgctgtaaaatatgtttccaggcaccacgcttgaggtttaagagcaaccaggatgctttagcatgacactactttcattccaatttgttttcatggttttgaaatgtgtataacaggccacaacttcatggtggactcaattcagccttagaaggttgctcacatattcacagtaactccaacagtagtggggttcttctacagactgagtttgttcaggcagtttcaaattccagccctcccactttagctcttcactatttcatgcttaagagtatttcctatttactactcctgagaaaaaaggaattatggcaattgaaggacttctcaatagacatttctatatattgccaattaaatccaacaatacttacgaagtataaacagatctgactttagattatacaatggcagagacagaccttgatgacaaagtctaagcgagttttcaacaaaaggcatccacccttcactggaaccatccacagcaccgcagccagtggtcagaaaccacggtctctccgaacttctccattcagttcctctgcagttgagcatcagcacacaacacagcgcaaaaacaactgtctatgggagaaatgtccaaaaaactggaaaccgcacacatatgggcgagatgcaaaactgttgcttagtcataacatccatgtggcctaaactgttcagtctgacctgtttccctaagtgggatgcagagttagcccagtcccaagtaagatttttcccttaaaaatttacctaacttccaacgctcttgctattttttgtctttacaccactaggtttctccattgtgggaatgtaattttccatgatctaattattaagcaggaccatccctctaatttcggcatccttttggtcccttgagccaggcagtcaccagggagaaacaaagttcttaagctctatcgagtcacagcccctttgagaatctcaaagtctgggtcctctaatcgggaaagtccacacacacacacagcctaggcatgacaggatagcacagcatggatcctagagggccatgcctggacagccagtagaggaatccatggaaatggaaagatctgaagtcaacacccccagattccaattttggctttatcctcgactaactatgaaaccttaaaaaaatcaattagaattctttgagccggtttcttcatttacaaaacggcgataataattcctgctgcagccacccctctggattctactcataaaaattattatgtatatcaaaattttgtaattatatttccccatgcttgttaaagtatgacttttcattagaaacttttgcgttatctttgattccttgttttgctttgtccactaaaatctgttagatgttccttcacggaatctctcatcagttctctgtctcactcaccttgctaaggtcctcatgtctgaatttcagtctccacttccttggggatctcctacttccaacctgtttatgtatatatgtgtgtgtgtgtgtatagttataattatagttatatatagtttatatatagttatatgtggaaatgtatatgtgtctgtattttttgtatatgtagacctacaaaatttgtatatgtgaatataatatatagtcactatttccctgacttggctatatttctatgagacagccatatttccaacaataatatgttgtttgatctaaacaatgttctctccactgtcatttgcccaactgtcaaaaagtaagctaagatagaaagtttagagtgcatatataggaagtgtttgttaatgggggtagggagcaaatgggcatcaatggttagtgaaaaggttttcattaagaaaattttatctcacccaacacaaggttattaaaacagcgatattaagagaatgttaaatcaaatagaaattgtatcctgctgcctttcactggagttcatagactactgactcgtacccagtcttcccctcctggtaccctgggaaacacaagattgcccagcttagagacaatctcagaaacattgtacaacattaaagagtaaatcatgagtgactgaaatacttaaaagcacagtatattataacatgtcgtaccagtaccagtggtcaagatgctgaattataatattccttaaaaccattatatttgtaaacataacctgttctttgatgaatgatctaagattactcacataaaatgctaaggcatggtattcaggacatgatgaagcctgcgacctgcacgtggatgtggtgctcacatggtggcttcctgtcctgcactgcgggagccccctctttacacaattattctctcctgcctcagcagcaagcactggctgaaacactgaccacattctccttgcaaaaaaaaaaaaaaaaaaaaaaaagcggttacttctagattctgtcttcctcctgacagtaaactcttaataaaaatgtacttggcttgttctttctcaaaacttcacaatgtaatttaaactataaaataatctcaagcaggtaatatcttaaaacagaaaaatacacatctgatggaaagtaaatttcaaaacttctctcttctgaactagcagagtatatcattttttagtatagaccttcatacagagcttgcctagaactacaagattaaagtaaataataagatgtatttaactaaaatttaataacattgtgtggcaattactttctcatttagctaacttaaaaactcaccgttaaaagcaggaattgtcccagagttgagggaaaaacacagagaaaggaaataatccaaaaaggtttgtactgttatctattaccacataataaattaccccaaaacttagcttcttaaaatggcagtaagcatttatcatttcacacaatttctgtgggtcaagaattatttgggagcagcttagtggagtggttctggcccagggtctctcatgagtttgctgttaagatgttggcctgggctcagccatctgaaggctgacctgggttgactcacccactttcgagacggcccactctcatggatggcaaattggtcctgggtgttggcagcaggtctcagttccttgccatatgggagctccctggggctcctctagtgtccccacctgatggcagctggctttccccagagcaagtgatccaacagagagcactgacacatgaaaacaccactgtcttttatgacctagtcccagaagtcacactttgtcccttctgcaataccacactggttacacaggtcagctctattcactgacagagggaacaacaagggcatgaaccccaagaggcaaggatgacaggagccatcttgaaggctggcgaccacagatccacacctaactccaaaccaccaaattactcggagtgtgtgtcgggtaagatggagtagagggcaaaaaaacagattctttggactgagagagatctagtttcaagaactaagtctacagatcaccaaggaagtgatcaaggatacatgatctaacctctctgaacttcagtcttctcatttttaaaatgggggtgacagtgccatggcagacccagttggggtcactgctatccatcttctctctcgcaattcccagcctgcccacggtgcggtgagcccatgtgactagaccccggacgatggactaagagggaagaggacgtgcctaagttccgggctgaggccttaagaacccatgcactcttctcctgttacttttccctgcggcaacaagcaaggagtcctcattccagggagtgtgaccgcatcgtggtgctaattcccttcccttggcctcgactgccaaggaaccacaggaggaactggcttgggaagtcccctggcatcagagtaaactttgtgtgagcgaaaaataaacctttatattactaggccactgagattcggggtctatttgttaacaaagtataatctagcctattttaattcacgtacataaaataatacttattttgataattaaatgagaaaatacatcttaacttcctacacagtacctacatgataggggttttaatatgtcagtttctgttcaccttgtctgagcttgttttctcattagcaaaaaaatcgaaataatattcaactcacagaattgctttcaaaattaaagggaatgaaatacattaaaaatcttaacagccagtaaggagttaataaatatttaagtttcttctccttctttccctggaattatgaccacggggggttcagaaggtctttttcccctcatcggaccttctcctcctctatattcaaagctccagagtccctgagaagctaacatactgagtttatttgataattcctgtgaaaatatcacattgcctacttaagacattgaatgcagctgcatgacagaaatgataatagcttaaaagatttaccaatcctgacaataatgccatgatttcatttcagaattactctaaattagtcattattttcttacatataaagaaaatgcaattccccttcttttgtaatgttgatattaaaggcccataaatgccaccttattctatcaggtcttttgtcccatgaaaggaactatgtaagatgtgtcctgacttgtgtcatctctaaatttaatagcatataaagctgaagtataatggatcctttggacctaaataaacatgaataataataattttttaaagcgaatccagccatcctgtgccaagtcattacactgtttcacaggacttgctccagagagatttcatcatgagtatattataacctctcagtcaacagattagtaaaacttgtctacttcctcactgaaaaactaatcatgtgtcttttccatgcaaaactggaatcattggcccatttacatgcccaagtcacagcctaacactagaacactggctgatgtcctttgaatgtggtttttcagccacatggaagctcctgacactttttggtgttctgtcactgtccttcattgaagggctcccagcaatgaccaatatgcccactgcagcacagaaaaagtggaacagcatgcattctgctgctctccctctcctcaacaaaagtaagacaataaattgcccagatccattctgctttcctctgtggtagccaaagatatgggggaatgagatgtgctgtgggaatacaggtgtggtgtctcaaactaattgccatgtgacagaccagctttgcctcctgtgtgctccttatgctgtgcaatcaatgtctgttcgatgctgagtcatggtgacacaggatctggctgcagacattatccaaagggatgttacaatgtcgcactttctccctaccctaaggccacctgctccttacctgttcaaggttatccattgctgccttagagtctgggtgtgtttaaagacctcacacaagacctcatcaactggtgtgcctcccttaatacacccatgtaaaactcgactcacaaatagcatttgtgaatataaaaatatacatgaacagaaaaataatgcataggaatatataatttatgttacatttaaatagtacattgtgttgtatataaggtgatacatttcttggaacaagaaagtccttacatataaagcattactgcttgttgcttctttgtctcaggttttatgattttaatgctgagcgacaaagctaaaactacgaattcaaagtccacaatttggtctgcctcagaattacccagcattgaattctttaactatcaaatagaataaatcttttttttttttgagacaaggtcttgctttgttgcctaagctggagtgcagtgttgcaaccacaactcactgcaccctcaactacccaggctcaaataatgctcctacctcagcctcctgagtagctggaatgacaggcatatgccaccatgcccagctaattttttaaattttttgtagagacagggtttcactatgttgctaaggctgctcttgaactcctggcctcaagtgatccctgccttggcctcccaaagtgctgggattacaattgtgggccaccatgcctggcatcaaagaacaattctattgacacattaaaaaatgaaaagaactatacattattatatttttattttttaaatttttagtgattatgggtacataatagatacatacatatatttatggggtacatgtgatgttttgatacaaatatttttgtttgtttgttatgagatggggtctcactatgttgccaggttggtcttgatcctcccacctcggcctcctgagtagctgggattatatgcatacaccaccacacctggccatgattatattttaaagtaaatgataacaatcacagggcagaagttatcaaagacaaaggttaattttgataaaatcattatgtgtcagacaactggattattttatttaactaagtgagataaaaaatgggtttgccaatgtgcatcctgttattcttataataccgactagatttgtcaaaataataatgaagtacagacacacaaatgcacccatcttaaacattttgtgtttcttcttaaattgaacaagaatgtattgagtactgtttgttaggagagaaaccctgcctctaatgaccttaaggccttaaggaaataacacacatagttcacatacatgaactatccctattttttatcctcataccttcttccgcataccaaaaaaaaaaaaaaccaacagaaaaattgttcaaatcctaataattctaacttagaaatgtcttgcattcaagatctctccacttctagtgcaactacactattcctattgtcctcatgtatcccatgaactattgcaataatttctggccacgtgttatttcatattccaggtatattcctgaaacaaacaattaggtcttaccgacttaaggcctcagtcttatttaaaaccctgttgactatacaataaaaacaaaatttataacctgatacaaaatgttcttcatgggctcctcttgcctgtctttaaatcgaatcaccaactctgtacattctaccctgtttccaggatgcccctccccatgccatcttctcactggttccaagtcacaacaggttatttcacaggatggggtgctgggtttgagggtttttttattcttttttactcattatctctctctctcctctgcctaaaatagccttattcccttcttagccagcaaacttctattcatcctagaaaatccagtctaaatgtcccttctccagtgaaacctccatcagactactttttctggatctcagaagcaattcatttcattgttatagctcttgtcacgttgcattataatgtcaatattgtatctgtttccagagctgtatgatgagctccacatggacagagatttgctcttatttttatacccttagcactaagcacaattcttggcacatagaagatcgatgtgccaagaatattaaataagatgcttacttaatatgaataaatgaataacaaagtaaatgctttacaagtttacagaaaggagaattcagtgtgttatggagtaattaggaattgctacactaacatatatgtaaaatatatgtaaataaaatgtacataacaagctttaaacaaagaataatcaaacttcaaccctgtttaatttcagactttctttaaaaaggatatacttatactatcacacattctctttaatatgccttaagtatgtagttggaagatgcttaggttcaagattccctgaagttcttgggatcagataagtaggaagatgttcttctatctggatcatcgtctacttttctttattgatattaatttgtaacaatcatatttgtagtattttaaccaatgaatccattttaatgctataatttagtcttttcacttactaagaagtatttctctctacttcattcaaaaatagtaatgtattagtctaggataaaacctgcccaacatctaaccccaaaattcctacatagcacgtaggtaggggttgtcagatttagaaaaaataagaaacctacaggatgctcagttaaattttaatttcaggtaaataatgaataaatataaaagtcccttgcaacatctgaggcctatttatactaacagaaatctagttattcatccgaaattcaaatttaaatggctgtcctttatctggcaactctacaaagcagcagacgagaagactagcgatgaagacatgccaggaaagtcttggttgacgtatgccactagaaaggctagctttcctggttccccagagaaaatctaagggcgtcaaccatcccctatcctctatattcttaaagagacccatgtttacccatgtgctgtggcattaggacttccaacaggaaactcattttggtaaaggaacaatctaagatcatgtctcagaatagttttttttttataaaggagcatacagatgatgttctctacagaactagtctcaggactttttcctaccactgtcaggaaaaacaagaaaatgtatcgtcattgtagtctgcccagcaatgctggtattccaatgtatcacaaaatttaagtccacgagccctttctacaacgcaggggctactgtgaagctttatatgcattactactataaatcttcataacattcctacaagatatatggcattctttctactgtaaaaatagggaaactaaggctgaaaataataatttacccaaggctacaccatgagtaggaagggaggtgaaactcaaacacagctcttaagaccttagaactacttaaatatttatcagtgatgttatatattgacttttcgtacccaggtcctactaaagaaccaaaaatgtaaaggtactcaaaagagctgtcatacaggtggatggtctcaggacagataagttcctaagcaagaatacaggcttgcgtgtttgtgtgtgtggtcacatggcgcttcctctgaaaattcttctctaaaatcaaagagctttacaaaatccaagccttcactattccactcaattttttcagtatatttgaaattttctacatggtaaattaccttcctgtgaagctagcacatttctgaaagtgcctaacttttaactataaacactgtaaggtaaatatgtaaggtacatgtaaaaacaagtctgctcatcccttctctgtttccccaggttgcagaaaatgaaatgaccataataactccaagacagagcagaaggttcatctgagtcataccaaataacttcattgctgctaaagtaaaatttgaaaatgattgaagtgatttttatgatcagccttttggaagtcattcaaaagtgctgcaatgctacttcaaagaagataattcaaatttaaatgtcactcttcagtgttgtttatcaacagctgagtattaaaattggtgagcttgatttgtgttatttcacttcaccagcttataatttaaacactcttatacttattatttgaataaatggaataaacacaagtcaaactttggtagtgaggtgctcatcttcagaggagttcaattagattggaaaaacattttgtagagatcttgtagaacaacagctctctaccttgaatgcacactggaatcacctatggggttctaaaaaaatatcaatgcttaggtctcacccctggaaattctcatataattgggctgaggtgggacctgagcactgagatttttaaaacttgccaactcattctaatatacagcaaaagttgagaacaactgctacagaaggaactcaagcattggatggaaagctggaataatgacatttcaggatcctttcaactctgaaagtctatgtctaattgtacatgtgaccctactatgacatcgtactaaagcagacctgaaatgtctttggatatacaaattaggaatacatcgttacagtcattctttctagatgtagtttcaaagtacaaagaagatgctgctattatttacacttctctttcaagttctgattatctattgaagagaccttaaaataaacaatttaatcaattcaattattaaaaatatactgagcatctactgtcagcaaaacacagtacccacaaaaatgtgggtactgaacatttattaatgagtaagccagagtcagatttttttggaacttacaattcaatgggcacaaatggttgtactacaaaagtaaggggagtatgtttgcagtctaagtgcatgatggttcatttaagtgattatgttcagctgtgaagtagaaaggctggcagaagtattctttttatcactgcaaaagtccataccttattcactttattgaagaataataaatgtaaaagtaaattttaaagtttcaggtgatatttcacatattttttaatacatatcttacatattttatatatatatatatatatatatatatatatatatatatatatatatatatatgtcagtaagcagacgtgtcagattctttagccttactaaacattcaccaaaaggaattacgttatacaaaaccaaatcaatttcttctggtggtttttcaattaagggctaaagtaaatttttaagtgattcaagagatataggtagtttatgcaattttaactaaatttccagtaacctgaaacaatttcattaaaatacaggcttgctagtgaattatgctgattctgcaagataaagaatatgtgagatgtgagagaattttgattaataaatacacatttgctaaattctgctttggttgactaaactttttgtttgtttgaactaaacaaaacagagttcaaaaaggcagagtaatgtaacacaactagttaaagggagactttagaaaaatgagccataacatctggccaatcatttcagctcactgtacccaaatggaactggaaacacacagtgataggaaaggtcactcatgctggtaaaaagtaatacctctgctgccacagttacaccccacaaatgaaatctacatccatattgtcttaatcttcactactaggcaggatcgatccaggggcaggtgctcagctagagccaagattaagtattttgtgctcctgtatcctgatttctagcacagtgtacaagacacagcggtgatcaaatcagccagtatatagtgtaatacaaataataaaatgttttaactgaaagcataagactttgtagtaaattaatgactggaaatcaactctttgactcaatttatcgttatttaataacgttgtagaagactaggcaaggctttacaaataaaaaatttaaaatcatacatataaaacccaccttctgagtgaaataaaataaatactcgaaattcaataaataagactgcttatatgggaggctacaattttaaatataaactttagttcctattttaggttatatcttccaaattccagtaaggaaaaatattcatgagagtttcttttcatgcaagaaaaaacaattctagtctcaagagaacccaaacccaaatcagcaattaaagtatcaataaaagctatctgccttgtttgtttttccaatcttgttccttaaaaagatcaacaacaaatttaaaactgcacatgtaaaatcaaaaatcgtaaccaaaagaataggatgtactaatatatattttctttgaatgtatcttcttgaattcaaacctaattgaaatgaaaaaactgttaattttgaagctgtagtatctagagtacatctccacattgacatcgaaattttaaggaataaatctgctggttctactgtcaataaaaatgcgtggctgggcctattatttcattaactattggaatctgtaagcacccttgatatggtttggctgtgtccctacccaaatttcaccttgaattgtaataatccgcatgtgtcaagggcagaaccaggtggacataattgaatctgggggcagttttccccatactgttctcatggtagtgaataagtctcacgagatctgacggtttatacatggcagtttccctacacaagctctcttgcctgtcaccatgtaagatgtgactttgctccacattcacctctgccatgattatgaggcctccccagccatgtggaactgtgagtcaattaaacctctttcctttataaattacccagtctcagatatgtctttattagcagtataagaacagactaatacaaccctgttctgtgctcttttccttccactgtctgcctctcctccatgccctcattcattcccaggttttcaattagcagtcagacactgatgatgtcatcatggcttttatagcccaggcctcctttgtgagtagtatacacaatggtctggtctacagctctctaaaagacatttcctttcacccattgcctctcctggaaaaagaaaaccctcgctataattctgtaacattctaaataataaaatatccaaggaagtatgaagtaactttaaatgaagtttaattgctgctgggatattaaatattcaataggaaatcaattatttaattagttgattgacattttgaatcaggtcatcttcacttgcaagtttctctaaaccatattctctgagcacattggaattccatgttttccaatgatattcccaagaaagggagaagtttgttgtttgctgtcactggcacaagcccatgggcaccaagtgtgaggaacagccccagtgacctgaagcctgcagtgagaaatgcgcttattgggcccaacttctctaccacccaagacaggatgcttattgacggagcagagagtttcctacaaggtccttgaaaaaggcaaattcaagctagtcttcaaatatctaggtcaccttttttttttttcctaagaaaaagaagtgaatgacagagcacaaagtagtcaggtaggaataaaggaaaggctacaatttgcatgaatataaaaaattgacaggacaggctatttatagtgttcaggtgtgagcagaatcaccaatagcaaagctaaggcttaaatacttagtttgctttaatatgtgctttgttcatttataactagagtaaaaagcatcagagaatgggaatgaccataaaattcacctcaaagtttttgagatatttatttttaggtgtaaataattagggaagagaatagtaaaaatgaagtgaaatacatacattataaaagtctagaaaatattttaaaatatccattttggcatatacacatgactaatattagagtacatacaagaaaagcaggtatcttaatattctagcacagataaagggccaggcgcagtggctcacgcctgtaatcccagcactttgggaggttgaggcaggcagatcacctgaggttgggaattcaagaccagcctgaccaacatggagaaaccccatctctactaaaaatacaaaattagctgggtgtggtggcacatgtctataatcccagctactcaggaggctgaggcaggagaatcacttgaacccaggaggcagaggttgcagtgagctgaaatcgtgccattgcattccagcctgggcaacaagggcaaaactctgtctcaacaacaacaaaaaaattctagcacagataacttgacaattttctttacaattcaagaacaatataagacttcagaactgtctgtctatagccagtctcactgtaggcaaaacacaaactgttctaggcttctttaggtcctaaaggcttgcaaatcaagaactcgttaggcctacaaggtacaaaagaagactcagtgacagaacaaggctcttactaggcctctaatatgtctaccttcaagcttaacttggatacttttaaaaagcacaaggatttttagggcagtgaagatactctgcatgatactataatggtgaatacattatatatttgtctaaacccatggagcacacaacaccaggagtgaaccctaatgtaaactatgaactctgagtgatgatgtgtcagtgtagactcatcaggtgtaacaaatgcaccactccggtgtggtatattggtaatggagaggtgatggatctgtgggggcaaagggtataagggaaatctctatgtcttcctttcagtttcactgtaaaccaaaaactgctccaaaaatataaagtctttaaaaattaaaaacttcattgatttataagccctatgctactagctataggtaaaagctttaaaatactatacaaataaaaatattaatttcagcatagatcatttaccagagaacgaaggaaagaaactaacattgtttctgacaaggaaatggacaggcaagaataaataaatatctacattctaggttttacattaagtatgttatatatatctatatctatctatctatctatctatctatctatctatctatatatatatatatcttctcttttaatcactacatatttaaaggcggtattctccctctactaccaaaaacaaaacaaaaaaacaaaaagaatcctgaggcacagagaaattacagctagaattttcatctttaactccaaagttcatatagtgctgtctttatcaataaaaaaaagcaacaaaaatgatttttaaaacagacgactatctaacaataattgcaaagtaagacaatgaaaacacagaggcatttagtggcctttacacagggttacataaaactggcccatcgatatcaacaggattgggcacactttgaccagtacaagccaaaagaaggtacgatcatctgtctaggagttgtaccaaaagctctgtccagcctatgaaggaggacataaaagattgagctttttcattcattctggaggacactgtctattaaagggaaatacccaggcaaatcgaaattccaatttttaaacactgtattatttaacattataataacatcatcaaaaatctctataaagtggttatttgtactgaaagagctctactttcaagtttgggctagagatatctaaattaaaggcattagaaacataccactattattttcaaggaaatcaatattactctaactacattcattcagcaaacccacaaggcatcaagcagtatgtcttgacactaaaagtaaagaaacagcaaaggtacatatgttttattctctacatttgatttacctgtacacttaggtaacatagatatacacatacacacacacacacacatatttatatatatgtgtatgtatatatatatatacctttatatatgggtgtgtgtatatatatttttaaactttcagtttaaagtatatatatatatacatacacacaaacacacatatacacatccaatatgcaaagagagaaagagagatagttcagtggtcaaacatttactatgtttctgaatgtaacacgtgcatatagattaaggcaaaagaacacctacatcctaacaggttcatgttaacaagtctacctcttctaaaaggccaactttgtttacttatctaacgagtaaacaagttagaaaggtaaagcaactcatctcacataattgtacttttctctggcaatgtaactgaaaagaaaatattttttgctatcataaaacaaaaggtttatcttttaagagaaaaactgccatattccttaagaaaataaaccaagagcctccaaagttttcactggaaagccagctaggtctctgaaagccttattcaagcctccagagactcatcttcccctttagatagctcactaatgatggcttcaaaagagagaatagtgagtgaggctctgagtttaatactctctgaatttaacactctggtttaagcaaaggtaaatgtcccttttcttaatttctcagagcacagccaaggcaaggctgaaatcttaaatgcaagataaccaaatatttagatataatacaaaggaagtaaacatagaatgtcatggaactgacattccatggaactgacattacatggaatgtcatgaaactgacattccatggaactgacatacatggaactgacattccaagtaaacagaatgtcatggaacaggcatatagtttacctgttttcagtttaaagttcagcacgagtgcctccctattcagctctaacctgccccaaatgcccaattatatctagcaacttaaatatccaaacccaagaaatgtatgaaacagagcatgaagtcccttttgctatctagttaactcccagtttcagggttcaagttcatggctgcaactttcctcagatgattgaccctgagaatgtctagctacttcaggagaggctctacctacttatgatgacagggctttaatctactcaatcgggtattttcctaacaaagcacagagagctgcagcaggagaggctggtctgttacaactttagattacattcaaatcaaggaatgtttacgttttgcaagagacatttaataaagaaaccaggataaatttaaatacaagaagtgtaatttacatctcacagtgaatcctgactttcattacatttaactttaaaactaagtagacaaattaaaagtaaatatagcaccatattgtcagtgtattaatgaaatgcctatgctttgaaaaataaacacagataaagagtcagaaccatttttaatcaaagataaatatagctgctcctcaacttataatggggttatgtcccaataaacctattgtaaactgaaaatactgtaagtcaaaaatccatttaatacacctaacctactaatcatctttaccttagcccagtctaccttaaacatgttcagaacacatattagcctacagttgggcaaaatcatctaacacaaagcctattttataatgaagtgttgaataccttatgcaatttattgaatattgtacttaaagtaaaaaacaggatggttgtatgggcagtctgaatgcatattgctttcataccactgtaaagttgagtaatagtaagtcaaaccattctaagtcagcaaccatctgtacataaaaattgctcactccattatctacaaatagtctagtgtttgctgtggtctaaatgtctgcgttcccccaaaattaatatgttgaaacctaatcttcaatgcaattaatattaagaggtggagcctctaggaaatgattaggtcatgagggctctcccctcaggaatgggattggtgcctttgtaagagaggctcacggaagattgttcttcccttctgccatgtgaggatgcaggaagtaggcaccatctttgaagcagagagcaagccctcaccagacactgaatttgctggtgcattgatcttggacttttcagcctccagaaacatgagaaattaataaatacccagtctaaggaattttgttatagcagccggaatgggctaaaacatgttctagtttcaagaggatattaatttcttgaaagtgcttatatgtttcacaagagtattaattttttaaaagttctaagtaaagctatagtaaaagtaggcatgcattgttagaaaaaatgtttacagtatccctattatcatttcatgtaatatacaataatttatttctttgaaacaccaggacatttttagagtgttctttggtaaaacaaattaagaatggtaaaaaggtattttggttatatgtcaattcaaaatgagatttacatgtcccatgagattatcaacaaatgttccttgaaaaattagatgtctacaggcacaagaatgaagttggacccctacctcacagcatctactaaattaagtcaaaacagatcacagacctatataagggctaaaactctctaagaaaaacttaggacaaaatctttatgatcttgggttaggagatcatttcttaggtatgataccaactatgtaagtgacaaagaataaacacataaactagacttcaacgaaattaagaactttgtgctttagaggacaccattaagaaagtgaaaagaaaatccacagaatgggataaaatacttctaaatcatatacctgataagaaacttgtatctagaatacaaaaagagctcttacaactcaaaaatagaaagacaaccctattaaaaatgggcaaataatttgagtagacatttctccaaagatatacaattggtcagtaagcaactaaaagatgctcaacatcattagtcattagagaaatgcaaatcaaatacacaatgacatacttcacagccaccaaaattactactatcaaaaaaacagatcataacaagtgttgacaaagatatggagaaattagaaccctcatacattgctagagtgaatgtaaaatgtgcagctgttttgataaacatttggtagtcactcaaaatgttaaacatagattatcatcttacctagtaattccattgctagttacatacccaaaagaattgaaacatatgtccatgtaaaaatgtatacataaatgttcatagctgcattatttatagtagtaaaataatgaaaacaacccaaatgtccatcaactgaagaatgaattttaaaaaggggtatatccacacagtggaatactatacaataatgaaacaaaatgaaatatagattcatgcttgaatcttgaaaacattactctaaataaaagaagccagatattgaatgattccattcttatgaaatatctagaataagcaaattcataagacatagaaagcatatcagtggttgccaggggatagggaatggggaaatagagagttactgctaataggtatgggatttcttttttaagttgatgaaaatattctagaattggatagtggtaatggttgcacaactatgtgaatatactaaaaactattgaattgtatactttaaaagggtaaattttatggtatatgaattatatttcaataaagctgttacaaaagtgagatttataactcaatctgggcttaagaaatgcaattacaactagaattgtgatcaattataccaattattttagatttcttacataaaaatatgttataaaaataattgttatatcaattattttagatttcttaaataacaaaaaagttctttgaagttgtgttagtattcattagacaaatatgtttatttgtggtgaagtaagcatatttaaaagaaaaaatgcacaaaggccctaaaagcattgtcaatcagctttgttggacaataaaccaatttccagtcataacctactttgtagaagtaatagctattactattttcaacatattactatcttttcaacttaaaaatgtacccaacttatcaaatgctatctaaggacagccatgtactcttcattctgtttggaaatattccagtccaaatctattcctaatctggtccaatgagtagaatctcctgtcatgactggcagtgacaaggagagaaagggaatgggagaaaaaaggggaatgaggatagatccgtttattcctccacctctatcaatcactgctttagctccaggattgaccatccccagcaattcttcatttttatccaactttccagtgccctctaatccccttgggaagattaagaccctgtctgattcatgtatcacccatggggccaagcgcactctccttcatgtagaaggaattcaggaagggttgggtgtgaaatcaactatctgaaatggggtatcacacattaaaaatgttacaaaaaattttaatatcttttttaaaaggagaccaactctcatatgttaaaatgtaatatcagttctcagtcatggtgttccaattactcacatgccatgatcagacgcaagatgttattcaagtaacttgttaataataaaaaagttccagtgtttttcaatgtttgttttttctataatcaaaatgtattcaaaactatttttctagtagcatttctgttacatgatttataatttttttttgagatgtagcaaaaaagggaagttaaaacttgtgggtaggaaaaaatatttataaaattgcattagacatgagaatattatctatcatgtgtggcaaattaaaaaatggctgcaaatctgtctcttgtattacacgacaaagaactactagaggtatatttgggaggtacaaaggataaatattcttgataaggtaaaactctcagatttcacatatcattatgtctactggaaggcaaatcaactcaaattcctacccctcatttatgtatacttgtcattcttggtactcaccacactctctcatgcccctaaaaatatttaaggtttactgttttctctttcttgaacaattaccttgtgcctttcctacccgactaatcctcaatcattctttgtgagtcagtcagaattttatgccctgcaggaagcctgccatgccctcctcttgagccctatagcatcagagccacaaaaatgaaagattactctatgatattactgtaccctacaatactaatcagaaaaaaaactgttaaatgttacccttacagatacatgccacagtctacatattttatttactgttttattaaaccatcgcttctgatcaacttggagatcagctctcaaagtcatcacaagttgattaatttttaaggaagtcttggaatcaaaacctttgaatctcctccctgcttacaaagtatctaaaggaaaactaaaaacaaacaaacaaaataaacaaaaaataatgcaggacagcacctacaccagagattttcaccttttgttcttttacataaaagattaataaggagatatgaaagagtcatagcagtccttaggagactataaggtaaaagtattggcaactattgtcaagtatgtctaaccacatacaatagaaatcaatgatatacgatatgttaaaactcctgcaatgaccatatggagacagcagccaacagaattattcagaacatttttcgtttcctccctgtgaagttttgaatagcctaaagacttactgactacatattttttcttttgcatcttattttctgcctttcttctaatacctgctagtatacagaaaaatcatggtatcagacaaccctgaacctatagaagaacctataatgtaacttaaatataccacacatttggagattccaacacttacttctaagttatctatgtggcttacttacttatgagaagaagtgagtaatagctggttatactgtaccaatgaataaataccaataaccaagatgcctgactagtaaacctgatacaggaaacagacatacttaaaaatgtcttgttcttcaattacatcctattctgtagatctcagcatctaaattttaatttaaaataatctcaacaaaagctacttgaaagccatgaaatgaactgatgtggatatgaaatatcattttttattttcaaaatcacaaatttaaaacacaaaaagttatttttgtactgaacccacttctaagctatttatttctgtcttcaaattactattaatatcaatcctttctgagtagctctcttgggtgaaagattctaatggccaacagatggggtaagtgcacaaacacttaaaattttgtcccaagctaaatgtctggcatacatacacacccataaatacattcaacttgctttgtatttgcctttcaaattgggaaaactcaaacaaaaatttaacctgtgaagtactgtgttaaagcagtatttcactatttagcagcttaaaatacagcaattttgccataatgtaatatagcgtttaggaaataaatatgatgtgttttacccgaacgtcacttttacacaatttttgaagttccttgaacttacactggcatatttattaacagtactaactcttattattttccttaattttcttgtaattctaaaggggagggagataagaatagctcccaacaaaatatacagtaatttttttttttttttttttgaaacggagtcttgctgtctcccaggctggagtgcagtggagcaatctcagctcacggcaacctctgcctcctgggtccaagtgattctcctgcctcagcttcccaagtggctgggattataggcatgtgccaccaagccaggctaagttttatatctttagtagagatggggtttgccatgtctgccaggctggtctcgaacccctgacctcaagtgatctgcccgcctcagcctcccaaagtgctgggattacaggtgtcagccatcgcgcctggcccctacaaaaatatttaaaagtatttctaccaattataaatttgaaaggatacataaaaaatggtcaaagatttgtcttacattaaaactgtaacactaaaaggaaaaagcatagtcaggcaaaaactgttatcaagatacgctgacataatgcctccttctgctttcaataacaaaagcgagagtaaagttgtaagacacagagtgaactgaatgaccctgacttcctttcctcaggctctcacaaatacaagttagttggcaccagagaggctgggtaggaaactgtgcacatttccatatgacacagatttgttcgtgactccgaagtggcacctctacatggaaagggtgtacattttactttttcattcaaagttatgttcatacaaaattcaaaccgtttatttaatgctgcaggatttagtactgtgcagctgtctattgcattcgcactcatttgcgaaaagtttgattaaatcactactcactcacccactaaaatgacagaattcaggtttgtgctgccaatttgctcccaccacagtatgtctactactgctatcaccacctaaaatggacccttccccttcttgtatgaatcatgcttgtggccctataaataccagtcttataaaccatgatttccaataaggatcctagttttaaatcaaagaaattgcaactgctgagaataaggcattattagttacatttttataaaatttgaatagccattgagaatttagttgctctcattttcacaaaagttaccttccttaaaatatcactttataaattttgtgtcattcttaagcattcaaacatccaggagccagatactgaccccttgaaacacaattcaaattttataacagaaaagagtaaggaaagcaaaaattatttctaaaagttgtgcttttagccaactgttccttaatgtgtatctcctctaagcaatgatcataaaggttactaaaacatatgatcaacactagagccacagcagcatgctggaattcttacagaaaaaataatggtccaaactggttaaaaaaaaaaagtccttatatccaaatagcctatgacattttcagtccttcttagttgcagggctttactagaaaacatcatcatttatttttatatttttaaacttttcttttaggttcaggggtgcatgtgcaggtttgttatgtaggtaaatagtgtatcacaggggtttggtgtacagattattttctcatccaagtaataagcatagtacccactaggcagttttttttttgtttggttttttgagagtttttgggtttttttgagatggactctcgctctgtcgccaggctggagtgcagtggcacaatctcggctcactgcaacctctgcctcccaggttcaagcgattctcctgcctcagcctcctgtagctgggactacaggcgcatactaccacgcccggctaatttttgtatttttagtaaagacggggtttcaccacgttggccaggatggtctcgatctcttgacctcatgatccacacgcctcagcctctcaaagtgctgggattacaggcacgagccaccgtgcccaggccataggtagttttttgatcctcaactcctcatcctcctctctttctccactctcaagtagtccctggggtctgttgttcccttctttgtgtccatgtgtactcaatgtagaaaacatcattttgcagggaaataaaatgctgctaagaagagtatgtcaatactacaaagttgttcagtgtatcttgaagaaagtagtcaaagccattctccccttatttagaaagccagtaacgtcatcagggctagcaaagtgactccaaattgcataagaaaattaaaactacaaagtaggctcaaattgtatagaaagatgtataatgtatgctcagacaactatcaactacatgtaacaacaacataaatgtacctgctaactagatttcctatctcacattctcaacaaaccatctatgacttccaaaagtcgatggaggccactttcccatgaggcaccacagtccacagttgactcccatgtctctcatttacaccttctgtttcacgcatccttccaggttccaagaaagcaatgcccttcctggcccacaatttctcaacgtatgccttcgattcatcccttcctaattactgagcaatttctctcctgctcatattacatacccagaaccatcccttcatccaagctcctgtttcccatttcgaactaacagaaggacattttcattttattgctttcttagtacaaaaatccctccttcctcctagtactgcccctccccacaatcagttatacaacccaattataattgagccattctcaatcatgtcgtttctctttttggaaaagttctctagttcactaattttcaccacatcccagctaattcctctacaaggcttttggaccccaaaatatgatttcactaagccgctaaaatatgattccattaacttcccataactcccaatcatgtacctttcactctatccataaataatcccagcctttgactttcattcacattactcctcttgccaagaatatgcttatctctcctaccaatagaaacacacattcaagagtcaacttaggtcatgcttctctaaaagatttccccttcttccccttcttcccctttcatcctcgatgagttttctagcagaattctttctcatatctagtattctccatacatttagttttattacttgtgggtcaaagaccaaacctttatagaatgttttaaatctcccccagtaactaacatgtaatgttaacatatcacatattagttacttaataaatgcagataagtttatcatataggatgtatactaccttctcaaaacttcatgatcgattttaagataatttccaaataacagttatttttctaaagagtaaatacatcaacagagcagtaagcatggcagtgccaagagaaatagaaaaggaagaaagagttaccttgcagaaatagatttaaatgagaattttctcatggcattactgcacatcttctaacagcttttgtaccagactgtccttgcaaaaatatttgcataacaaaccaccttgtcatctagagatggtgcctccctccaggttagaggacagatttgtttcctgaccaggataataaagataacacctccctgcagagaaagattaggcagctttgctagaagccccttaaaagattgggaatttcctgatatggctgcattacagaccactgagcaatgacacaaatccgctgtgagcaagcatccacctgagacactcagcattgcccctgaaaggattttgggacatacagggaactgacaaccacatgaagctcatgctgtcttctatgctctgagtgataaaatcccctgtctctgacccaggagtcccctgtcttctgccagcatcatgtaactgcagcagactagcaagctgggtaaactgtgagacccttggtagttcctgaaatttttagatgttaggagtttccggtttaaaaaataaaacagaagctaccatgttgaattctccacgtctaacatgcaatgtcatatcccggaaacaatatgttgagtgaaaaaggcaaactcaaaagtgtgaagacttcatgatttaatgatatgaagttctactataggtcaaactaaggggagagaaatcagaatggcggttgcttctcagagtggggatgggtaggaacagaatggaaataagaaaaattttgggggcgggtgataggaatattccatatcttaactagggtagtggttacaatgatgcacacaactgttagaatacatcaagctataaagttaagactgtgcattttaatgtatataaattatatctcactaagaaagcattaaaaattctagatagctaaacagtgaatatatcacagtcccttttagtttcaggacagaataattcacaaaaacattaggagaaatactgatcactttcacaagcattctgttcaacatcctttctagagcggtagctgcaatttagggatttaagagtatgtattctggagtcagattacttggttttggttttatactcagatctttcagttactagctaggtactctccagtaacttccttaatcttttcatgcttgggcttcataatttttaacagaagtataaaagattttcctgtgattttaaagatgaaattagatagtataggtagagtgcctagtatatagaagcattctctaaagattagttgttatcaactaataataacacaggattcaaaataattcagaacatttctgttaaagcaaaagagtaatataattttaaaaatctagtaagtgtaatatacattcgttaacgggaaaactaggtgagagatttaccatgccctaaaagtcatttaattatataatcaaataatgcagtagatccacatcaccgttcttttacatgttaatttgaagtacagaaagaaaaaacttaagccgaataaatatcattttgggtaaatgtttcaagttcagacagatgtttctcatttactctcagacaactattttattattttgggtctattttcctaatgtaatgaatgtaaaagaggtaaatccaattgaatactaatcctgatcttgcctgaagagtaagttgatgacaaaatttttgaaaaacatgactaaaaaatatgtaaaaggacaaaatctagaatcggatagtacaaatacagggagaaggagacaaagggatgaaatatcagtactggaaaagcactttgctacaacaaagggcaagcggtctgacaaagctgggcggactttatggctgcatatcagaccacatactaactatagcattcatgtcacagttagtatcccccatacagagtcacatctgccacacatgtaccagaatggcctcagtactgtgttgtttaaaattattcccaacattttaaaagaaaactagaaaagagataataataagcaataatgatgtaaaatttttatcctatatcaaatttcttaactgcatcattaaaatatctctaacatttggtactgatctcattaaaagtatttccaatatttaacagtcattattatttgtctgagatgtgaggtattttatgttacttgtcatgtgagttgaaaaaatttttaaaggtacaagaaaaaataatcaagttaatggaaaacatcacttctcaggaaacaaatcaactcatttagcaatgaaggaggaaagagcatattgtgttactgctttcaatttgtcccaacaataaaatgctaaggccaaatgatggttactactgagtgcttacgtagaaaactgactcagttctcctagcagacagggtcctttctttgcttaaaagttacaacacctggtatacagcagcaatacaactaaagaagatgagtttcagactacaaataagtggctgttgaaacaaaaaggactacaattatgagatatgatttctcttttagtctttaagccttcttatgttcatatttcttaaagtacaatattataccatgtgctccacacaggaagtggaaagaacagatattacaatccctcccaagctacacctttaagatgcagcattacagataaggttaccacacacttcagtgatccactataattgtgcagacaacaaaatgctacaggaggaaaaaaaggcattttaactacattcattcctatctaaaaaagcacgtgtgcaaacttacatatgtaaattcaataaagttcatacttccttctcttttcttgccagacctgaatagtaaatctgaaaacttggcttttaattgcactacttgactcctcaaactgaacaaagtattgtgtccataaaaacatctgctattgacaaagaattgtacataatcgtttaaaaaaatcattttggcatatctttattgtaaagcattttttcccagtcctaaggattttcgggtttgaaatcaagatgaactttttatcccacagcaactctcccagaactgtccatttaaattttaatctagaaagagaagcttgtctaagtctcctacttgctgttaaaagctacctcggcccctcaatataaacagtcagaagacagccaaccatgtctcaagaagatggaagtgttctgttggcaaatggccagaagactagctcaccagaactgtccaaatcaaaaacctgtaatcagaaaattccagactcctccttcaacttccttcccaaattcaaactggccactaagatggatggacttcacttcctctctagtgcctgtcactgccttattctggaccgctcaccactgctcactgctcttcctccctggtctttccaccttcaaccttgcccaacccagagctgttttccacgctgtagtcataatggttgtctaaagggtagatatgatcatgacacagaagagagctcacgatctgtgcctcactaccttgcaaccccactcactacctgccactccctagaaacaccctctatttctcagttgtacttgatattctcggtctgcaccacaatctttgacgcccccaaagcttaaagtatgcttctttctcttccttgacagcctaaccagtgcctttaccacgtggctaactcttagtcattcttcatgactcagtctgagttttattccctccagaaacctttccatgcccctcttccttggccctatagcaccttggtccacctacacagaattgttcaccacatcataattgatcctgtcttttgtctttcctgctaattccttgaaggaagaactcttcttcacccctgtatctccagcatcaacagttcaaacacagcagcactttttaagtgtttactaagttttgttttttgtttttttgagattgtagttactgaaaaagtgataaaaagcacgtggacctaaaagaaataattcataaatttcagagttgtaataaactctgaaaataatctttttcaacttcttaatttacaaatgaggtttataaaaaagatttaagaaagatttttcccaatagcatggatatgagagaaggaaaaataaactagtgaagataccctcccctaccccgaaaatcttaaaactgtctaaggaaaaggtatctggggaatataatggataaatggaatgccatctatttcagcaccaaccacacaattctatgaagcgcatgaggagctcttcctagtgtcaccagtaaaatacgcgtttcttcacccaaggctcaaagcttctacctgtgtttgtgcctacaattccaaaactggctcttggaacagtcgcttcctccactgggaaggagttgccacacctgtaaaaggaacaggttgtttgtgatcgctaaggtcaacctcttatctctgatggtctctgaatttagagtacaatttaaatatatagttaacatagtccgggagagatacagggaaggggtgagggaagtttacttacaatcaggactgggtgtgaacgttatgggaacctagaatattagagctggggctgatctgggattactctaatcaatatccttcttgtagtagccgaggggactgaagcccagaaaacttcaggacccgcccagggtctcccagtagctagtgtgtaagctgagaccagaacttggctcgttctctcccagtcctgagcttgggcagaatcaccagcaacgccagctcccttccctttccttcagatgggtctcgggtccagagctggcgcccgctagcgggaggccagaccgggagggccaaggcagccacctgtggctttcccatccctcaggtccagcagtgcacatggggtgcccccgcgtcaacgccggaggagtgaccttgcaaacccgcgccccgcgggcggcagagccggccgctcactgcccggtccccggccaccacggaagagcgaagatctctgccagggcaggagccctagccccgacccgcgccccaagtctctcccgcgcggcggcttccggccgccatggtttccatagcaacaacagcacaagctgccgggtcccagagacgccctagggtcagaggtcatctccgtggcaacggaaacttcccgcgctacggcggctccaacgggccgcttccgccgcattgcgtagcgaagcccccggcgagccgaggctgggagcgcggtgatggccggtccccgtgagcagagggcagcggcggcgggaccggggactctgggccaatgggtaaagccaggaggaagcccgtgcctggcccgttgggctccctcctcctcagagccgaagcagtccacactcggaacccagcttcacccggattaccgaggggttccacgcctggaggcagagctgcagcgtgggcccgctcgcggctttgcagaaaacaaataatgacacacttctctggaagcccggggcctgggcccagagccgtggcttctgccaaactttctggtcccggacaccaactccccgcctctcagcccgaggccacagcggcccagcaccctgcaccttttaaagtggctccaaaaaggagaaagccaaatagatcagggtggtaggcgcgagtgcagggagctgcgaagttggaagattactgcttttcaaactgccaaagagcaaaatactaagcgagaaactccgtccaaagcaactggaactcgaggttctttactaatgagagttccagttaccatcttcagagaaaggagctcaaaagagggagtttattttttgcggaatgtcttccttgttaagaagaaaattaaagattaaaaaagaaaatgaagggtctggcaactatgaacctaatggtgccctaacgtttgctattctaaggccgagaatgccagatggggagaacgccatgagcttttgagcttgtgtattttgcgagaggctcgagtgtgaacagtagactacaggccttgagactgagaaggaagctataaaatgtgggccaagggaatgtctgcaggaccgggtttcagagcaccctatcgtggcggataaagagccactaacagcttttttctttatttagtagccaaattcttggttggcgctttgagaaaggagtaagcattaagcgaatttaaccaagtaaaatgtatcgtcctgccctttgtagtcccatagttcactatcctagagatacctatttttcactattttattaaagtgtattgaaaacctaccatgtgtcgtgaacagagtttttgtcaagagacagtgacaaaggcagtggtgcccagcagttgttgggtgactttcttacatgatgttaccagactaatcaaacaagaacttcactgttccctataaaacatgtctgcgacattcatcctttttgccttcaagtttaggaagtccctaagaatccctccttttgttcccttctcttcatcatcctaccttttacattctgaccaaagtaaaaaaaatagtggcagctagagaactacacagggaaaacatcaggacatagttggtcttgatacaaaagagctattgcatctctagaggtatacggggagctgagaagtctccctcagaaaactccatgcccttcagtacccgggttcaacacataactaaaccttgtacctggtacacaagtcctaaggaacaccacacagactatggcagtgagcaggcagatgtgtaaataggtgtttccctgtccctatttacaggaggtaaatagtattacctccacagtccctcctggaggtaatactgagttgggctcaaaggttttattaaaaataggcacagtgcaatgacttgtttaacactgaagagaagagctcctgttagactgttcaaacagcccaactgtttccccttaaggcaaaagacactattttgaataaatgcttccattttgagacatctacgtggtatttatagaaggcgtatgagtcaatttgagtgaggtatgatgccaaaatgtgcaaaggagtgaaaacattggttgttgtccttgttaccatatgtataaaaacacttcacaaaagtctccaatgtttgtgttgctaaaacatggaagactgggttcgaacattttaaaggaatggttcattgtaggaaacgtgaagtatagtatagaattagctttagcactttcagaaagtactgcatcatttgaacaaattttctcagttatggatgctgtctaagatgagaacaagttgtacagccaaagtcatcttcattgttaaaactaagtttagattatcatgcattgaattttacacttattaactgggatatacatttcaaaaaagaaaaatctactctcccaacaaggcagtactccgaagcctacctaaaatgccatcctttggttcatggagtggcactgctctacaaaacccattttgttacctcagtaaataagcttcctggatggagtctaaggccaactaatactacattgaatcccactctacagccaagcatgttagaagaagcagcttacatctgtttgctgttccagacgtgcagtctgaatttgatgttttcatttgaaatatactcagtgtttagacttgcagaggttgtggcccatttgtggctcacccagctctactggaacctaggatgagtcggtaggctgagaaggaggggagtaaaaagtgctcactcttcttccctctcttcctattttctcacttccaaacaccatgacagccctagatgtaaagcaagtagctttttaaaaaaacgtatatttaaatgagtaacagtggcataccaggtgttttggcacctaaaacagcttagtgaaaggcaaaagcagagctgaaaggcagccagacaagtaggaaatagaaagtgatcatgggtcctaccaagccctgcatgttccacctcaaagttacacgacagagcgggagactgagttcagaaaaagagaattgatggaatgttctcagtgtgctgtgcagaactaggtctagggcgtctgcttcgtactaacactgggcactgacatttgtactcaataaaatcctcttagattatgatttatcttaaaatctgtgttttccaaaatcctaccaagccatggaagtttggggatatcctgtgtgtggttgagtgggtatatctatttgagggtctgtggcttcctttgcttgttttacattatgtgcctgaagagacagcaatgacatgaccttagtatttatgtttattgtggattttcttttttcaaccacacttctttccttagtacccttggcttaaagtgcagtgacctagattatttccagaacgggcctattatatacattggtcaatccaaactatcatactggtttaaagaaacctatgaagcctccttcaagcaaaataaatgccttggacttagtattccctatttaatgatttgcctaaaataaagtcaccttgcatgactcctacagtgaaagttgaagcaggtaacatttattctaaatgcatagctgttgctctgctaggaaagtaggacatttaagagtgtgtgtgtgtgtgtgtgtgtgtgtgtgtgtgtgtgttctctgataatagttgttagactgggtgttttaatgaagatagcaaatttactttatatccaggacttttaagctattggaatttattttaaaaagcatatattgtgcaaacacatttttcatgttctcttccagttaaattttacataaaacaagcccaaaacactatttaatgaagacctcttatataagtattaataatgagctaatcaataacttttgggtagatgaataactttgtccttaaattcgtaactctattttctgcttattttcacaccaacttgattatatagcggtgctctgaaattccacgaatgcttgaaccacctacacttgttgacagtttagcgaattggaaataatcagtaaattatttcataacttccaaagatataggaaggaaaattaacctattatttatctctgaaataagaataggtgctttacaccaaattcactggtatttggcagtattctcccaagtttcttagtttgaaaccagttaattgttctctttttaaatttaagataacataataggtagtagtcaatctgttccttttggctgtaacagttaaaagaattttagtgtttgtttcattttaattacccaattaactttttagttctactgctattttgggatcaaaaacctgcaaaagattttaggctttatgttactagcaggagaatggaactcacgaagtacaatagtgaaagggaatggcttggcatgggttcgattcaagcttaacaggctaaaacttttagaaggtaagataaataatgtgacacattaatgtcccatttaaatatatatattatatatatgtataatatataatatatatatatactaaatgctccaactccctggttggaactcatatccctggttatctaacactaaattatcctattagaatagttggtaatgttcttagatacactttgagttagcccatcaattcatacccaaatactttagcattcataagctgcaaaatgaattgttctaaaaataaattgtcatttgttccacagtttccaaaaatgccttggaaggggggaaaaactattccagagagatgaaagtgggtgggatggaggaagtgtaataagattgtgactcgtgtatagggagaaatttagtgtttccggtaaaattgtttacaaaaaaaattataaaggcctacaaagaaacttactgttctgtgctaaattatttcccactctccagtactatggaaggactgacttcaaggtccctaagacaaatggtcacatctaaataaaaaatgtttttgcactattcctttctcagaagagagttaaatcttttcacagaaagacacaagaagggttcaaaagaccaccatttttgcagtgtaaagcagtcacccctgcccttcccactgcagcccttggcctttctcactttgagaagtcttgcaaaaagggtcttcatattaggctgtgagatagtgttgcagatgtaagttggttttgtatgaaccaagcgtcagcaagttttaggtttgatgtcggggacttggagtacatcttggggtacacttcatagctgaattagacatgcgggtggaaaggtgacaacactgttttccccttgggcaattctcaggttggtgtgtcgtttcagagttgctaaacgctgaggagttaagaagagaggagggtaaaaggacggaggaggaggaaacagatggggtgaatagaaacggtgtaagaactagaacacagggaggaggactcagggcagagcccagagcccactgcagcaccgagtccacggagcagccagaggctactaccagagcctcaattgccaccccaaagtaccagctgggggcaatcttctccgccccagcataggagcctctgcccttttagactgtctaacaactcgcagtttctcctttgctgcaggaatggtggccgcaaacggtctcagcctccgcacccaccgcctccgtccccgcccacccgcacctcctcctcctctgcctcgcgctgcacccgcaggcggcagacccctcggagcgcgccaccccagctacgttgcattggcaaggttcggaggctggagggcagcagccacttgctgccccagtcgctggggctctgggtgccagtgcggcccccggcagagcccagggcgtcagggaggccgtggagagccatgatctactgcaccgcagtgccagcgtcaggagcttccagagcccgggctgccactgcgggacggccgatctgcccgctccctccttcagacacaaccccagacaaaaacagccggccccgggtccctctccaccctgaacggagctaggggacgccacacactcccggctgccagcgtgagcggttccgggaaaggctgcgcccagcctcctcgccagcgccgccgccaccaccatgcagccctccagcctgcctcccctgggttgctcgcccacagctccgcggccgcccccaatcgcctcggactgagacgcggggacgggaacccctgggatccgactccccaaatcagatgcatttgcatttcttatgtaatgtactgcaagttcccttgttggagccctttggaatcggggcgcatgatcaccagtaggcttaaaagcaggaactcacggcctggctcatccccacccctggccctgtgggaccccgacgcagggctttgacaccgctttctaaagggggggacttcaattacaaatattagaggggctgggcttgtcctctcagtctggggttccctcccggcgcaagccttgctcaagtattcccggtggcaggatgtgtcagaggcagacagggggaatgagttaatgctcgggcacccggagctggacgggggagggacgcgggggctgacggaggagcggggccgcgagggagggggcctcttttactttggtaaaggtgatcgtggtggcgaatattgtgcaagctaatcagaaagtctagagcaggttctcggaacccagctacgtccctcgaacctgctgcagaagtaaggggagctcgcggttctttttcctggcaactaccgaagcttcagctgcctggggcacaaccttaagccatagcccttcactattccaccaaacataggcaaccaaatacattaaaaaaaaaaaaaaagtttcctcctccctcctagtgatggattgtgtcacagccaagggatgccaataatggttttggggttcgtagacgccgatccagctgttacttgtttattcatgcaacacctctatatgcaacactgtcctggttcctggtatgtttcccctgccttcctgcatagcagaactgcagatctagctcgatgagcaacagacaggttattatgaggaaaaacataacatgatgcatgtttcgcttaccagttgggttcttgtttttcttaagactcttgccacaaagacactgcagcatatgcgttcctttgctgaaaatgttccaaagaaaccacattgatttgggcgaaaagcaatccagcagcttagacaccctgagaaagaagagatccttgtggttgcataataataatttgaaatcagttctcctgaagaggggcaccggttttaccataggaaaaacgataatattccggatcttctcccagttttttcccctcacgtggtatatttctttgagacttctcagtgattgtttgttttcggccagggtgaatgatttatcccccctcgatcaccaccggattattaccaaagggttggagaaaaaatcctttttcagcatgaagccaaacagaaaagcaaagagatcccaactgagatcaaaactaatcagggagaacagtaatgcacaaaagatccccaaagagaaaaccatagcctttttacttgatcgctatgaggatgggtggatctgcagaaggcaaagcaggattcatcttactgagagaagactgccattgtgtagcccctaggagagaaggaaaaaaaaaaaaagaggaaagaaagaaagaaaaaagaaaaaaaaagaaaaaaaaacaccaccacacacactcacacaccaataccacctccgagattgagtctgacagccgaagacagagcctcccttctcccagtgtcgatttttttttataatcaatcgccagtgctcagtgggatcggtttgaacctgcagttctcaatcaccacgaagaaaagatgcaaatttaggtgccccctccccttgtcagtcttgtagtaggtagagagcgccacaaatccccttcctccttcctctcactcttccagtttccaacaaccgtgagcatgaggaaaatctcccctccggattcctcgcccagcctcggatgtgagttacaggcattagagggaggaggaggaggagttgaagtttgcattgaaaagactggctttccatgacgtagccacgtgctttcagacccgtcaccagtgagatgcttcaaccagcccagggagggcagtgtcactgcagtctctctgctagggcccctcctgaagtctccccacccgccagctccagccccagccccaaacccagacccaacgcgcgaccctctccctcctccgccaagcgccagtcagcctgctgtttgctcttggagccaatctgacagccttctattaaaagtgaattttgaaaagtaaaaattaaaaattataatgagtaaaccttagaaaatgcatgttgggaggttggaggtgggggggaaataaagagaaaaatgggtttaatgcttctccacccagccaaaatcagttccaccttcacattttcaaaagcagcatataatgcacctaaaacattaaggaaaactcaagttcctttaattcttattattggactcctacttgaggggctgtttgaaaaatgtaaactagatatataacagatattaccagaaaccgcctcttaaaaggacaaccactaaaatctaggtggcaaactgtacttttgtggggagggtcatgtatacatgagaaaatgtatgccttttatagacaacacgttacctttaaataattgtgcagaaagtccctgcttaaatcac

SEQ ID NO: 6 - DNA, 101 bp, Homo sapiens
cggggatgcactgaactgttcagttccgacgtgctgcagttcccacacgcccgcgccccacttacatccagcaccgaggccaggtgccgggttcggctggc

SEQ ID NO: 7 - DNA, 197134 bp, Homo sapiens
cgttgcactgatattcattattgcaccaataattttaactttcttaatactaagtatggaaggatgcctcataagataaaaatagttcctgttgtatcatcagtccagcaatagattagggaagattaaaaatggattgtaatgccttctttggccttgagaaagctcttattgtgcccatggttcagtaggcctgctgatcatttccatcttaatgtaatctttaacattacactgctacaggtgagatgttaagtaatacattaagacaactattttcactgagcaatttcacaagaaatatgtttttagctaaattagacatttaacaaatgccatttgtaattcaatgcagaggagacagcatccttaaaacaagctattgatgtgactttcccaacataaaacaatacttatgtttttttaattttaattgaagtcctgaatgtgaaactatcgccgtcagtgcagtagaccaacggaaagcaccaaataccttaggattatgaaataagccatatgcagttttatctctagcagacagaaattcttcatccaaattaggaagaatctacaggtcaagttaatcatgtagctgtgacgtgctgaatgtttttaaaactttaagatcatttagatgaacactaggaaactcagaggtcaggcagaaatgtaaattgtaatattcaatgaaaataataaatgaaataattgagatgaaatattatctaaagaatgcatgagaataactgaatctgataaagtaaaattaaaattaagagagaagagaaaataagaaagtgagcaattgaaaaacggaataataaataattttttaagaaaaataatttcatcatgtatttctctatgctacgtacataaacgcaaacgctataaatagagttattgacatttgggaggttgatttgtttttatcaacatcgcaaaacagaaaatttaggttgcagattttcacatggctatcacgttcagaatccaatcaggttctccttctttactacttgatgacttctttaaagataaataagcccgcggaccaagaagtgggtacactggctcggttaactctctctccccagaaatttcactactgaaaagattattatttgggggcggggaaggggatgtagaggtctttaggacccagcaggcggcggcaggcggcagttgtgtagatcgctgagagactacgagggtccggttcagttttaattctgtctctaatctctgcaacagccgcgcttcccgggtcccgcggctcccgcgcgcgatctgccgcggccggctgctgggcaaaaatcagagccgcctccgccccattacccatcatggaaaccctccaggaaaaagtggccccggacgcgcgagcctgaggattctgcacaaaagaggtgcccaaaatgaagaccctgatggtgagtcagttgtggcaactccaccgggcaaagagggggatccccgggctcagggtccacgggacgcaccgtggagactccgagacgcctaaccctgggccgcgaggtcgcctgttacaaagggacaactttctacccgctccgcgttccctcccgattctccagctctgcctggctcggaatcccagagccaggatgggaactcggggttgcctcgcctcctagatctccggcgagaggtccgagggggtggcggagagctgcaggagcgatggaggagtgggcagattgctcaagggatgggggtgcccaaaagcaacagcctgccaaaaactaagagggacggggaggggggacctttgcagactttcttcgttttcttagatttcaaacttgcaaggatcgcaaggatccagggccccaggaaaggaggggtgtgaaggactcaaaattccagcagcttggctggggtggctgcgccagacgggcccttccccaaagtgcaaacccacccctgtcctcggccccggcgcgctccctccctcagcccggggccgtacaccacctgccctctaccgagagatctgggcggcggcggccgaaagcagcgacgcgcccggagcatcccttgcgatacgctaggggacggtgctttctctgtcccagttgcgtgcggcggggctggggcccaggccgccccaaatctcccccactagagtgaccaccgcacagttgtccccgctgggcgcgctcctccggtgtctgcgctcagccgctctcctcttctctctcccgcccgcccgcagcgccatggtctggcagtgtgtttagcgctcaccaccatgtgcaccagcttgttgctagtgtacagcagcctcggcggccagaaggagcggcccccgcagcagcagcagcagcagcagcaacagcagcagcaggcgtcggccaccggcagctcgcagccggcggcggagagcagcacccagcagcgccccggggtccccgcgggaccgcggccactggacggatacctcggagtggcggaccacaaggtgacagcatgcccgccagcccgctcgccactcagcctggggatcccgcacacctgagccttccccctttcccggggctgggaggcgctgtgagtaggtgccgttcgaaggctggaggggagtggacccgctggggtagggtgggctagttccaacttggtatgaattcttatttggagaaagacacaaagttttgtagaaaataggggtgaggtgcgtggaccccaaagcctaatttcccagcagaaatcggccctggaactagaactccctgatccccagaattgcagctgcggatggaggtccggttcctgaagcctcgggtttggccgccgagtcgctgcctggtgggaggaaactggggttggcgcgggtaccagcctgagcgttcctctgacccggaaccggagggtgagcgcagccagcccgcggccactgctcgggatccagcgttcccctctgatctctccagcgcattgctttgggctgaattctctcagccctggggagtggtgcccaggcaggcatggaagacttgagggacacactcagcttccattggtttgaaactcatcattgtgagcctgtcttcctctgccttccgggaagctgctgcatggggtggctaataactaataagatgaattttttaaaattgggcctcctttccctggaataataaatatctggtttcagtgtgtgaagcctctgggagaatcctaatcaagtttgctgattctgaagatattttaatacagtttaaatgtatccgccattatttgaagctgctcgtatgtttttattaaaacacaattccactctctatctgctttataaagctagaggatttcttgaaatctcccaattattctttttattttactaaattttgtggttgtgaaccgaagtaatatatagtagatgctccttttgtgtgcaaaggtcactctaaccatgcgtgaaaaagccaaactttttaaaaagtggcattcaaaatattgccacacacctgtttaatgcataatgctaaggatttgaaaggtataaaagaatttaaggcaggacccagtcttacggatctttaaatacctgaggacagaacaatataccatgaaatgtgtgtagatggataaaccaatagataaaaatgtgtaataaatgctagatatgaacagtactgtaggggtgcaaaaatgagaacgatgacttccctggaaagatcaaggaaagcttctttgaaaaagtggaattttgcaatgagaagaattcagggaagcaaaaaaggaggaatcaatttcattaggaagtgattatttatttatttatttattgttgtggcaggagcaggggttggggggtaggggtgttagtagacttaaaatccaaaagcagaaggctatcaattttacaattacagcttttgtttccgctcttagttgttgattgattacatgctttgtatctgcatgtgcaagcaaccgataagggctggagttctaggaaagtttagacattagcttctgactgtagatggctgtggtgtttatgtgtaactggtgtatgatggatatactgagatcatggatttccatggctattgtttggtggaaattactgtctaacacttgtgaagctttgattaatggcagcatcaaaaggtaaatttgctgaaagttttgatcagcttttgggaagagatttctaatacttttcttcctgtgttcttctgctggacagacaccagctaagaatattgagagcttaatgcaaagtataataacctaatgcttatgttcaaaacaatgtttattgaccacaaatatgtttgatttcaatttttgtttatcagagctttattttattgaaacaaagaacagtccttttcaatttggagggcgggatgttgataccctacatgggaaattgaaatgatatgtagtaaaagggttttacaaattgtgaagtgctatatgaatgataaatattgtgtgaaagtcattggaattcctagtagaagaaggtctttggagataattatgaatatcaatgaaattatctcatggaacaccaacatctcacaaaattctatacccaaaggttttgagggagttcacgtcaccacaagcaaaggaagaaaggcatatcttaaagtctatgtcttctgtttagacattatcccaattgtcccactgaactaaatgtaaacttctcagaatgccttaactgattctctttaccgctactatttatctggctgcaaattgggcagagttcccttacagatggtcatatgaaggtgcatgtgtaaaatgttgtttatgttctctccaaaagttcctgtttaattaggtttatttgatatcttcctatattcttgcataggcagaggtggaagacattgttagaatattgctaggaatttttttccaattatgacaggggagggtaagaaatgaaagcctttctattcttattatattgccagatgatactcgattgctaatttttttttaccctcacatcaggcctcaggaaaatgatggaatatgctggatgtgatgaccaccaagccatatgctgctgcgtattgaatcagaattccaacagccttttttatctgccattgttttacatagtctggagagagttacagatattatttaggaaaatgttcacacctccatagctggaggccccaaagactgataaatatgtagtgtataagctcagttacatgatgttgttaacattaacagttccaagattaaattcaacaggtggtcctaatccccagcacctgaatttcacaaattacagcctgtctgcaatgatggtcttgtctcatatggctgcagactgaattactgttgagattaaatcactgtgtgcttttgttgaaatatatgctgcaagtcaagtcagtgatgagcggcatgtgttgaggcttaaaatatcacttttcatggtcatattctctacttcctctttcacaaactatgtgagctgcaattgtaatttcagtatcactaaatgaaggctacatggagtttcttgtcataatgaaggcattttctgtttgagtctttctcttctttcccaatccctttccccagaccaattcccacaaatgttccaccaactcatttccatcgtgttacatgtctgtgtcttcaggtactatatctgtattctaacattactctctcagtcccgatttgtggaagccaatgataacaagattgcttaggtacaactgaagaagccaattttcatggctttgggaaccttctgcatttagaactgtagcctaatgtataaccaagctaacacacacacacacacacacacacacacacacacacacacacacacacaccacacacattaaatcaagaaatactcagaggaaagctccaagtcttatagcagaatggaagggaacatggaacacagttcagtttccagtctggatctcgtctgggtagatgaggtcatttgccatctggtagaccctgtgaaatgaaaccgtgagctaattcccatttctagaggacaggctcttatcacagaaggcccactatcacccagactgccctttactgaaatggcttatgaaagggcggtgatcaatggggtctacagctaagcagctatctctttgcttcagaagtagcccccagggatggattttacacataccaataacatacttgtccttggttctttccatttttaggcactcagttattcagacaaatcaaaattgcttagtggtaatagtactattactattaactggtaactatctggttggagtggtaagacaagtgaatgcaagaactgaaaaatagtcatccaaaaccggaatttggataaatgccatctaacttattttaaaattatgggatgagtattccccttttagaaaagtatataaattatcaaacacaagtttacataatttatttgaccacattttatgacatttgagttgtgaatgaatgactgaaatgaatgctaatcatttgaatctcaaggaaattcaaagtgagctaattttcaatgctcaggtattataagatgtaatctgccaatgatgatgaaaccctgttaccacaaagcatcaaacccccaaaatcagaaaaagaacactattttgtgggtgaggagttgcaataatgtagtcacttttaacaggataaatgttttttataacatttattaaaatacttaaccttccttaaatctgtgacagccaggataatttttccaacttcccacatgggtaatttcaagatatcactatcctcctgtaaatggcagatgagtttgaccaggctcactcttaaattccaggcatgctggctttcctgctgatctgtgaacattcattctgcctcaggacctttgcacatgctcttctctcttcctggaaagctcttccccaaggtcttttgcatggttgattccttctggtcattcagtcatcaggtcacatgtcatcttcttatggaccacattctttaactagcccctcctcaacagtcattctctgtcatattagcctgttttattttccttataacacttaacaatatctgaaataatcttaaagtttatttgtctattttctgcccttcccccaactagaatctaagtactgtgacagcaatgtctttgtacatcttgttgaccagtttaaccccaggacctacaacaatatctaaaatttaatgggtacacaataagtatgtatggaaagaaagaagggagtgaaggtggaggagagaaggacagacctacttacctatgtcaacttttttctctacaagaatcatcattgcaatctcaagaccctagtatgtctcatttttccaaaatttgttctgcccacaaaagtaattctaataacagggaggaagaggaggaaatgatttaagaggaaagacaaaagaatctttgggaatgagatttaggggtccatgtttaataagcttcctttttaaatattgcacacattaaactttgagaaacactgtttgaaatgtttttaatcatcacaatgtgtagttctgtagctaattcatttctaggtttttgaactaatcatagcccttggtaaatacttgttgaaggcctagtagtttcaaaattgagcattctggaggaagaacacaatccctaccctcaaagaacctttgatctaatcgttgcagagaaaagacaaagaagcaagaaaagttcaataataaggcaagcactgaataataatttgaaatcaggaagcaataaatcaaggcactgactctaaaaaggagataatttctgtgatctttctccatctataaaacaagttaaattctattattaccttagaagtttgttaagctttcaaactaatattccactctttattagcctcatatctcttcatgcatgtgtgcagggtatccaatgaataattactgaacaaattggatatcaaagcaacttcaaagtggcttgattttaaattcaaaatattgtctctttatgattttcctcggcatgacatagggtcttctgcacttgttaagttaaaccttcttgaatgtctctgtaacatatggtgaccaccttaaccaagctaaatctcataattcattgtactagtcagggttctgtaaagagataaagctaataggatattatattatatatatgggagtttataaagtattaacttacacgatcacagcttcccacaataggctgtctgcaagcttgaggagcaaggagagtcagtctaagtctcaaaactgtagaatttagagtccgatattcaagggcaggaagcgtccagcatgggagaaagatgtaggctgggagactaggcccatctcaccatttcacatttttctgcctgttttatattcgctggaagctgattagattgtgctcatgagattaagggtggctctgccttccccagcgcactgactcaaatgttaatcccttttggcaacacccacgaagacacacccaggattaatactttgtatccttcaatccaatcaagttgacactcagtattaaccatcgcaagtccaccccttgtcaacttgaacccaaacacatctcctgagatcatacataatcttcaaataaagacaataatgaggtcataataatgcctaacataataaaactatccttcatacaactggaaacacaccaacccccaacccaaatactattacaaaaagttatcaatacttaaatgctgatatgcagtcaatacatcttatgtcacatgataaaggaaaaggaaacaaaattaagatattttcttagtacaagtgtatacatgcacaaacgtttttaacagaagaaggaagaaatactcatgacaattacagtcctcgtttctgcagctgctcaagtagctagtaatgattactaccttcttctactactcattgtcttccctttgccttcagcaagcacctcagcaggtcatggttttttttcctggtggagtgacccaagccttcattcctgaggggtctgggtcacttgtagtcctacctggattgggcggttgtaatttcccattgactttaatcacagggcatggtaataacctaatggacaccctaaaggatctcccgtatcccatgcatactctttcttacctccgttgtggagtagtggactgatttcatcttgatagtctgggtcagtcaccccagccaacactgtaactcccttcttagcctgttgacttaaaggtaggaggaacccaaggtgtccaggtggcaatcttaactctcagtttaatggaatcattgttgtgtctccagatggcagcgttcctctctctggagctaagacctctaggacagcagaacattatgttgcaggaacaggaagcaaaacttttgctagtggatcactaggggtgatggtgagtggttccgcttccacttccacctcttgattcctggacccgtgcatcctggctatgggagaaacagtaccatatattggacactgatgcagagcatacatccctgccaccatggccttctggagaactttgccccagccctgcaaagtactgtcacctagttggcattgtaattgtgacttcgaaaggccagtccaccgttctataaatccagctgcttaaggatgatggggaacatggtaagaccagtgaattccatgagcatgagcccactgccacactactttagctgtaaagcaagtgccttggtcagaggcaattgtgtgtggaatatcataatggtggataaggcattcagtgagtccacggaaggtagtcttggcagaagcattgtgtgcaggataggcaaacacgtatctggagtaagtgtctattccagttaggacaaacctctgccttttccatgatggaagaggtccaatataatcaacctgccaccaggtagctggctgatcaccccaaggaatggtgccatatcgagggctcagtgttggtctctgctgctgtcaagttgggcactcagcagtggccatagccatgtcagccttggtgagtggaattccatgttgctgagcccatgtgtaacctccatccctgccaccatggccattttgttcatgggcccattgagcaatgacaggggtggctggggaaagaggctgagttgtgtccacagaatagatcattattaaaatcctcctctgctgaagtcactccatgtgaacactcacacgggatacaaatatcttcacattttttgacccctcagataggtccatccacatacctcttccttaaatttctttgtcaccaattttccagtcgtgcttcttccaagtccctgaccatccagccaaaccattggctacagcccatgaatcagtatataatctcacatcggaccgtttctccttccatgcaaagtgcacaaccacgtgcactgctcaaagttctgcccactgcgaagatttcccttcactgctgtccttcagggatgtcctagaaagggccatagtgctgcagctgtccacttttgggtggtgcctgcataaccatgcagaaccatctgtgaaccaggccttagtcttctcgtctctgtcaactgatcatagggaactccccatgaggccatctgctgggctgagggagagaaggcagggtggcaagaatggagaccatgggcatttgagccacttcctcatgtaactaacttgtgccttcaggacctgctcaagcccgatcacgtatacaccacttccatttgatgatgggatgttgctgtgcaaaacccgctttttggctggatgggccagaaaacactcagttcatgataggcaattcagtttgcatggtgacttgatgacccatagccaaatgatcagtttccaccaaagcccagtaacagcaaaaggagggtaattatctgcagatggcagggccttgctccaaaatcctagaggcctctgcggtgattcaccttttgggcttgccaaaggctccaaatagcatccctatctgccactgacacctcaagcaccattggatctgctgggtcatatggcccaagtggcagagcagcttgcacagcagcctgagcctgttgcagagccttctcctgttctggaccccactcaaaactggcagcctttcgggtcacttgataaatgggccagagtgacacactcaaatgaggaatgtgttgcctccaaaatctaaataggcccagtaggtgttgcttctctttcttcattgtaggagggcccaaatgcagcaactcatccttcaccttagaaggaatatctcaacaggcccctcaccactggacccctagaaattttactgaggtagaagttccctgaattttagttggatttatttccgatcctctggcatgcaaatgtctcaccaataagtccagtgtgtttgctacttcttgctcactggatccaatcagcatgatgtcattaatgtaatggaccagtgtgatatcttgtgggagtgaaaagcaatcaaggtctctctgaataagattatgacacaaagctagagagttgatatgcccctgaggcaggacagtaaaggtatattcctggccttgccagctgaaggcaaattgcttctagtgggccttatggacaggaatggagaaaaaggcatttgccgaatcaatggctacataccaggtatgaggagatgtgttaatttgctcaagcaatgaaaccacatctggtacagcagctgcaattggagtccccattttgttaagtttatgataatccactgtcattctccaagatccatctgtcttctgtccaggcgaaatgggagagttgaacagggatgtggtaggactcaccacctctgcatctttcaagtccttgatggtggcactaatctctgcaatccctacagggatgcgatattgtttttgatttactatatttctaggtagagccatctctaatggcttccatttggcctttcccaccataatagccctcaccctaccagtcagggagccaatgtaggggttctgccagttactaagtatgtctatgccagttatgcattctggcactggggaaatgtctacaggatgagtctggggacccaccagacccactgtaagtcagacctgagctaaaactccattaattacctgacctccataagcccctactttaatgggaggacctcaacgacattttaggtaccctggaatcaatgtcagctcagagccagtgtccagtatccccaaaatgtctgatcatttccctttccccagtgcacaggtaccctggtaaaaggctggcgatctcctggggaaaggatgggaaaaagagtcactgcataaattgtcagtaatgtagtggggtccttcctcaaggggatccaggctccccttcattcaaggcgttctgggtctgtaaactggctcaagtctggaaatttattgaggggacaggattctctgtttttacaattcaaattagtcttttgtccatttgacttcgaagttttctgcttgtataaattaagtagaaatgcagtaggcttcttatcaatttcacttctaggaacaccatgattaattagccaatgccagagctctacatgagtcaggctattctgattgctgctttgcctctgctgtccattaaggtagctatgcccaccttgcctttgacagttgagtgccatcacttggcccctgccacctcaggatccagttattcccactgtatttacattttgtagttgagtgacttggttcccactgttagatctgacatacagagaagaccaattataggactcttcaaaaacataagtgctgccctcataaatctatttcacaaggcattgatcaagggtatgtcttctggaacctcccagctgggatgagtatgtctaaagtgactaatccactccaccatcccaatctccctaagcctttgggtcccttcctctacattaaaccaggggagaccaggcatttccagctcactcacagtgagtcatcttttaattcatatttcatctaaccaagcaaataaactattagaacctttttttaactccctgagctgcagtattaaaagcagagtgggcccaaatcaataaattcagcctgatccaactctatgttccttccaccattgtcccatacccttaatatgcattcttatgcctgttctccagaatgctgtttatataaattagagaattcaaacagttattttcaagtgtagcacacctcctattgggtcacactctcaacctcatctctaggggtccactgggactttagtctagttacaggtctagaagcaaacaggggtgttggggtggctcctgaggagaatcaacattatttggcctggtgagtgcctcagggaggccatcactgttgcctcaggcagcacagggtttatgtcctcagacagatgtggaaaggctatggcagtgtgggtcagggaggagatgttgccactactggggatggggaagctgttccttctggcaaaaaaggtccatcagagtttacaaactcagtatccccagcttcattagggtcctccacacatcccattccaagttgcagggtcccattcttttccaatcaatgcctttaacagtagacactgggtgaggctgtgcatgcaccttttgttgcaagtcagccacttgcacgataagaacttgtgtctgttttccacaatttcagctctttctctacgggagataagactctcactcagggcagtcttatcagatttaaggctcagtatctgcttctgaagccaggagacagaatccctgagttcatcattttctttcatcactttgtccactgaacttaggaccaaccagcttcattatgttctttggttctccacatatggtcaaaggtattaggtatagtcactaaactccttgcctcttaggagcggtgaatcaggagtgtcaaatgcatttattttgcataactctctaaacagtttatgccaaggactatcagtgttttccatagtattagaactagagttcttggcattttggggtctaatcatattaagcagccaacttccccaaaaccaacaaaagaactccatccttaatattcagttcctctagaaccattcctgctacaaaaatctgtattagtcagcattctctagagagatagaactaataggacatatacacataatacttaatagtttattaagtattaacttacacaatcacaggttccacaataggctgtccacaagcttgaggaacaaaaagagccagtccgagtctcaaaattgaagaacttggagtccagtgttcgagggcaggaagcatccagcatggaagaaagatgtaggctaagaggctaggccggtcttgccagctttgctggaagctgattagattgtgcccatcagattaagggtggatctgccttccccagctcactgactcaaatgttaatcccttttggcacacacacacccaggattaatactttgtatcccccaatccaatcaagttgacacttagcattaactatcacactcatgctatggtgaatgtggatataattgtgttgaccacaagacagaatatttgcagtcaggtctgtcttagaaacatgatacctattataaaagagaatttccgtaacctgtagggtgaagtgtcagtacaatttctgctttgcaaatactaggattatggaagattaaatgtgtgaaaggactttgaaaaattaaaacatatcattaatcaacaagtcattccttaaaacctcttattcacctactatatactctttggacagctgtgtagggtcttaagtatagaatgacaaggagtgattatctcttaaataatattgtcatccgtatcccagaacttgatccaacggaagaactctcatgggagtcagtgaatttatgatcaaatgattggtaaaacttttggggggaggtatgtgcatttatgagatgtgttcaaattcttctccataagctccgagtcttaaacacttagtctgggcctgggacaaataaatatatttattgcctgttctattcaatatgtctttctaaataaaaaatcacaggaatgcatagtctcagcatagacagcccatctgcagtgaaaccttccctgacttatagcccaggtttgatctgagctgtatgttttgtcttcatagctgagatcccatgacaatacttattccactttattgttatttcttgtctaaaattgtctgccttccctactagacaaccagctcttggaaaccaggcatttttttttctctctttttctgtcattgtagtcccagcctttaacataatgcctggcatataatgagtcttcaataagtacttgttgaatgaatgagaatatctacataaagattttgtgtttcttctaaaataagcctacctcaagagtttctaaccatttggagttactgaaaaggaatagctgcaagtcataaatatcaattcctcctgccacaatttgtaggcctgtaactaattcatttctatcttcttgtactaatcagatctcttaaagcatactcaggatttcagagctagaaggaaaacttaagaattatcaaaaggaattccagagtggttgtgtgatttgcccaaggccatgggttagtggcagagctggggcaaaatgtcagtctctgatgtgaacatcattaccataagagaaattcagtgccaacatcttctaagcagtgactcaacattatttggacagaatttattaaaatgaagagcctaggcctacccagttattgaaaaggaataaatatttaaacatcttattattctgagatgaatatgagaatatgcctctggatagttaaaaagagtcttccaccaaccaccaactttgcaaatgggtgtttcagagaccacacataatgcatggtactaattaattgaaacaattttcaaaccagagtagatttttgcctttaaaacataaaccaagccaaaaggagtgtcatgcttaattatctgcataaaattttctgaccagagcactcatttagctgaattaccttctccacagtggagaagaaaacatcatcaggagacttagttaaccaagtgtttgaagaactaccattctgcaaatatcattgactccccccaaattctgagatgtaatacttactctaggatggaattactttaggcaaataagaaagcattttacctatcatagggaaaattaaccctgatcattgctacagctcttgaaaaggaaacttttttagtatattcactcttaatggctaaggaggtgtctgtagagttcctgggaaactgcacagagtctgagtattctctggcagactgaaatgcagtgccaaataattttttaataagaaagcatattctggaaattaattgcacatatgagacatctccattgactgaactgcaaacatgattgcatttccaacttacagatcttttcatgttccttgcgtgtttcctatggcttcccattgcctacaggatcaagttcagaccctcaggaaggcttgcaaggcccaacaggatcttgctggcctaattctccaaccctacccccaccactgccctcagcctaggcactacgcacccagggataccgctgccctcagcctaggcaccacgcacccaggcaccgcacataccttgctgttttgttcttgtctgctttaccttcagcacctcctttctaaagttttcccagatacaacatctatgcagagtatacccaacgttctcttatgtcagccacacatcattcagtcaatcacatattgactgagtagctaccgtgtggtaggcacaagggaggaaacaagataaaggaccttgtccctacccacaggaaaatcagtggaggaaataaatgttataattactataccttggtaagtgctaaaatattctctgtatcttacacatgcttctgatcacacaatattgcaatcatttttccacatgcaagtctccctgactaggttttacctttttgaggctaagaacataacttatcttggtatccacagaattgaaaactgtatctcagacatatgaaagctaaataaatatttgttgaatgttgggtaggcaaagttctattttaattgtatgtagtatgaagaaatttgaccaagtctggctaatagactattaattataggaatggacagaaatgataagtaagggcagaagggcttcaggtatctgacatacacatctttaatttctgtttcccctttgaatacagagcaacatctcctgacctttccagaacagctgaccagatgtggagatgcaatgatgcccatatttgaaaacagtatagtaccatgacaggcaggcaggcccaggctatttatttgttgtgagctctttggcatgtcataacttctaggcttgatccagtttatagaagagaaagttaaactatattcattcattccctcatttattaaataatattgtgtttctaccatatgcctagcattgtgttcaggacccaggaagcaaggaacaatgaatgagatgtgatcctcaactccatgaaacttatatctgttgggagagggagaaacacacataaaatttcagtgcagatttggagaagtattatgggctgtggagattggattttatcctgaaagcattgaggaagtctttaaaaggtaaattagaggaataactccatcagatatgtgtgccagtggatcaccctggcttcagtgtggcatgggttaaagtagccataggttgtaggaagagggaccaattagcagactgttgcttggtttgagtaagtggcacagccagaggatgatgaagagacctcaggtttctgcctgccttaagtttctatgattggccaccctcctgtgtctgtgcagacagtctgaatgcagattctccaacagaaggtttgtggttcaagattgcctcacaattgctggtaaagagagctgaggatgatcccagatggcacttcaactttctctaattttgaaccttgctgtgcacctgaataccacatactgacttgagcaaaacagtagtgttattgttagggctgaagcaagctgtttgtcgagactccataatgcatattggtgacaacaggaattaaactctccacctgcaggacagccagccagtggggtgtagaataagtgtgctggcagagactttagtatgtaaaagtgccgcaggaaaagggggcaagctttattctagaagagtcccattcaaaccatagcagataaagatattataattagaaccagaaccaagaataaatactagagtaagaaatgacaccagtttgcttcttcccagtatcagagagtgtctctttctggctatatggacatgaaattttgactgggttccagaaaggcaagaaagggtggtttgtcatgggcttttcaatgcctacgaaggactcaaagttatttgagatattacatttgaatatgatttgatgtgctgtttgataaaagaacatcaatgggcaaaagaatcacttagtcaaaaataagttcttctgactaggacttatgacaactagggaagagtagtaaccaggcttttttctggaataagaactatggtgtccctctatgatgagcaagatcaggtcctccaaggagttatacatcgcaatactgactggtctgacaagtaaaagaccattcttagtacccccacagagcatgctgatggtatctcaatctttagaaggtttaaaggatgggatggcgccagaccttactttatatctctttcagggttttgtgccaacctatgaacaccaaaactcagcactattttatgcaaactatgcctgtagaccatatttaagagtatggaatgacttctctctggaaagagtttcctcgcctcatccccagtataacatgtcgaaaagaaataaggaagaagaaatccaggatgctagttttgaaaatgaaattttgttcccttcccaattttaaatgcaggtatactcattgtcttctcgaaatgacaaaaggaaaaaaaaaagaggaaagttacaattattcataaatctaccaataaaatgtaattactgttggtacatgaatgtattttcatacaatcaacacgtgtatacacgacatttaaatgtacttccttctagttttttattcatctatgttggatatgtggggtttatgtgtacattgatttagcagtgcacgtgatcagtggtttaaaggaggggatggctttgctgttagatcccagttataaagacttatcttgtttaatagtttgaaaccaaaatctatttcaattagagttggaataattaggaaatagtcttgatacttacgctaaattatccatttactaatccagaagatatattcatccctctagtagcttaaaaacccctttctttccctgctgtttacaacccttagcacttttcaattgtggcatgcttccatctctttcatcccccacctatatgctcagacacagaatgtgttcaggcaatttttaagttttgtaaatcattcccaatagtcccttaatccttcttgccacttttctctaaatccctttcagtcgatcagtagctacttggagggtatggcctgcgataacctgacacaggcttccaggacactgttagaggtgatcgccatcttcatgggcagtggggcagtcctttgtacatatgcagcctcacgtttgcctttattttcccggcttctgctccgtgatgcaatttcctgtccataaatggtgcagatctaattccctgaccaccatatagtaaaggtttactttgacatattgtccttcctaaaaagaaattttactgcacagttataattatcacatttttcttaattagcaacctcttctgatttctttttcatcttctagttttataaaacattttctttatcttattttaacccaacttactgaattctatgactattttcttagttccttttttttgtacttgataagatctctgagctactctttactgcttagatttttcaagtatatggtattatatcttgattttggtgtaatctcagaactccagctattcttccagtctatgggtagaataattatgtcattagagacattggagcctgcctctcccatgacggccagctggcaggggatatatattatatgtcttggttgatggctttcaagtaaaagggtgaatctgcgaagaccagtactccttgccaacaagctctttataaaatcaactatttcattttgccgcctgagctctcctttggccgttagattgaacaatcactggatgtttcctaaatttgtcatcaccccaaacggagactctgtaatattaagtaataactccttattctcctcttctaccagtccctggtaacttcaattctactttctgtctctatgaatttggctgttctagctatttcctataagtggaatcattcaatatttgtcatcttgtgtctgactaattttatttagcataatgttttttaaggttcatctgtgttgtagcatgtatcagaactttgttcctctttaacactgaataatattccattgtatggctataccgtactttgtttttccattcattagatgatggacactagggttattttcaccttttgcctattaaaaataatgctgcgatgaacactggtgttcccattcattttgtaaagtaaccccctcttttttcttccttctcagccacatggcagcacttgagtctccaactctcatatccatggaggccgtgctacttccagccgttcccacctccacacacaaaagtaaaatagaaatttctttataagggagaaaagaagctattaattgccctaattgtatttctttgtttaaaaattatatatgtttttgaaaaatatagaaaaaataagagaggggaagtgttcccatactcctaccactttggtgtaagtaatgatataattttggtttatttctgtcagtttttttgcattgcattctttttcagacctaaatgtgagcatgttatggttcagaagtctaagtctgtttttgtttttgttttgctgaaattaaaatagccattaagatttcctttggtcagtgtttgccttttatatcttttttcatcctataattttcagtctttctgtgtacttatatttcatatatgtccaagtctgctcctaatatttgcagagcctgaggcaagagtacaaatagaggcccacatgcattctaattgctttattcagtaattatatcttcatttaggaaagattttcaaattacaaaggcctcatctgaccgattccagttacaaattagatcagaataattctcttgctcatttttattattttggctagtaattaaatcctcattaaatataaaatgtgttgtttgaaaattttttatgatgaatgcttgacagagatttacccactttcattatttctagtttttaaaaatgtcagtagactgcttatttgtgtattttatttttttggcttttttcctcctaagattttttttcataggttctcttttatcataatctcaaattcttctcattctatttcccctcccaccatacacactgtgaagcagtgactagctccttcttagctgcggtaaaacctgcaaatctttacggcatttgaacacagtgaccatttgtttcaaggatttagggcaaggaaatgtggagaagtactttttctggaatgtgaatggtattagacacaaccgtggatgtttaggattatagatcatgctgtgacagaatgacaaaggtgtcaatgtggtctttaatataatttgtgtgttggtggtatgatgtgccatttaaagcagcgcttctcaaacattaatggtacatatgcatcacccggagaagcttcttaaaatgcagattctgaatctttagatctcggatggggcctaacagtcagcatttctaacaggtgcctgagtgatgctgttgctgttggtccgagatccatctcttgagttgtaagactctgaagcataggaccaagatcaggggtctctctcatctgatattaagagtagtactctgtatgtcctatatgaatacactatagctggaattgatttttaatttgaaattataatcatcgccttttaagagtcatgtttagtttatttacatttattgtaattttctaagttattgatatattgggattttttccctattatttaaacactggctttgcattttatgcattctgtgctttgggcttttttttaaaactctccttttcccctggaccattttttccccttcttcttattccatttttagcctgtattagtttaaaaattaaatgcttgatttctattctttcaatgtcattcttaaaattttaacatgtatattaccaaagtcctaaatgaattaatttatttttaaatggcaaataaaaatcgtatatatttattgtgtacagcatgatgttttggtatatgcatacattatggaatggctaaatcaaggttaattaacatatgtattgcctcacatacttatctttttttgtggtgagagcacttaaaatctactctgttagcaatttttaaaatacaaaatattgtgattaactataatcactgtgatgtacaataggtctcttgaatttattcctcctgtctaattgaaattttgtatcccttgaccaacatcttcccagtcacacccccatccctctggtaaccatcattctactctagttgtatgagttcaatttttttagattccatttataagtgatttaattaatatctttatcctctttccagataattcaaggaccttagcattttaactctagtcaactgtaatattacattccatcgtattgcagtattttagtcttcttctattaagccttccaaattggatattagcattattgtggttgtttcacattagcattattgtggttgtttcagatagtcaatattgatgcagatttacctgaatattacccatgattaccatcattccttctttctacttagatttccatcatccttcttcttgaaatataatttttaaaaggtccattgaagaagttctgttgatggtaaatacagttttactttctttgaaaatatctttattttgcccacatcagttattttattgttcagtattaagaaaacctaattcctgtgttttcttcccatcattgttgatattgagttgtgtgccatcaggcaaatgtcattactttttagatattctaaactgttgtttctttaagtaagtacattgtctccccttaatctgttctcttcgtaatgttttatttatttgtctcactataatgaattctggacagtttcttctggtctttctttcagtttgctaattctctattcagctgtatctaatctgctatttaattcatccatcaagtattttttccttagtattttgttttaataattttatttactatttctagatttttttctaatcatcctggtctttgtcatagtatcttcttctttatatacattttatttatgtatctgataacattaataacttaaacctttgtaagttataagtatgtttttagtttttgtgctgattttgttcaaataaacatattttgtatgtgtgttgtttgtgttcttgcagatgtgtatgtttatcatcactctacactcatctggactatatctttgggaattcttcatgtcctatattgaaaatccacttcttcaaagaaagattacatttgcttttgccaagcccctagaagccctacaaactagaactaaagctttactaaaataagcctagaccttctgcacacatgccaatagtatgaatgcaaatcacaaatctacatcatttttatgaattctaaacttttatgaagcagagaattttttttattcttcttcacccagaaccaaggacaaaacagacaagttttcttttacgttccctatgcttgctggattttctctttctagtttactcattccttagggtcatggtttttcaggtcttccctcattgcttagggtcaagactgtgccccttgtccctccacatggttgttgaaatgcaaagctttaggttaaaggatcagcagttacccttagagcagccactgtctgcaatgcccattcattatgctagatttttacttcagtttttttttttttgagctctgtggagttcttttacttaactgttaacttgcttaataaaaacagatttaagaaacattttgaatgtttaaataccagcttttcttggtattctataatgtgagtgcttgtatcaattacaaattttaaaatattatttgtaaattaagtggttactatggttaatttagaaatgcagaaaaatagaagaataaaaaattttagaattttgtaaactagagatagcataaccattataaacatgttagaatttaagatttttttcatatacatttttacataaatgagattacactacatttatcgatttgagcataagatattctcaagtgagaaagtgaatgattatattgagaggttggcagcaaataacatcaagtctttccaaatgaaaacctcaattctcatatcattaaatataaatttttcaatgtagtaattattcatcatgtatatttttaacaataaaacttctatttgtggaagtacaagtttgtgtaggggacacatgttttcacttctcttgggtatatacctaggagtagaattgctgtatcatatggtaacctgagtcttagccttttaaggaacagcaaaatggttttccaaaaggctgtaccattttacagtcccaccagtaagaagaggagagtaggacacagagaccacgtgaagacactttgccaacacatgttatcatctctctttttaaatcttagccatcctatcaggtataaagtagtatctccttgtagtttgaatttgcatttatttaatgaagcatgatgttaaacatgtttttatgtgcttattgtctatttgtatatctttcctggattatgtctattcagattcttggcccatttttattggattgtttttatttttgagttgtgtttttaatatattctggatacaagttcatataaaatacatgatttgcaaattattttctcccattctgtgggctgtcttttcactttattgatggtgttctttgaagcacagaagtttttaattttgatgatgctaatttatctatttttgtctcacttatacttttggtgtcttatctaagaaactgtcatctaatccaagatcatgaagaattattcctatgttttcttctaagagttttgtagttttcgcttttacatttaggtctatgactcagtttgaattaattgtatacatgatgtgacagagaggtccagcttcatctctggcatgtagatatccagttgtccaagcataatttgttgaaaaaactctgctttcccctattcaattgtcttggcatttttataaaaaataaaccgcatatctatgtattttaaattcagttatatatactgtcactagccataccaggcatcatatgtacttacaagcttaagactagcatggaaatgattatcacgggccatggcaaagaataatgatctgctatttccaaagattctgtgaagatgactgtgcagccgagaatttatttggtttatagagactaaaattccgtctgctttgttcactattgagttagtagctaaacagttgtaaaatttctcaagtctctcagagctcacacttgcaggaagcttgatttcacaacttgtacatgacagtctcacataaaagtactctcgtgagagtgttactatggacagaaaaaaagactatacctcttttatgactgctgttgttatttagggcttcttttttcttgatgttgtttcaaaaggttgcattttgcaataagcagcaacaccttaagatagatcttaaacagaaccatgtttaaggcttttttttctcccctttagtcacagtgattttccatttgccctggaaggcattcagcattacttgtaaacagcaaagataaatgtggcttctgatattcatctttatgaatagtccatatgtttataaataggaatagaacaaaaagcactgtcccaaactttcctttaaattctaaacatctaaatgtattttaaatattccaccccaattaatctcacttttaaataaaacattgcatgtctaaggtggaaaaacaaaagactcttcgacaatgccacacaactgcatatgtttgaaaatagggtggtcacttttaattgatatagaggaaatttgggaaagaagaaaagtaatcaactttcctatatctggagtcctttaaccaataaacagacaaaccaacataaagcacacatggtaagctcagcacacataactgaatttctctttttacgtttttgcacctcagcctgtccaattgtgcaaagaaggggaggaggattaaatatgcaactgagtagccagggcctctagctgctggtagttcctcaaagctgtacatccctccctcaccataacttgtttgttctctccagcaaataccatttactagggtgcccagattcacctctgtaggcccaagactgtgaggttcctagacaacaggattttgctctgaatatcatccatatatgcactctttaatttaaccccgtcttggcaggcataaggagtagcacaatgaaaaaatgtagatcctgcccccaacaactgtgtaagcttaggagaccagcactcagaagaaattttagcatagagtaagtgcacagtaaaagtttgttaataaggaaggaaagaaagaggaagggtgtgcaggagggaggaaggacaaatttggatttcatatgtcataccagagaaagatggaagcagcatattgagatatagaagtggtgtaaaagacaagaagaaatcagtttaagaaggcataggaaccagaagtggaaaattagggtataaaacttaagtgtctttggagacaaactggatttgaatcttagatttgccatttgctggcagtgattttgggcaatttacttaattatatttgatcttcaatccgctgtataatgtgtaaggagtaactatccacgtcattggaattattaggaggatttaataagataataagttttaccaatttagcacaattcccagcacataggaaggactcaggaaatattagccatcaatagaagacactatctattcatttatttacttttatttacttatttatttatttttgagacagaggctcactccgtcacccaggctagattgcagtggcgcgatctcggctcactgcaacctctgcctcccgggttcaagcgattctcctgcctcagcctcctgagtagctgggactacaggtgcgtgccaccaaatccggctaatttttgcattttttgtagagacagggtttcaccatattggtcaggctggtcttgaactcctgacctcgtgatccacccaccttggcctcccaaagtgctggtattacaggaatgagccaccgcgcccagcctagaagagacgctcttgatattcaggttttctttaaccctgagatgtggccatggcacacaaatgtaaacattttcaaatcagtcccaggtggtaggcttctagatttttgttttttacctttgaaatcggttcaagacaatgccattatggaaagcctctgcagaagaaactatttttattgtaccaattgcctttctaaaatctgtcaaatcttttaagtttctcccttgacctttttggaagcttaaacaggaactgaatcatcataaaatttttgaaatttgccttgaatctactttggagctgcatgaattgagatctcttggtaactgaccttgtgttgacccagataggcctgttgcagtgtacggcatgtacaccgcacacctgccaccacccctgtggcagcaatgtttgcgagcctgaagagttttgtgtggggagttatgacagaagtcagccaagtgtaggtaatgatgtcaggtagcatgggaggttggagcgcaggaagaggcaggggggggatctttaagcaaggaacccttgtatccagctgtgccaaatgggccttccctgaggacttgataggcaccctattgccacttgtaactcagcaattgaggtcacagtcaaagaaaaaaacctttatttttcacaatgtcatctttcagcagtacagcttcataagtgaagatggtgatgttccaacagttcatctaaactctttaaaatcctaccaaatacgttgcaggtggtgggtatgtagtaaaagtggataggaggagggtaagtattgaaatctgtttgagatatgaaattacatgagtaaggtttggggttttcaccacaatttcactcgcgtccatgtgaagagaccaccaaacaggtttgtgtgagcaataaagctgtttatttcacctgggtgcaggtgggctgagtccgaaaacagtcagtgaagggagataaggatggggccattttataggatttgggtagataaaggaaaattatagtcaaaggggggttattctctggcgggcagagtgggggtcacaaggtgctcagtaggggagcttttgagccaggatgagccaggagaaggaatttcacaagacagtgtcatcagttaaggcaggaacaggccattttcacttcttttgtggtggaatgtcatcagttaaggcaggaaccggccatctggatgtgtacgtgcaggtcacaagggatatgatggcttagcttgggctcagaggcctgacattcctgtcttcttatattaataagaaaaataaaatgaaatagtggtaaagtgttggggtggtgaaaattttgggggggtgatatggagagagaatgggcgatgtttctcagggctgcttcaagtgggattaggggcggcgtgggaacctagagtgggagagattaagctgaaggaagattttgtggtaaggggtgatattgtggggttgttagaagaaatatttgttgtgtagaattattggtgatggcctggatatggttttgtatgaattgaaaaactaaatggaataacagaaggagaaaaacaggtataaaaggtctaagaattgggaggacccaggacatcagattagagagtgcctaaggagattcagcatagtcctgccagcaaagattatttatttacttcaagagttaagagtggcagtttggggatagcaccaggagatatcagctgtgatggcttggagaaacagtgtaaactggcagtgtaaacaagagcagggcatgtatgagtagttgagaacggtgaataggagtatgactagacagaagatagtagggatgacaagttttttgggggcacagtctaagttggtctggcgtctggaatgagactggggcctaataaaaaggaccgtctgtacaggagctcaaatgggctgtacgctgtagcattctgaggacaggtctgacttctgagaagggaaagtggtaaaagtatcatccagtcctttttaagttggtggctgagcttggtgtggtgtgtttttaaaagacctttagtccgttctacttttcctgaaggcagaggactgtaagggatataaagctttcactgaatactaagagcctgaaaaactgcttggctgatttgactaataaaggctgatctgttatcagactgtatagacatgggaaggctaaactgaggaattgtgtctgacagaagggaagaaatgactatggtggccttctcagaccctgtaggaaaggcctctacctatccagtgaaattgtctacctagactaagcggtattttagttatctgacatggggaatgttgagtaaagctaatttgccagtcctgggttggggtaaatcctcgagcttgatgtgtagggaagggaggaggcctgaataatccctgaggagtagtagaatagcagatggaacactgagaagttatttccttgaggatagatttccacgatggaaagaatatgagaggttctaagaggcgggctagtggcttgtactatagcatagcctgcctttggtggtgtgtggcgattaggcctggtggaactgccatcaataaatcaagcgtgatcagggtgaggaacaggaaagaaggaaacatggggaaatgaggtggatcagagagatacagtcatgggggtcaggtgtggtatcaggaataatgtgggaggccagattgaagtccgggccaggaacaatggtaattgtcggacttaaagagtgagtacagctgaaggagccgggagcagaaagtatatgcatcaggtatgaggaagaaaatagattttggaagttatgagaaatgtagagagtgtgttgagcatagtttgtgatttttagggcctctaaaagtattaaagcagtggcagccactgcatgcagacatgagggctaggctaaaacagtaaggtcaagttgtttggacagaaaggctacagggtgcagtcctggctcttgtataagaattctgaccgcactaaccatgcctaggaaggaaaggagttgttgttttgtaagggattgaggtttagggattaatcagacacgatcagtagggagagcacatgtgtttttatgagaattatgccgagataggtaacagatgaggaagaaatttgggcttgactgaagtaatgggggctgcctgtgaagctttgcggcagtacagcctaggtaatttgctgagcttgatgggtgtcagggtcagtccaggtgaaagcaaagaaaggctgggatgaagggtgcaaaggaatagtaaagaaagcaggtttgagatctggaacagaataatggattgtggagggaggtattgaggataggagagtatatgggtttagcaccatggggtggataggcaaaacaatttggttgataagtcatagatcctgaactaacttgtaaggcttgtctggttttagacagataaaatgggggaattgtaaggagagtttataggctttaaaaggccatgctgtagcaggtgagtgataacaggctttaaccctttcaaagcatgctgtgggatgggatattggcattaatcggggtaaaggtggttaggttttaatgagatggtaaggagtgtgtgatcagtcgccaaggagggagtagaggtatcttatacttgtgggttaaggtggggggatacaagaggaggactcaaaggaggctttggattgggaagaagggcggcagtaagatgtagctgtaatccaggaatagtcagggaagcagataatttagttaaagtgtctctgcctaataagggaactgggcaggtggggataactaaaaaggagtgcttaaaagagtattgtctaagttggcaccagagttgggaagttttaagaggtttagaagcctggccgtcaatacccacaacagttatagaggcaagggaaacaggcctttgaaaagaaggtaatgtggagtgggtagcctccatattgattaagaagaggacggacttactttccactgtgagagttactcaaagctcggcgtccatgatggtctacggggcttccgaggcaatcggacagagtcagtcttcagccgctaagctaagaagatctgggaaggagtcagtcagagagccttgggccagagttccaggggctctgggagtggctgccaggtgagttgaacagtctgattttcagtggggtctcacacagatgggatacggcttaggaggaatcctgggctgtgggtgttcctcggcccagtggccagatttccagcacttgtagcaagctcctgggggaggaggttctggaggaacccctggcagctgcggttcaggcctttggagttcttgtgtgctggagatgtggctggggtttgtctcacagtggaggcaaggaattgcaactcagaaatacattgctacttggctgcctctactctattattgtacaccttgaagttgaggttaattaagtcctgttgtggggtttgagggccagaatttaatttttggagttttatttaatgtcaggagcagattgggtaataaaacgtatattgagaataagatggccttttgaccttttagggtctagggctgtaaagagtctcagggttgctgccgaacgagccatgaactgggctgggtttttcatatttgatgaaacagcctaaacgctactgatttgggagaggtcagataaagaaaaaggagcattaaccttgactatgcctttagcttcagccacctttttaagaggaaattgctgggcaggttggggagggctagtcacggaatgaaactgtaaaccggactgggtgtgaggaggggagttgataaaaagattataggttggaggagcggagcctgaggaagaattcggacctagctcggcctggcgaggaagggagaggtcagatgggtctgtagaaaaggtagattagaaagactcagtgacacttggggttgggactgaggggacaggtgggagggaaacaaggaagatttgggatgagttgcattgggaacagagactagggagggactgatgtgtaaaagaatgcctggacatcaggcacctcagaccgtttgcctattttatgacaaaaattatttagaacttgtagggtggaaaaattgaaagtgccattttctggctatttggaactactgtcgagtttgtattggggtcaagcggcattgcagaagaaaataagatggttaaattttaggtcaggtgagagttgaagaggttttaagttcttaagaacacaggctaagggagaagaaggaggaatggaaggtgaaagcttgcccatagtgaaggaggcaagcccagagaaaagacagtagagacacagagaaggggtgggggtttcttgccctccagaaaagcagagaaggggtcggggtgtggaaataaggggttggggcacagagataagaggtcagggcatggaaataagggatcggggcacagagataagaggtcggggcacagaaataacggatgggggcacagagacaagaggttggggttcctgcccctcccccagaaaagcgggacttgccgctaagggtgaaggaccaaggcaggcgtccctgcgtggtctgacaccactgaaacctgggtgaataatcagagaggcatccttgcaatgattaaacaccaagggacggctgccttccctagtccgtgactggtgccggagttttgggtccacagataaaagtgtctcctttgtctctaccagaaaatgaaaggaattgaaattaagagaagggagagattgaagtgtggcgccaagattgaaagaagaaagacgttgagggatagtgagagaggttggagaagagagtaaaaaaggctgcttattggatttaaaattggtgagatgttccttgggctggttggtcggaggaccagaggttgtaggtggatctttctcatggagcaaaatgcaggaggacaggggattgatctcccaagggaggtcccccgatccaagtcacggcaccaaatttcactcgtgtctgtgtgaagagaccaccaaacaggctttgtgtgagcaatacagctgtttatttcacctgggtgcaggtgggctgagtctgaaaagagagtcagcgaagggagataagggtggggctgttttataggatttgggtagataaaggaaaattacagtcaaaggggggttgttctctggtgggcagagtggaggtcacaaggtgctcagtaggggagattttgagccaggatgagccaggagaaggaatttcacaagacaatgtcatcagttaaggcaggaacaggccattttcacttcttttgtggtggaatgtcatcagttaaggcaggaatcggccatctggatgtgtacgtgcaggtcacaggggatatgatggcttagattgggctcagaggcctgacattatcattcataataaccagaactttatattcttaactacaattattaaagattttataggttacaatacactgggatatacctttctcaaagaaacatttaatgttatcccagaattaaaatatacttttgcaaaataaaatgtttatcaagtctgccaaaaagagagccaattattttggtttctctctaggattttaataaattcctttgatacctagtcaaagcagttgagcatcctcacattgaacaaaatgaaagcaaggaagcgatcaatctcatttgaaaagtgaacaaacataaaaatcattatcttttaaaatttttcatttttacatgttgcaaagaagaataacctttcttatgtttcttgcatgtttcttatttcctcagtaattaaaaaatcatatttagatacatttattactagtgaatgctttttcatagttttaatcacattgatttgttgagaattatcagaaaacataattattcagataaggaattgtgaacagtcttatggattaatacgttctcagaacatcagtgttttagcaaataagatattatttacagtgagcacattgttagcctcactagatgtcagtgtagttctaagtaaatattttatatagttcctcagtagtgttgaatgagaagatgttttgctttagaacttaaagattgagaagatggaatagttgcaataagtgtttgtggtacattaattccaacatcctcctctgatgaaaacacataattggtaaatttatacacatcaacacagggccaaaaaatagtccaaggatgtaaataattatggattcataggatacattgtgcttccttagtcaccaatgtattttccgtacattgaaaagtcttactgtacatcacaacatgctggtcagccttttagggcttttcccaattgcaaagggagcatggttactcctcctgccatgagagggcagcactgagattgtctccagcccaggaagcagtgggcactgtttagtatgggttagcacctaggtttttatgtggaagcattcaagtcaggctgtggtgatatatgttctcagagtctaccatagtatcattttagtgcttttattacaagtcatcaaacactgtatctgagaaacatgaggataaattatggtacattcaaaaactgctgataaatagcaaagaagagaacagggtactttgggaatataaggccttttgcgtgagaaatgttttgtgctagctatgagtgaattttctacaagcagagaagttccatttggtcctctgaactggttaacattttcttgattctttgcttagtgtagcaaataaaattctgtttattctttttgagagttcccaaaatatctttattgatttggattttgctttttcactttattttatagttgattttaagtttttcttgagtgtgttcatcagatagccatataaaatggaacaatgcatttgtaataacaaatattatacatgatatttttttggccagcccagttgcacagtcaactgagaaagtggaagttatcactttcctcttaattccttttacatatttttcctctggatgagaaaatgttactttctcatatccagaaaagtgttataaaatgatacattgagatcatctgattccctctttattgtgattgtttctttaaaagaaaaaaaagcagaaaggggccatgaacttacaaagaaagttttaaagaatacaccaaaaattgttaaaacaataaatgagttcatcaaggctgcagggcacaagatcaatacacaaaaattaattatatttttatatacttgaaataaatgatctgaaaatgaaggaaacaattctgtttacaatagcatctaaaagaataaaatatttaagaataactataacaaaagaagtgtaaaactaatactctgagaactataaaacattactgaaataaattacagaagatctacataagtagaaaaacagcccatgttcatggacaagaagattttaatcttgttaagataatagtgctcctcaaatagatctaaagattcagtacaatctctgttgcaactgggattctctaggccagttgacttctttgtacaaattgatgagctgatcccaaaattcatatggaattgcaggggactcagaatagccaaaacaatctttaaaaagaagaataagttgaaggcctttcaaatttcataacttcccaatttcaaaacttacaataaagtgacgataatcaaacatatgttactaacatagggataaacatatagattagtgggatagaattgagagtctacaaataaatctatatgtctttggtcacccgaatttaacaagggcaccatggttattcaataaagaatattttttaaacaaatggtgctaggatgattgtatatccacatgtaaaacaatgaaattgggcccttacctcacacaatatagaaaaattaactcaaagcagatcaaagatgtaaatctaagatgtatgtacatataaatctattaaactcctagaagaaaactcagggataaatctgcaggacctcagatttgccaacgaattcttaggtgtaattcccaaaacatgagcaacaacaacaacaaaaaattggttttcaccaaaattaaaattttctgtgcttcaaaggatgctatcaagaagtaaaaaaacaacccatggaataagagaaaatattttcaaattatatatcccctttggaacttgtatccagaatatgtaaagacccatacaactcaataataaaacaaattaacccaattttaaaatgggcaaagaatctcaatagacgtatctccatagaaggcatacaaatagacaaagcacacggaaagattctcaacatcattagccatcaaagaaatgcaaatcaaaatcacaaggaaataactcttcacaccccgtaggatggctgtattgaaaaaaatataacaacaacttttgtcaaatgtggaaagaaattagatctctcatacattgctggtgaaaatgtaaaatgatgctgtcactttggaaaatggactggcagttcctcaaattgtgacacatagagttacatgtgtcccagcagttctactcctaggtatatgccaatataaatgaaaatatctagctacaaaaaacttgtacacaaaggcattattcataacagcattattcataacaatcataaggtagaaacctaaatgtctgttaactgttgaatagataaacaaaatgtggcataaaatatggcgtatccatacaattaaatgttatttggccataagaagcaatgaaaatacagcagttagtgatagatgctacaataagaaggaaacttgaaaccatgaaactattaagctaagttaaataagacagccacaaaggaccacatactatataatcccatttatatgagatgtccagaataagcaaatccatacaaacagaaagtagattagtgattgctcagggctgggggtgatgggtgggtaggagagtgatagctaaagggcagaaatgttctgaaattgactgtgggggtggtttcacatatctctgagtaaattaaaaccatccaattccgtgaatttagtgggtgaattcacatagctgtgaattttatctaaattgtgaaaataaaacaggaatgtgatgctctaaccagcataggcccaggccgcatgcttctggggaagaaattccacctgaatacttgggctgtaaataggtcattttcatgggaaaaggatgaatagatgccagatggtaagaagggtgaaagtctactacacatgtctgcgaggtcggtaagggatctggtctttgcaaaggaaggttatattagagctcagttgagaagagaaagggaaagggactcaaattcatgcttaagggtgctgtgacaggtatccatacctttattaaaagacatgtacaggaacgttcatagcaacacagtttattagccccaaatatccatcaatatttgaacaaataaattgtggtatattcaaaatggaataccatatggcaacaagaatgaccaaactacaaaagcatacaatatgaatgaatcccataaacctaatattgaatgaaaagagttattcagacagatgtagtgcctcaggcttgtaattcagcaccttgggaggctgaagcgagtggatcacttgaggtcaggagttcgagaccagcctggccaacatggcgaaaccccatctgtaccaaaaatacaaaaattagccaggcaggatggcatatgcctgtaatcccagctacttgggaggctgaggcaggggaatcacttgaacctgggaggcagaggttgcagtaagctgagattgtgccactgcatgccagcctgggcaacagagtgagactgtctcaaaaaaaaaaagaaaagagtcattaacagacagacaaacaatatgattccatttacataaagttcaaaaataggctaaatgaatctatgctgtaggaagacagattagtatatatccttgtggggggctgtgaatggatgagtacaggagaggaatgactttggggtgttgacagtgttctgtttcttgatcagggtgctgtttatatgaggtgttcactttatgaaaattctttcagttgtgcacttgttatttactcaccattctctatgtaagttagattgtgacaaaagcgaaattaaaaagaaactaaatacccttgttgttgtttactttccctaaagatagagagcacatcgtgtttatttctaatgcttattcaaaggggtagagactctgagaaaggatgaggtggcgggataactacttacaagagtcacagttacggggctattatttcctgggcatggaaagagtagatcccttccagcctagccatttcattcttattgtcttggaagcaaactgtccagctgttcttcttaacgtcaggttaacaatgattgtggtcattccctgctgcatgggtcaggctgtgagacaccctccccttaaatttacatagagacagaaggtatagacaggtgcaaatgggaagggaacagcgtatttctccactgtgtgcttatgtccaaattggaaaccagccttattcttgctcactaattattaaggaaaataatttttaactatcaggacactgttcttcaaatggtgattgggtgaaggagattttctttgagttctgtgaaatactaaaaattctatgtgttgataatgactaaaaatatattttccacttgtaaagacaaaacttctgtattgcaaagttattttaatagaataaaatcttagtttcttgagtcagtcttttgcaaatagggttccatgtataaactatcaagaaaatatttccaataaatgcactggggtaggtttagatttatttgacatatacaggaatatttgagggaagggagcaataaattcatctctttaatttgctgcaggctttccttagagggagcgcttttttagctggtgttaagatggagaaaggtgccttctatcgtgctgttgctgaattccctgctccagaaacatgcagaacattagcatgacccaactgcttgaaagcaaacaagatgctcttgtcttaaaaagcatcatttcggaggaagaaaagccataatgaaccctccctttttctttttcttaactgaggagtagcaaatggtatttaagctgttatctggcaacaaaagtttcaagtaatgttttttaaaaaagcctgccaacacttctttctgctgggcactgatatagctgagttaaaggccctttcgagatggagaatatgacaagaaaagttgcacacccctaaccaaagtgggctttccaagagctagaataaagccacttcattaaggtttctcacactggtgttttttggcagcatttttcaaggatcatttcctccatgggggaaatgaagtggcagtgtctttcctaactattgctaaaggtgaagtaagaatttgaattgagaaaggcagttaaaatagtatctgaacttttgaacttcctgatcagataattattcttgaaactctgtataagatggaaaagagaattaatgcctcttaaagtgtttaattttagaggactatcattattaaatagtactccttctataattttttgattgttgagtacaggcatgacaagaatttataaagatacttctgattgataacatagggtataaacagaaagttctcttaaataggaaggtgtatatgtttggaaattggacttgtctcttttgcttagacgtgtgtataaattaatgcaagatatttgtctatatctcaactccgggtctccctcctgcatatccaactacttactagacacattcccttgaatgccccgtaggtactttatttcaacatattcaaaataaaactcatcatctcagccttctcctgctcacccaccttggccctttactactgtttcctcattcttttttctattaatcatcgttaagccagtttccaaaatcaggcatctaggtatcaaccttggattctgccatcactgatgccacataccctaataggccacttctggtaaatttcctaaatccactcactttcagcaacccactattgcccatctacaggggaccactatcattctaccacttgactctttcaacattctgctaacaagccttcttgtagcccttcactcttttgcctccttcaagccatcaccacgagagggatccaagactcaactctccttttttttcatttctataccaaaaccattctttgggtttctgttcttaggatgaactcctcaacatggtgtgtaagattctatatactctgatcttgaccctgcttactactctcgctgatgtgaagcctcctgttcctattatctctgagaacacccaaccctgcttggtggcagcaagggacagaaaaagcacttgaggcagcaggctgtcagatttgctaatagtgcaacccaactcataaaaaccaccaagtccaagacaaggcctctttttgtgaagtaacaataacaagtagaacagacatttagtcagttttcactggctgtaactgtactagtgagagaaagccctgctccacagtttcttgcatcactacactctgggaagccccagtactttaccatgcaagtgtagccccacatcatctcactctttgccgtgagtttaaattcctccaactctatccaagggtccacgttcccctatccctggatgccatgtgtttcattgacatgagttttcctcctattaagcatggaggggtcttataagtggcgctgtgaggacagatgcttgcactttgtcttgacctctgcttcagcaagtgtattgtagctacatccttagctcactttggttttagtctcaagatcatcccagtcccctcctctatatttggttcatggtttcatatactgttaaccaggaatgctaaaaatattaatttggtgcattatatttatgcgaacacttgagatgtttcaagcatgcaggaccacctgcagaatctctggaagggtttatttcctatgcacacaattagcccaaaatctttttaatacaatagatttttttatgatactatttgttacttaccttttaccattttccttatcccacctatggctccaagcagactaaatttctctcaggttcttatttttgttgtgctctctgtcttagtattttcaggctgctataacaaaatataccatgaactgagtggcttataaacaatagaaatgtatgtctcacagttctggaggctgggaagtccaagatcaaggcagtggcagatttgatgtcaggtgaagacctgtttcctggttcatggatgggggcttctcactatgtcctcacatagtggaaggggcaaagcagctctctggagcctctttcattcataagggtactaatcccattcacgaggactctgccattacaacccaatcacctcccaaaggcctcacctcataaccttatcacatgggtgattaggtttcaatatgtggatctgagggggacaaaacattcagatcacagcagtttctttcaagacttttacacacaggttgcctccagatcacaaggctcttacccctcttttgttcttggctactttataacatccacttagacctcacttccttcaggacacctaggttagacctttgcctgtgtgcttccctagcaccttccactcccttcacatagcacctaacacactctgttgggtttctctgaggtatgtaagctctgtaaccgcagggttcctgtctttcttgttcatccttgcatcttcaaagcctgccgcattacctggcccagagcaagtacttaatgatcatttgttaatgaatgaataaatagatttttccattaatcatctaatcagtgaatttacaattctatgcaattctttgatgctctaagaaattgaagttttattttctgaagttatatattagttttatttcctaaggaatttgatttatccttactttaaatcataactacccagtggttattatagctatgctgccatatggtaaaacacatgaagcatctaatattgccttaagaaagctgtttcacagtaaaaactcttcaggcccttctctcggcacttttcattttatgttgaaattattggtgtttgtatctctcttacctgtaagacattaggtgcctcaaaggcagtgaccatgtgttattcaactttgtatcctcacaaccttgtatctagtgcagtgttggaagtcagtaaatgtttatataaatgcttaagataggccagaatccacatcttggctcaaaaactgtataactgccaacacccatctctgtacttacactcccaaagcctcagtttctacatctgtaaaaatggggattctgctgtttaaaggatcatcttgcagggttgttatgaagtattacataaaatataatgtaaataaggaactcagcatagtgactgaaatataggaattatgaataagctaggatggggataaatctaagtttctttgtgaagacatatggtgtgtcaaaatgttaatttttcactgtcacaggctggcaagacacggtcttagatctagtaaaattgttgcaaaaagaaagcaaagaggcaaacttcccaacttttatattaagaatatttgtctgaaatataaaacaaagtgagaaattcaatgcaaataaaatacactacaggaaaatttatagagtgctcaaatggatgagttgcataatttgtcttatgaatatttactaaaagcaaaataaattggacaaataatattcttggactgtaaatcattgaaaatgatatatacagttggagaaaaggacaagaaaatcatagcaggacctactctttcctaattacaactccatagagttgtctatagtgtgcttgtttttcattaattttgtgattatccttcccttttctttgaaataacaataagaaaacaccaaggaaaaaggttctgtagtcataatatgcttaggaaagtcaagatgttaacattcacattctaggactgggaaacaaattttaaggaaaaataactttacccttaagccttaagcctcaggtctcccagtgtaacatgtttcaatttgctgagactaaggtgtttggctggattgtttgctgttgtctgatagagttcatcttaaagtagtttctattcttgtatgggtttgtctgacaattttcatatcatttagtgagaatttgtatttttttcaattgttgcctattcctctgtaattattgtaattgcatcttattatataatttgcgtaaatatatgcaatcatggaattagaaaacgcgggtggtgatatgcagtgtcacaactgcagtggttaaagatgtgtgatttttttaatctttgaaaaaaataaaagcgaagtaaatattgtaatttcaggggaaagcgttttagctgtctaaaactgattgcccagagaaatcaaccaaacatttttatttagacatagataagaggtttcatgtttttgactgttctaactcagagatttggaaatcttggttttaaaatatcagtttgatgactgctcaaacacttataaagtttcaatattaactttaaactataaaatactgaggatcgtatgcttctaatgataccttttctgtaggttgttatcaatgtgagtttgaataagcatttattaatactgtgaataagatgcatattatcaatattaacgtctgcatccatacagttggaggtatttatgttgatgtagacaaagacacagacagtggaaatttatatgcctttcaaaatcccagtgactataaaattctgctcctctgactatacattaggtaaatggtatatttaaataagtggtcaaggcaaaaaaaaaaagagcataattcaagttcagcacccactgcaattgtagatgataaaaatgaggcattcatcaagctaaccctttcgcctctagaatttcatgtgcactgagagaaaagtccattgatctacattcagctcttaaaaactgcacttgctgttagaagacagaacatacactcaggaaaaacttcaggctgatactgctaagattttaacacatttataaaacttcccatcaatacctaatttattgagagtttttagcatgaagtgttgttgaattttgtcaaaggccttttctgcatctattgagataatcatgtggtttttgtctttggttctgtttatatgctggattacatttattgatttgcgtatattgacccaggcttgcatcccagggatgaagcccacttgatcatggtggataagctttttgatgtgctgctggatttggtttgccagtattttattgaggatttttgcatcaatgttcatcaaggatattggtctaaaattctcttttttggttgtgtctctgcccggctttgctatcaggatgatgctggcctcataaaatgagttaggaaggattctctctttttctattgattggaatagtttcagaagaaatggtaccagttcctccttgtacctctggtagaattcggctgtgaatccatctggtcctggactctttttggttggtaagctattgattattgccacaatttcagatcctgttattggtctattcagagattcaacttcttcctggtttagtcttgggagagggtatgtgttgaggaatttatccatttcttctagattttctagtttatttgcatagaggtgtttgtagtattctctgatggtagtttgtattgctgtgggatcggtggtttgattgcgtctatttgattcttctctctttttttctttattagtcttgctagcggtctatcaattctgttgctcctttcaaaaaaccagctcctggattcattaattttttgaagggctttttacgtctctatttccttcagttctgctctgattttagtcatttcttgccttctgctagcttttgaatgtgttcgcccttgcttttctagttcttataattgtgatgttcaggtgtcaattttggatctttcctgctttctcttgtgggcagttagtgctataaatttccctctacacactgttttgaatgtgtcccagagattctggtatgttgtgtctttgttctcgttggtttcagagaacatctttatttctgccttcatttcgttatgtacccagtagtcattcaggagcaggttgttcagtttccatgtacttgagtggttttgagtgagtttcttaatcctgagttctagtttgattgcactgtggtctgagagacagtttgttataatttctgttcttttacatttgctgaggggagctttacttccaactatgtggtcaattttggaataggtatggtgtggtgctgaaaaaaatgtatattctgttgatttggggtggagagttctgtagatgtctattaggtctgcttggtgcagagctgagttcaattcctgggtatccttgttaactttctgtctcgttgatctgtctaatgttacagtggggtgttaaagtctcccattattattgtgtgggagtctaagtctctttgtaggtcactcaggacttgctttatgaatctgggtgttcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgctggtagatcttccatccttttattttgagcctatgtgtgtctgcacatgagatgggtttcctgaatacagcacactgatggctcttgactctttatccaatttgccagtctgtgtcttttaattggagcatttagtccatttacatttaaagttaatattgttatgtgtgaatttgatcctgtcattatgatgttagctggttattttgctcattagttgatgcagtttcttcctagtctccatggtctttacattttggcatgattttgcagcggctggtaccgtttgttcctttccatgtttagtgcctccttcaggagctcttttagggcaggcctggtggtgacaaaatctctcagcatttgcttgtctgtaaaggattttatttctccttcacttatgaagcttagtttggctggatatgaaattctgggttgaaaattcttttctttaagaatgttgaatattggcccccactctcttctggcttgtagagtttctgccaagagatctgctgttagtctgatgggcttctctttgtgggtaacccgacctttctctctggctgcccttaacattttttccttcatttcaactttggtgaatctgactattatgtgtcttggagttgctcttctcaaggagtatctttgtggcgttctctgtatttcctgaatctgaatgttggcctgccttgctagattcgggaagttctcctggataataccctgcagagtgttttccaacttggttccattctccccgtcactttcaggtaaaccaatcagatgcagatttggtcttttcacatagtctcatgtttcttggaggctttgttcatttcttcttattcttttttctctaaacttcccttctcgcttcatttcattcatttcatcttccatcactgataccatttcttccagttgatggcatcggctccaaacccacaggcaatatcatactgaatgggcaaaaactggaagcattccctttgaaaactggcacaagacagggatgccctctctcaccactccttttcaacatagtgttggaagttctggccagggcaattaggcaagagaaggaaacaaagggtattcaattaggaaaagaggaagtcaaattgtccctgtttgcagacgacatgattgtatatttagaaaaccccattgtctcagcccaaaatctccttaaactgataagcaacttcagcaaagtctcaggaaacaaaatcaatgtacaaaaatcacaagcattcttatacaccaataacagacagagagccaaatcatgagtgaactcccattcacaattgcttcaaagagaataaaatacttaggaatccaacttacaagggacatgaaggacctcttcaaggagaactacaaaccactgctcaatgaaatcaaagaggatacaaacaaatggaagaacattccatgctcatgggtaggaagaatcaatatcgtgaaaaatggccatactgcccaaggtaatttacagattcaatgccatccccatcaagctaccaatgactttcttcacagaattggaaaaaactactttaaagttcatgtggaaccaaaaaagagcccgcatcgccaagtcaatcctaagccaaaagaacaaagctggaggcatcacgctacctgacttcaaactctactacaaggctacagtaaccaaaacagcatggtactggtaccaaaacagagatatagatcaatggaacacaacagagccctcagaaataacactgcatatctacaactatctgatctttgacaaacctgagaaaaacaagcaatgcggaaaggattccctatttaataaatggtgctgggaaaacaggctagccatatgtagacagctgaaactggatcccttccttacaccttatacaaaaattaattcaagatggattaaagacttaaatgttagacctaaaaccataaaaaccctagaagaaaacctaggcattaccattcaggacataggcatgggcaaggacttcatgactaaaacaccaaaagcaatggcaacaaaagccaaaattgacaaatgggatctaattaaactcaagaacttctgcacagcaaaagaaactaccatcagagtgaacaggcaacctacaaaatgggagaaaatttttgcaacctactcatctgacaaagggctaatatccagaatctacaatgaactcaaacaaatttacaagaaaaaaacaaacaaccccatcaaaaagtgggcaaaggatatgaacagacacttctcaaaagaagacatttatgcagccaaaagacacatgaaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccatcgtggaagtcagtgtggcgattcctcagggatctagaactagaaataccatttgacccagccatcccattactgggtatatacccaaaggactataaatcatgctgccataaagacacatgcacacgtatgtttattgcggcactattcacaatagcaaagacttcgaaccaacccaaatgtccaatgatgatagactggattaagaaaatctggcatatatacaccatggaatactacgcagccataaaaaatgatgagttcctgtcctttgtagggacatggatgaaactggaaatcatcattctcagtaaactatcacaaggacaaaaaaccaaacaccgcatgttctcactcatagatgggaattgaacaatgagaacacatggacacaggaaggggaacatcgcactcgggggactgttgtggggtgaggggaggggggagggatagcattaggagatatacctaatgctaaatgacgagttaatgggtgctgcacaccagcatggcacatgtatacataggtaagtaacctgcacattgtgcacatgtacccaaaaacttaaagtacaataataataaattaaaaaaagaatgaaaaataacaaaaaaaaaacaaaaaaacaaaaaacttccttggataataataataataatttttttctatttgagaatttggaatgttaacagaaaacatgttttctaccaaaataaaggtaacagtgatctggccatctgcattttaaaaaaaaaaaactcattgaaatactcctgtagaatagattgctcacttttccttgcttttgtagttcatagtttttaggaaaaaagtatcttttacctttaaaccaagaagggtatccaaattttgattgaaagcactcctgtacctcggttctcttaagtgtttctgagacatgagtttgcaggtaggaagctggtacggatgacacaactgggacagactggactaagccagcctcatccagctacatgcagctgcttcgcctttgtctccaaaggactcatcccttgttccacattttgaaaacaaccatgcatttacaaagaaattctcaatcttcttgttttctctttaattctctttaaaggaaggaaaaaaattctgtatgccctattcaagtgctatacattggtcttagggactggaactgaaaacttttatgatcaaaaaattttctcctccagttgccattctgttctaaattttactttattttttgatgtaggaatgtttctttaaacatcaagattttagtttccagtagaaaactaatgaattattaaaggatgggaacttgaagcaatctttagtgcttaataaggagaaaccacaaggcttgaataaactgttccatatttctcttttaatgctccgtttaaaatctagacggtgtgtcataagccttttaaaaaaaaacgattgtgtttaccaatatagaatatgagatttttgtttctttttaggtatttttcttgcaattaggatatactttgatgttaccatggctatggcttcacgttccaaacaatgagttttttcttatgtttgattaaaccaaaataatgttagtataatttccctgtaaattattatttgttgacaatcagtgttaatgccactaaaaattgagtataaatatcaacaaagtacattggtaaatgattaacaggacaaatgaaaagaaaaatagaaattctaaatagaattgctatacttctccagaattcattcctcctagaataactccctcagggtgaatgaaaagtcaggtgggcaaagctgtgagctccacctccttcaactatacaaattttgatttggtaaaggaaattttgacctcattatttcaccctgctttgaaccaagtttttatgcacctactttattattgctctttgcatgtacattaaaacaaatattttattttgactttaacctagaatgagcactacagttataagcaattgacacaagataagtctaaaagaaccaaaaaaacatagagtaagattcgtgatagacaaaaagtgacttgctggcaatattaaacattgctaaactcaagcaacgaaaaattaggctaaatattgtcaacagtgtcaaaatgttctccattcataatctattattgatctacgataactaataaatctgtacactgtgattcatgtttttggaaaattgaactcccaacttacacacaatattccagttgcctctgaggaatgaggttataaataatttaaaattttgatgtcttgtttttctttaatagaaaatttattgcctaggtatagtagtgtattagggttctccaggaatcaaaaacaataggcattataaataaataaatatataaaaatatatatttatatttgtatgtgtgtatttattataaataattggcttatgtgattatgaggctaagaagtcctaagagctatagtctccaggctggagacccaggcaagccagtggtataagttctgatacaaaggctagtaggctgaagacccaagaagagtcttgaagtttttcagtttgagtccaaaggcaggaaaagacccatgtcccagctcaacagtcagtagtaggtgctccctcttactgggacttttggtgctattcaggtcttcaactgattggatggggcccactcacattagggagcagagtaagctttactcattctaccagttcagatggttgtctcatccagaaacacccagaataatgtttgaccaaatgtctgggcactccatggccaagtcaatttgacacataagttaactgtcccactaggtaacatatgaagaattgttttaaaaaaagttattcagctgggtagaaattaccatctgtctagaaaatagagttggagaagagaatgaagctgataatgtgcctgaaatcttttttctggcttctattccagtctgagagtcaggaaaagaagagatctctaataaaatgcttctaatgtttgggtcatttttaccacaacatcagtaatggaagagaaagtcaaaagaatgaggctccaggccaggcgcagtgactcacacctgtaatcccaacactttgggaggccaaggcaggcggatcacaaggtcaaaagattgagaccatcctggctaacatggtaaaaccccgtctctaataaaaatacaaaaattagctgggcatggtgccacatgcctgtagtctcagctactcaggaggctgaggcaggagaatcgcttgaaccccgggggcagagcttgcagtgagccgagatcacaccactgcactccagcctagtgacagagtgagactccatctcaaaaaaaaaaaaaaaaaaaaagaatgaggctccaagatgagcacctgagcaccaagcagtcctcatccttctcactgctttggagtttgccagatttgggtactttgatccctagggaataaacactccttagctggacagcaacacaaataactcttaaatgaactgcgtctgttacacacacacaggcacgcatagagtttcaatggggtttattgaaataaagtggcctctacactgaagaattgtaaggactgtattctatccatttcctgtttacttctccatttatttgtattcataggtaaggtttactagcacatcattaagatactgtaaaacagcattaaaatcctaccttttaatttcctcaggtaagcgcctctcttgtcttagcaatgcctcggttctcaggccttgtttatctttctctgtaattgtgagtgaggagctttctgaactggataactgcctctgattttaccccttcaaattcatcttccttgcagctgattgagtgatccctctgaagaacaaacatgattgattgaagaataaacgtgccctcccaacttaaacagcttccaggccgcctcagtaacgtgaggattgagggaaaatgcctcagcctggctcagacagtgcctcccgtcttgggctgcttggctcctctcttcccattcagccttgttactctccagaagtaccaagcagcttgtaggttttcaatgccccaaggaatgtgtgcgccattcttcacactgttcttgctcctagatggctccccacatgctgaaaacccccaccttcttcccttaatgggtttcgatttagtcttcaaggcatgtctcaggcatgttcttttcccaaaagttttctgacactccctctgttaaaggacaaggtgcctttcctctgtcttttggaggaaatttaccagtgatcacactgagcatatatccgatagtctcatctcctcagctataaagtctttggttttagaacctgtattaattcatcttaacatcccctgtgcctaacagagtctaagtgctgagtaaatgggggctgaactaagctaaattccaaagatcaagccaagagttcttagttacttgaaaaacaaacaaacaaacaaacttctgacctttcttcattataatcttggcaaatcagaattcctttgccctaaaataactgtaatcaaggagttgacgctaaagtgatgatgagaactgtagtatcactacactaatgaatcttttagccttgtacaagaaataatagaaaaatccataaccagtttcacagagaactgctaataaaaatcagaaaacactataaatacggcattaaaaaaggtaaaaagctgggctgaagcttaaagatggaaatatttgcagaaaactaaggcagtgagaaatgatgtcctgtatcatgttttgatgtgttatattcatctttctggtgatgactttatttcacatgtaaattaggaaaaagggaaaggaaagcatatccatatcattcatgtccagggaaggaaagtgaagtatcttagaacagcttctcaagtcagctctacatagctgggcttttgaagtgctggtgaattttttttaatctcgccttctacaaagaaataacaaagcttagaaatttaaaaatccaggctactgtcaattctgtgactttccatgaatcagtctcgttattctttgacatcttaaaagaaaacagccatatgactgataatctttggtgaatttcagatgcatgtgccatagaaactgtgaagaaatttaaatcttaaagtactgatctttgggcttcttaaaaaaccttccagttcagatataatgtctgacactaaataatcaacttatctactttactaaaaatggccagtaccccaaactaacactgtaagtttacccagttgggaattttaaattgtggcttactctgagtgcttcatagaagttcccactcttacctccttctgaaaagttttttatgcatagtcacatgctgtgtacctgcattaccttctaatactggtcacattgcattgaatcagggaacaatggctggcccaaagtcagcctgtgggctaatcttataagtagatatggccaatctggcatttatactggagagtaactgacaagccaatcagatactctcttgaagagtttgaatatggaaacacaaataatagagtaatgcccaagcccccaaacagaaaacatatggtggaaagtagaatagagagctcaaggtgggttgctgtagtgtaaaccatcatttagtcatacttaaggtacggtcatgagaataggaaatagccataatgaatgagaagtgaactgctaatggcagagaatgtagactacctgcttgagagatttggtgaaggaaagcaataaagtaatattttagtgggaattatgcctgagagactttatttagagtagactggtagtaggaacaaatttagagtctaaggcatagcttgaagatgaaagaaaaaagaaagttacaaatgtggcatggccgcagaggagaaaactgaaaccaaactgggaagacagagtttatccttagaaagagagaaaaacatcctttctctgacacagaaggaatggagaaaagatagtggaagacactaagaactggaaagaaaatgagtgaaaaggggctcttcttttcccctcttggggactgatcttcagtacaaagaaaagtaagaaatacagaacaagaaaacaacagagaaaaatcaatgaaacaaaaaaatgattcttaaaaacagtcagtaaaactgataaacctctagtaagactcacaaagttataaaacaagaaagaagacagaaatcaccaatagcaataataaaatagggatttcaatacaaattctgcagccattacatggataatgggatactgtgagcagctttacattcataaatttggagaaatagaccaattctttagaaattacaaactaccaagcctcagccagaatagttctataaccattaatgaaattgaatttgcaactgaaaaactccagaggtatgcaatactaattcaccatttgaaagtcaataaatcattaacagagtaaaggagaaaaacatgagtatctcaactgacacagaaaagcatttgacagtatccagcacccattcgtgataaaagctctcagcaaactaagaatgagaagggaacctactcaacttgatacagaacatctacacagaaacccttacagcatatatcatacctaacagggtaagactgaatactttcctttaagatcagaaacaatgaaaggacgtttggcatcattcgtattaagtatggtgctggaagttccaaccactgaaataaggtaagaaaaagaatataaaaagcatatgtattgtaaaggaagaaataaaactgtttctatttttagatgacatgattattctatttaggaaattccaaggaatctacaaaacaagtactgctagaactaataaataaattcagtatgattaacaggatgaaagaacaacatgcttaaagcaattgcatttctgtattcctacgatgaacatgtggaaatagaaatttaaaacgtaaaacatttacaatcactccaaagtaaatgaaatacttaggtataaacctaacaaaaaaatgtacagaatctgtctgtgaaaaccacaaaatgccataagagaaatcaaagatctgaataaatggggagacatactgtattcatgtatcagaagagtcagtatagtaaatatgtcagttctccccaaatttatctatagatttaatgtaattcctatcaaaatacaagcaagatatttttggagcttattctaaaatgtatatggaaaggcataggcccaagaatgcctgaaatgatcttgaaaaagaaacaaagtgagactattcactctacctgatatagctatggttatcaagatagtgtggtattaccagaggtatagacacattgatcaatagaatagaatggagaactcagaaatagacccacacaaatatatacaactgatttttgacaatggtgcaaaagctttgcataagaaacttttcaaaccagcctgggcaacatggcaaaaagtctctactagaaatacaaaaatgagctgggtatggtgacacgcacctgtggtcccagctactcgggaggctgaagagggaggatcacttaatcccaagaggctgaggctgcagtgagctgtgatcacaccactacactcccgcctaggtgacagagtgaaaccttgcctcaaaaaaaaaaaaaagaaaaaagaaaagaaacttttaagaagaaagtaagaatagagggatgaatgcatcttaaataatgttggtgcaattgaacatccataggcaaaaagaaagcctataaaagggcaacttgagggatccttatggcaatgaaatattttctatctcaactggatcagtgtcagtaccctggttatgatattgcagtatacttttgcaagatgttacaattggggaatactggtaaaaggcatataagatccctttgtattatttattgtaactgcatgtaagtctaattattgcaaaaaaaattgctttaaaaattaaacaatattacctaatgaaaaaaaaaaaggagtgagtggacaatcaggaacagagaatggagacttacagccattggacggggtttggaacagtccatgtggaagtacttgtttgtcaactggagatgagtaaaaggattacccacagccgagcactgtggctcacacctgtaattccagcactttgggaggctgaggctggtggatcacttgaggtcaggagttcaagaccagcctggccaacatggtgaaaccccgtctgtactaaaaatacaaaaattagccaggtgtggcggcaggtagctgtaatctcagctacttgggaggctgagacaggagaatcgcttgaacccaggaggcagagattacagtgagctgagattacaccgctgcactccagcctgggagagagagagaaactccatctcaaagaaacaaaacaaaacaaaaaaacaaacaaacaaaaaaaacagttccgacactagtcccactgaggttagatctcatggatttgcagcagaacaattacgtgtatttggaaaagcctgatctcaagatatgatgacttcatatcacatctcgtacatactatactgatattcacagaaactataaactatcagctccaacaccttaaaaattaatggacattccaaagaaaatatacagcatgcactttcctgagcttttgcaaatgcatcaaatgaaaattctattgaaaatatggtcaaataagcacagcatgatggtacaaaaatgtgatgccaaggagtaggagagacagatttctgctgggttgtcttaatctgtgagtgtgtgagagtgggtgagtgtgtgcatctatgtaagttgaggggtaaggaaaggacctttacctccagataaagaagtaatatttctatctacaaagcccacaaaccagattctgttcagtagcattgttttcccattccactaagcccttccattccaatttcaactgcgagatgtgaaatgcagcacattgaagagatactctgaaagtatctagagatcatgcttctattgggaggagaagattaatttgacttaagtttctggagagcagatccattttgtgcatcttaatatcccctccacatttacttttatgtaagaacacacaagtatcttctgagtgactggatgaatacactccttttaatagatcaaactttgtgtctaacatttatcggacttaatggaggataccaaggcatttaatatactgttctttccctaaaatattcataaccagaatttttgcctgtcaccttttctctacaatgacaacttcgctgaagaattagttcaaatgtgtttctttgtttcctcatatactttcatatatgtaccaaagttccatctacaccatatccttggtgtacaatgactggagcatccacagttctatgagctcaaacacctagggtttcagaccaagggcaatttcaacttaggtaaccaaaagcttccaagaaaccctgaagaaatgtgtagtcctttgcgtccaaacattcctgacctgtacagacccatgagcagcaattagatttatttttcagtgttttgaaactaaggagagtaagtaattctggatggcctggtgtgttagtctgtttttgtaatactataaaggaatacctgagactggattatttataaagaaaggagatttaagtgactcacagttctgctggcttcacaggaagcatggcactggcatctgctcctggtgagggccccaggaagcttacaatcatgatggaaggtgaagggggagccagggcatcacacggcaagagcagaagcaagagtgagggagggggaaggtgctacctacactcttttaaacaaccagatcagtctcatgaactaacagcaagaattcactcatcaccaagaggatggtgttaagccactcatgagggatctgcccccacgatccaatgcctcccagcaggcctcacctccagtactggaggtcacatttcaacatgagatttggagggcacaaatatccaaactgtatcacctggttttcttaaagcaatctatttgaacttgtcaattcaaagccaaagacatagtttattattaccatcagagtcactcaatcttgaagatgatagggctgagaggaccagagctgagtccattttccttcctttagtcatcactgcactgaaattagttcagattaaaaagagtgagttctttgctttaaaatttcaaatgacagaggctctcatggaaatgccttcaggagtttcaaagcctccatcattaggtgcagccatccaaggcaaatatttgatacttcgtgaagagaagcgataagaagatatgtgtgtcctacaggatacattccataatggatgataatgttttaaatatatatatatacaaataaaaaccgagattctaattttttcaggtgtttcattagtaaatataaacatttcttccatctcttgaactgtaggaaatacaaatttccttttcaaagactctgttttgcatttctcaacattagagaggcaatattttaaaaggtaactagtgataaaactctctagaagagatggctaggacctagaaggacattttgatccataagccagcaacactgaaaccaggactttcaacccacatgcagctctttaggtaccacatgcagatttgatgggctctctggttacagaaacctggccaagttcgcagaactctgacagctccgtgcctcccactccagctgaaacacttgtgggaaaactgagcaaatggatctgcctcgcaggatcagaagaagtaggcaccagcaattccatggctcttctcttccttgtagttttatttttcttgttatgaaataaagcaaagtaatacaaaatttataaagtacaaagcaaattttaaaaagtaatgaatgctctaaaagagaagtcacttataattccactatcaagtgtgaatcacttttatctttgcatataaatcttttgcaaaagttaaaatagcatgcttatttagaaaactcaactatcacccagcggcaaccattgctaatctattggtgaccacttggtcatctctttattcatacctacacacacaggtatctctgtaatttatgtaggggtcactctctatatcatgccttgcatctggctcttttattcagttgaatttcagagagatctttctattatcaagaaatattaaaaaaagtattttaattgttgcagagaatttctttaaatggacagatagatgttctagaatgtacgcagctaatccttcatttatgagtatgtaggttgtttctaggtttctcttctctgaaataatgcttcagtgaagctccttgtacatgcattcttgtgcttaacctaatagctccttgatataaatttctagaagaggaattagtggttcaattttgataagtatttcaggactgccaaaagaaaggttgtgaggacgtatgctgtcactagcaatacaggaaaagatggattctccatacctttatcagtattactaatatttctctaattttctaggagaaaaatgaaatattaacctcatttgttaggtaaagatgatgggccatttttactggtaatttttcattaatagtacaatcaaacatcttttcagatattcatttaccattttatttcttttgtgaactgctcatttttaaattgtgattttcatcttatttaaaattgctttgtaaaggtttactttatattataaatatacacttcatgtctgtcaggtattgcaaatattttcccaatttgttatttgtcttttgatttatgatgtccttttactgtatacaagtttttaaattatgtatatattttaacaccttcaaataacacctagtacataatttcatatttggcttttgcatttttaatattgtattgcttttgtttttccttgttattcagagttctaaaaaatattttcatgaatatataaaatatattttaggaatgtaccattatttcctcaacattggctatattgatatttctcaacactaatagtgctgtattggaggatagtgaggcgatgaagagagagaaagatacagaggaagagagaagtagctgtaattcaaaactctagtaagaagagaaaaagcaaagtgaaactgtttcctttatcactattgggaaagggacaaagagttagcaaaggcctgatagtgatatcttgaaaaaaatgaagagaggcatgttaagaaaaagtagcccctggggaaaataaataattctttcttctgagtggcagagaactatagcacattcaatttgtgtgttttagtagacttataattttaattaagcctctgggttttttctttgtgcttgtcccttttgttttaatgggacatgaggtcttttctttttttccttatttgtagggtccccagtgacctctattgcattttgttactcttggcaacaataaaatgtatctattctctttaggcttgtctaataagtggcattattgcattattcaagcatttaaatttgattgatgagtttatccataaggttgttcacaaatctgttaaagtcatttattttttattctgatataattgtgcatgccattattaatgctgctttccagaagagtaaccacatgttgtagggcctaatttcaggttcaaaatggaaagtggtgatcttctcaatgtgtgatttattggaggaaaatggagcttgatggggacaatctgggagtacatggttgggagggaacccccagatagacttcatgttactttgctgttactcaacagtttgcattgtgggacttccagtgccagtcagggtgaaatatagtttcacattttactaccacctctattgtttctctctcttttctcttctaagaccagggaatagaacataaaggtcgacagctttatcctaatctgaattgttttgaatactgcacttgtattttcatccttcattgatttttaatgcaatgtgatgtattatagccatattcattacggtgtgctgcaccaaaattgtgcttttggaagtgtggcttttaataaaaggaaacacttgtgattatttgtgccatatcagctgtgtcacaagtccttaatatacgtaattcagtaggggttcttttcccaatttcatagcaataaaggtagcacattggctccattgccttacttaggtttcagagttgtttggaaacattaaggattctgattttagtttccatgccatttcatttacatcagatgagtgagtccatcccaaaaaatgagttgggtacgtatttggacagctacaataagtgagaagggtgccttattttgcaaatgggcatgtctactcctgcctagcctcatcatctgtcacctttgctctttagaatgtggcttcttgccaccctcaccctactatccccacccctctgcctgaagctgattaatcacttccaaggctgtttaggttctgttccacacctacactgcaaagttaaagtgtctgtctcccttatgtgcactttaaggacaagatccgggcctgtcatctgcatttcctccagggcttgctgcttaccatagagtccagcacaaggtaacatttaatggattcaattaagtgagcccaatgtcaccatcttagcatattgagccattaatacatggaattgattgttaaaatacggaggccagcttccttcaagccttactttctttcaaaaatatttgttgaatacttgctgttttggcacagagaacatagtggtgagatgatagaaataatccctggcttcagtgagttacaatctcatgaaataattcattagtcttgtttctccaattcacatcctttcaagtttcaggttgggaaaacaaatcaaatctcccctcatattaaaaaaaagtaaactaaaatactgcctctagatgtccaggtgcagggactcacacctctggtcccagcattttgagaggccgaggcaggaggatggcttgagcctagaagttggagaccaacctggccgagaccgtgagacctgttactataaaacattaaaaaatagaagggcattgtgttgcatgcccgtagtcccatctacttgggaggctgagacaggaggattccttgaactgaggagtttgaggctgcagtgagctatgatcatgcctctgcactgcagcctgggcaataaagtgagaccccatctctaagaagaagaaaaaaactgcatctggagctttgctacttggatcatagtgtagcagagatgcatggtatagagctatcctgtgcattacgatagctgctagccacatgtggctgttaacactgcagtgtgctaggtctgaattgagaggtgctgtcactgtaaaatacataacaggtcttgaagatttatatattaaaacctgttcatcatctcaataatttttagattgattatatgtagaaataatatttttgtagtttgaatttaataagatattattaaaactggggccaggagtaggggctcatgcctgtaatcccagccctttgggaggtcaaggtggaagaatcacttgaacccaggagttcaagatcagcctaggcaacataatgatacctcatctctacaaaaaaataaaaattgaaaaattaattacacttggttgttttcatatttttgtgggattacaagataaaatttgaaaaatagatgtagcttgtgtttgtggcttgcattattttgctatttgaaagtccaagtatagagtgaggcacagcatagactggaggcacattgcttcacttcaaatcctgatccttccccctactcgttttgtggtctttggcaatttactaaatctgtctttcattctttgtcttatcatcttgtaaaatcaagatagtgatagtacctaactcaaaatattgttatgaggatagtttatatgtctaaatcatttagaacagtatctggcatagagtgcatactcttcaaatgtttgttgaataagtaaataaacccactggtcatgtgcaccttcactcagtaggtagaattatcaaagaagtaatgcagtttttaagtagcagtttcgtgaataacctgtatttttctaggagcaatagtagcaattgtagactgacatggtgaacatttttgatggtttattagtttaatttccttctcctcactttcttcctctctccagaacaggtggaaggaaaggagcaaaactcaaatatattaatttcattactctctagtaggctttttgggagaatgattctgaaatggatggcaagtcaggaatttttttcttcgcattatggcagtttcctgttactttatgtaggtaccttgaaataaatctaacatatgaaaactcaagcttctatgttacagagtggattctttggatccattgaagagcattgtcagcagccatccagacacctccatgtattcatgtattcattaactagagaagagacactttgaagtcaatcaaaatttaaaatatttatgaagcctatatataaagggaagatatattggttgtggcagagacactcttaaagtggcctccaattcttgtctcctggtgttcacacccttgcgtgggacattcctcttgcaagtaggcaggacctgtaacttgcataaccagtacaatatggcaaaggggatggaatattcatgatgacacatatgcagtaacatgaaaataagatgtcagcacccatccttctggagtttctcctttgcttgatggctttcagaaagtatgcagccctgttgggggacctgcatagcaagagacttctggcagcttctagtgactgaatgtggcctctgccaacagccaacaaaacactgccaagaattaagttctcccaacaactggattaagcttataagtgaatccttccccagtcaaacctctgatgagaccacaccctgccaacaccttcatttcagccttgtaagaccctatcagaggactaggtatagtagtgccaaactcctggcccacaatacatatgtgttcttttaagctgctagtttgtggtattattgttattcatcaataaataactaatacactggcatttttactttcccaaatttaacctccaagcatattttatggcaaaagcaagacatatgcattgaaattattgggtgatttttccttttcttctttttactagcatcagagggatttaagtatatgatacttagcagtagaatcagtcactatatttataatatttcacagcatttaaaacagtatatacaccaaagactttaggttggcagacaatgattcagttattcatatgttgatctgatataactatgttgttaggaatgtatgagacacatatatttgggtttctgaagacagatatgaactgaagacaattttttcaagttattagcatcttccaggtggtagttggaatactgaaatggattaaatcacctgatcatctgtagacattaaagaaggctaaggacagagtccctgaagtaacaacatttaaggatcatgcagaaaaagaatcagcaaaagaaaaaacaaaccaggaaggtaaggaagatttaggagagtgatgtcagagatggaaagagtttcaagatgaagagaatacgaaaaaggagaagcaaaaatgagacctgagttaattggatttaggaattaggaagtgactattgacttcagcaaggtggagtggaagttggatttcagtgaatcactaagttaggaataaagaagtagcggtgaaatattcacttaggtaataactaaagggagacattgaactaaggaaagagttttccttaaatgatgcaagagatgtttatgtctgttggccttgacaagttaccagaagaggttatcatatgggaaaggaaaagagtaattgttaaagtgaggtccgggggttgagagggaatatgccgagtggcatcacaaagaattagcttgagatggaatagaatacatctttctctgactagaggggaggaaactagcctacatgaggaagtagatgcgtcacaggtgtgggggataagtcagagaatgcacatgtcttcaattttcccatttgctgagagtaactagggtagggttgagtagggctttaggtaagtatgtaagtaggtaaaactgctgatggtaattagagggaaagctcactaaacacaaatgagagtcttgctgagtagaaatgaacttctaaggggcattgagaatttcaccaaatctgaaagtaatatcattatgaaatctcccttggaattaaaggtgaagagatttcggtttgtgtccagcaaagtgagaaacctgaactggggaaataccctgcagccccacttccaagctgttgccaaggccatccctcttgcacacatgcagactttgctcatgcctcttggctgacaaactaggcttgtgttgtattttaccttagtatagttagaggaagaaaaaattaggattagttcttcagattggaaataaggaattccatatgtaggagatactctttgcaatggggtgtggcatgcccactttcttcactagacagtgtattgcagctttgctttcttcttcctgttggaaatatattttcagtcaccatccctgttttcccccaatttaagcgaaacaggcaagagccatccctcatcgttctctgagattgcttcttttggaaactgcacacattatatttcttagaggtagcttttttaaaaaagaagaatctaagaccatgaaactggaatttttgtccatttaatttcttaaatggaatcctgaaattttgtgtctagggaaatggtctataaaaaaggcatcttctatatctagatgatctgtgtatgggtggagctctggcaatagttactacaaaggtcgacattcagatcttctgaaattattacagcagtttattctttcatttagtatagtgatcaaatacctgctatctgcctggtgctattctaggctccagataaggacccctgcttcagggagctaacattgttgtatgcatgcagaggggaaaaggaaagggagtgaacctgaaaataaacaaatataatatgttttaaaaaaagatacattgaatcatgtttaagtatgaacaaattaaaatgaagagaggtgatggacaaaggctaggaaaaagaggctggctttagacacctaaaatctacagatttcagaagatttttgggttgtgaccagacagctaaacagtctgtgagtactttggcaagaacataaatggcgtaagaactgctgtgtccatatttttgaaagctgactctaagtcaggagaaataactatcttctgtgaacccgggagaagagacgtatccttgacattagctgaggtcagtatggccagtcaattcttttctctgccaaaaaaaaaaaaaaaaaaaaaagcccagaaagtaaggaaaacaagagggcaggagcctcatagatgaggaaaatcatatctttaaaacacagtttcttgttgataaataatcctcttactgcactggcaacaggactctctcctgccactccccctttgtcttacattcttaatcagttgattacataccactaaaaatacacataatgccacttcctcctttcctgatcacagccacaaacctccattttccttttttgttgttgtttgggcttttggttctgaactttgtgtttttaactacatttagagtctgggaaatggaggtttctgaggttacctttgaaacatctttgagtgacaggctccctttggccacacagaatatcaagagtggaataaaaagtgtggattcagttcaaactccggtagcttttttcaactcagaaatggaatctggctttgactagccccagggaatgtaaacagaaccttacctgtaattaacctagggcttctcttgttctcaatgcaaatggagttacaattgtatttctcttagtagaatagaaaggctgtgtttcagaggggagctggcagttgaatagaggacaagttatctgtctaactgtgacagctctctcctatctccttctagaaaagctgaatgatgataaaactgtagttgcatttgatgtaagacatatggtaattactataataatattatcacccgggttctgcagtggctttgtcagtgaggtgcaatttcacatattgtctgcgataaaatccccgtttttggttattgatagcaatgcctttctcaaatgctataggtattttgtgacagctgcgaagttcctgcttcatatccaggtaattgggttgagaataaggcctgcatgctaaaacctgccgatgtgagaagtagtgaaagcccagggagtactgtgaatattttggtagttattaactgactaaatgggaagcctttgctagtcagtgcttctgaagcaatcctagagaaaaagaaagaaaagaaaagaaataaaggcaatctcctttagaaagcctctgttgggtcttcaatgacgatgtgcaaattttgagctaatcaattatattatgaatctatagataatatttaaaagctatatacagattcacaaattaattgctttcatgtcattctgctattgattgtttcataagtcaaattttacttggcttaattactggtttaatagaagttatttcagcataataagtatgtgaccatgtaataaacatttttatttatttgtcacagaaggaattggttctatagtatattagcctgagcttagctgtatatatttaatttcatggctgtttccagggaactgaattttgaagacactaacagcatgttaaaatggactactataaatccttttttggaaatacgtgggaaataaataataaataacgacagtgtgtcaaagtgattttattgcttagattaataaaaggaaagtaatacaatgtctggataggggaaaaaatcagattatggggttttttccttgttaatgttatcccttgtgcagaattcattttttaaaaatcccaccaaagacccataaaacagtgagctctattctggagttattatttaggcaccgataatcagtagtggcaacattcagtgagtacgtcagagcatactcttgttgaatcaaataaatatgtatatgtaaaggtgcagattacaagttaattctactatgaagtgctaaataactagaaataatgtgattaatttggggataaaattggtgttgtattggttggttgttatgatttaaattccttggttaattcctttttttcctcataaaggggaaattgcccagtttttgaataattgaactgcaaagttagcacaaaaactgaagacctttggccctagcatttatagaaaaacacttgggatttctataaaaaacctatagcaatgtggtaatttaaatcattttgatgcaattcaattcaagggttgcaattattaaatgcctgcaaagtccagacactttctagcccttgggatacagcgatgaacaaaattaagttctacttccatgagcttacactgattaggcatggcttctgtgccagattatgggtataatataacatctcaggaatacttgctaatgacacaccagatgaagctgagattctgagtggccatttgttactaagagaaagaaccaagaattagctcctgtttgactccccaagcactctgaaccctagtgtagtggaaagattatcttctgcagaagtaaaaatattctggatttcccaaaagaagtttgctaacataacaggcaatagatacctctagttgggtggcatattttgcacacgtttgttaactcaccgtattatttccttcttcaaattgttctttgactattttccaagggtcttagcatttttacattcatttgaagctcattatacaattaaggtattatgcctttttcatgtgtactataactagtgttcccacctatgattttctttattttgttggtatatacctttttaaagcaaatgtctgattcattgtctttaatttggagcaacagacttatcttcagatggaagtaaaaactcaacttgtagcttattttgttgttcatagtctaaaatgtagtaagaaaaaggtgcaccccaagaataatggccagtgtgaatgagcccttcttcttggagaaaagatcatgggccagtttcacagaaggacattctttctttgagattttatacacatgtgctattgaaatttgaaggagaagaaatattttctatggcgtagttccctttgtagggtcaacccttaatttacagaacattattataagataatacgatagtgtttgtgaggttgtccaaagggaataaattttataatcacttatcttttgaaattgcattaattgttgaactactgataatgaaattttgatactaaagattttttctaaggcagaggttatgtggtcatgtggtggaaggagcattggactttggactttgtaccagaggatgtgggttttcacttaaaaatgaggatatgaacctgatgatactaagactgaaaagacaattcaagtcaggagactggaagagaagcagggtgtgtgtgtgtgtgtgtgtgtgtgtgtgtgtgtgtatgtgttagaaaggggagctataagagacatattttggatacattcctcagagatgccgtgttgagatgttttgtagataactgaatatcatctacctctcaagagagtggtatgggtgatagaatataggtctgttaacaacatagcagcactaatagaagccaaagagaaaaacaaatgacttggggagaaggtgtgaaatgcaagccctaaactgaccctgcaagtggtttttattattttccttgtttcttttggtttttgatgtttgaacatacatcttttctcaaagataaaagttttgcaaaatcacacagtaaaaataataggacttatggggaaaattgggatgtgacagatcactcaaaactcatagatgtgtaagcataacactaacaaaaataacaataaccttattaaattatcagcacccttaaaaagcatgttaacttcatgatgaagtttttagaaggaaaatatttgatagcttactggaagatggtgtaaggaagggttgaggcgtctgagttatagaggaaagagcagaagcaaacactcaaggcacttccaagtcagaatacatgcacacataaaggaaggatggaaaatggatgcagtcagctggctagtgcactgtgtgctcagctgctgttacttgttggagcaagatgttaggaccgtgagaaaaaccactgtgaacctgtacctcacactgatgttagccccattgttaccagaggagcacatgaaagaaacacttttcttttcctctgacctgcctggccaaataatatttataattcattactttcagtaaggacaagagaacagaactctctgtattccaatttgaacgccttatgactagggtatcaatatctatttgccacaagctccaccacactctattgtcttacatcccctcatctcctatccatttcacacacgtatgtttcctgtcggatttagtttgcaggcccttgtgtagggaagaaaagaacttagaggaaaaggttacatttaagggtaggctctaagaactgatcattagaaaggtagaaagagcatcgagaagaaaatgttagattggaaacaaaaggaggagataatttcagagtagagttgtgagtataagatcctgcagagaggtccattgagattatggcatctctccagtaagacagcactagtacctttggtaagaaaagtttttgcatggtgtggtgaaggcagagccaggctgccatgccagggaaagggagcagcaaagggtgaagaaaggaatatgctccactctttcaagaagtttgatgtggaaagaaaagagaaaggaggactggctgcttttatagggagacatgctgaaagagttttctttgtatggcaaggaacacttaaacgtatcatttgtagatggaagagaagtagctactggggaggaaaagggaaatgattgaagatgagagagcaagagtaagagaagagactaaatagaacaactctccagagagcttatttccattacataattcactccacaaatgtgggctcatctttgttgcatttctagctccttctgactggaagtgtgatttctagcaatatatttatagaatctcctctgccccccttcaaacacttttcaataaatgctccgtgtggttcatttgtaaagctatctctactgtagtagtttctaccagaagacatctacagataatgcaattcaccaagtcagcatgaagggttgaatccctggaacaactaggaatttttgcaggctatttctgctgtgacacagccctgaagtggctagcagatattcagcctgagtggaccccctttattactgatctattgcctgcctaattgtgcataacattccaaatattattaatttttaattatttacgtttaattatctgcattacttaagcattcgaattccacagctaatgttctcaatgaaatatttactaaacagtcaaacctcttggattccacagaattaaatgttttcaatttgcagcaaacctttcctccaggaggcattctttgcactctagtgttctggaggtggctgcagtctgggtggttatggcttcagccttaccatccttttcatctcagggacactgtcaactctaatgggatggattgctctgcttggcattagcattaggaggttgagtgccgttgggacactcgtgccatctctcttcccacttctcttctgttagggccagaaaatgcattaacaaggagccagttctggcgataggaaagcgaaacaacattattgtggtcaaaaggcagatgtggtcaaaaggtcaagaggcatgatgaaaactaataatagctctgacaagagaagattactcacagctgatcagccagaaagcttttccagagcaaaatcaggacccactgtcgatggaaatgctgtttccagaacagaggccaaggaaacaggattatccaccccagcattcctgacataaatattctcacctctattatcctttgtacagaaggagggggcccatggtccacaaaatgtgaattggtttcagttcattttctaggagtggaaatggacagaattgtgctaatgtacctatgctcactaacggtgtctcccttctcaccaactacaaatcactgagagggttgatgatgtgatctgtacgcatagtggttaagactgagggatatacattagaccttcattcattccacaactatttactgatcacctgccgtgtgccaggcactgtgctaggcacttgagagacagaatacagcaagacaaacatagttgcttcctttatggaacttatagtccagcaaatatgagactccctggatttgagtcacaatggctgcctcctagctgaatgactttggggaacttacttaacctcttcagacctcaatttccttatctttaaaaccggaataatcatagtactttcctcatagggcagtatgactattgaattgttgatatgtgaatgcatgtgaaactcataaatcataagattggcacttacagcttgtttcactgggttgtagattaggtgtgcatgtatggtttcactaaaagcttgtacttgaggcctaacaaaattagcaatttaattatgagtgtttaataaacgctataattactggacacgactctaagtagcagaagatatggccggggcgagcagatagatgttagagagtacaactttctgagtttgggtaacaagaagacacattagtcttatacctggcatgaaataagtgttcaataaatgtttattgttgttacagttgtgattatcattattaggccctgagggcttcatattaagctgaaattcatgtgagtttgtgcctagtaagtaaaactgacatactggagcactggcgtggtacttgtacatgtcaaatagtaactgttagctgatgcacacatgcagacccacacaagcacatacatgttagtgtgcatttttattgcaggctattaaaagcatttgttaactagaagggaccttagaaatgatatagtatggctccctcaggatgatgaaactcgagacctggagaaagggaagcaacttgccaggccacacagtgagtggtaaaccagggaccaaaatctggttctttgccccagctagagaaagtctgctggaccccaccctgcctctcttctaactactttacatcatgtgcaataacaatgacagtaagtaatatccacaccccgctgacagtctgcaaacgcctttctctttcatggcaagctgaattagaagctttggagtgtactgattttgccttctctgtctcaccaccttcctgccacctgtctttttgcattcctgatgaaaataaaacccaaatgcataaatcatatgactgatagtcataactggtttctttagattgctgtagctaagttatgcatgtatagattcactgaaaactttttttgacacctcataaaattagtatgtaaattgggggtaaaattgaatacccccaatttaaattgctgggcacagctctagttagataatatttggagacaaggcttggagacaagatgtagccagggtgaccagatgtcaggattgagaactctgtgagcttaggcaatgggttcaatgttttgaaattccttgttcccacaagcctcataaatactacctttgtgccttcttaaatacacagtgttttgcttagctgtttgcatcaggcatgtaacaggcggcaatatttagaaagttagagggcagcaccttccaaaatggacctggatttacctttttatcatgtttttctcctgctgaggagttcacattatcacttcatcattgattgtttttgtgtgaggtaatccatagagttttgcttgaaccccacaaattgaattaagagaactagctgctgttctcccttgctacagtgggtggctcccccaaaaatatcccacctcctaatcactagaacctataaatgtagcctttttcagaaaaagggtcattgcagctataataaatttaaggctcttcaaatgagattatcctggattacccaagtagacctgaaatccaatgacaagtgtccttacaagagacagaagaagacatggatacagagaagaggagaaggccatgggaagacggaggcagagactggagtgaggcaatcacaagccagttatgcctgggtcacctgaagctggaagaggagccttcggaaggagcctttggatggagcaaggcctggccaacaacttgatttctgatttctggcctccagaactgtgagagaatagatttccctcgtcttaagccaccaggtatgtggcaatttgttacgactgcctcagaaaactaatacacctgccagctgcaaggtggccctcctctgaatgcgaggtgttagaagggacagtgtctctcagagtcaattctgaaaaacactagttgtgtgggtgaagagataggcgggccttaaatggcagaaggagtgagtgagatgaaagtatggagaggccagacatgaaatcactaggcggattatttatgtatttttctgtacgggtgcatcacttctaaaagtattgtttgtttgcttgttttcacacacttgcttccatttattccctcttctcatgtacatggtggaagaacactcataattggccttttgtcttctaacctgtaacataagaacaacttgaacttcagaaccagccattttggcatgcagtattcctgaaattggttttagttatttcaattaggtatttaaattagcatttgtttctcttttaccattcattctcacacattggtcacatgaagtgttgatgttcttttaggtttgggaagttcacttgcagtagataaatcagtcacctaaaatgttactgtccaaaatcattggagcagttgataccgccagtatccatgactgactgcgttccttcatttggtctatggagatacttatcaagccctgtatgtgccagacactgtgtctggaatgaagtgaacagtggggcacagaacagatatggtttggcccttctggagctctaagcacagcagcacatcttctagatcttggctgactctggagttggtgttgcccaagatctcttcaggatctaactgagttggttttgtcttagactcttctctctcccaggctgaattagataaaccagactccaaaaggcagctggatgaggtcatctatgggtttctggggatgacgtgtttggcagaagtcccctctcctgtcattctccacctccacagacatttagaacagctctatccagctgcatatctagacagaacttgactcgacatccacagtatctgatttatactgaatttgccacagatacatagaatctgaagtttcccttctaaaggggtattttgagccataacaaattccatgaaaaacaactctatgtcctccctaagtgataacaatattaagagtggaaattgtcactcacaaagagcttgactaacaaattcccattctttcttacaggcaacttttgtctcctctccttcctctagccacagttaatgtttgctgagatgtaaattcaccctccactgctctaaatatattagaggtatcaattcatttgttcttcatacaaccagagataggtgctattattcccattttacaagtgaagaaactgaggtaaagttacttgcccaactttcaaggacattatgtatgagttgggactcaaattcagatagtttggctctagggtccacagtctttaccattatgctagactgccatcacagaatcagatcaacatgcattgttaatctatctgtgactgatgattgtttagccaatcagtaaccaaactgcaaagaaccagagttcttcgactacaggtactaatctctctactctgagccatgtaaaaaaataattgtagaagagagggaaattaaaaattaaagtgtgggggtattgcattgaagctgcacatttacgtgagttaagagtccctgatcacagagcaccctctccaaacaagcctcccatctcctgaaggatgagaccccactgactgacttcgaccacagaacatgcaacctttgaaacatttccagaaacaatacagtccttcataacagtgtaggaatgaagctatctaattccctgtatcagccatcagaggtacaagtgacatgaaagtttaactggaatctttttttttccttatgtctcaatgcatactttgcacttttaattcagtattgtgtcaagttcatacatctaattcatggaaactacttataaaatatgaagacacattagcaactaagatttggttaatacacatttcaaatgttgttggatttctttggagtacaacaatacctaaatgttgcattatttaaccaatgttggggtgtgggtttgtgcacatagggttcccagcaggtaatttatctagtgatcatgtcctgatgaacacaagggccctattgcaggcaaatcaaaagaggtaggactatgtcccaagtgttgcttctcttaccccaaggttgcccaatgcaatagttttcattctggtacatgcaaacatgtttcctctaaggtgcaatgccagaaacctagaggaaaatgtgtcttggttttatctgagaaaactggcaacaattcctttggaattgattccttttctttttattattttaaagagagaatagatggttattataccacttacgcagctaacagtttgtaggtcaagatgacctagagccaagaatgtgatattcattatgatacagcatgaaaaagagaaagttctgtttgtaaaggatttttttatgaagtcacaggcccaagggagatgagtacagaaagctatttagggtaccaagaataaattggatggccccctctctattcccttttttaatccccctaattatttattctgcaacttctcccccaacaagtatgtaagccacattagggccgggatttttgtttaatgtggcatccccagtgctggtatgtactctgtattaaaaatatattaatgaatgagtgaatgaatgaatgaatttcatctgaagaatgagccttccagacgaattccttgttaaaataagccagcacattgtctataaagcagcttccttgattaaggggcaaggtctcaggttaacgtgagataagagtttctgatttcagcatccagccaaatgatactgttctttggaacgcactctcttcttccctccactagtttttcttccctagcatttgttttggatctgtagttacagcattttctgctcagaattcaactgagggaaaaaaaaatgtgttttgagtaatactcactaaggtgaaaatctgaccatattttgagaaataaggggtttggaggctcaggacagaccatcccactgctgtcttagggacattgggctgctggagcctggcccaaagaaggtcttctgggaaatcaggactgagtctgggcaatgctagagtcagtgggtaaaatggctttggagtgtggcacacatagtaacgctctgtggaaccctccatattgacctgagcctggcctgatctatgagtcatctaaacctaacaaaaggcatctagaggacttggggttaaggccgagttattcttcaagtacacaattatggttgccagtaaaatgaatttcatgcttgaggtgatatttgtgggagaaaaaaaaaaggaagattaaaaaggctgtgtcaaaatagtgttttgattagaccagaagcatcattctagaaaatgcaaaatagtaggaacgcaataaaacaaacaaacagacaaaacccaaacaaacaaaaaatgctttgggcatgcctttcaggaatgaacgatgaaccaaagtcataaatcatccccctctattccctatttttcaggtgttatgtttctctattttgtagactttcatgttctacattgtgaaaaaataactaatgcacaatcccatatatttaagcttgtatgattactaatatttgtcatctttttaatttgtagaggatatttaatttactcttttctggaatatatgataatcctgtgctttactttctcatgaaggagagagagtaaaacaataagcaccttggtttaaaaagaactaattagcaagtttccctccggttctccaggcttatggcaaataactttcttcctgacaactgaatgttacatcccaacctccattagtcttaatagaagtcatgcattctctcccacttgctgtgatataagaataatttttcttctgagtagaataatggttgtgaagtcatttaggtagtcacagaaaaaaatagccttttattgttgttgttgggttttctttgattccgggaatgaggctaagagaaaccttgttccattttaccgtaaatactattaatccagagatgagtccttagcatacagaaatgattgatttgcatttaaatgagtgaatattcagagtttctagactcagataaaacatcaaaattatccagtgaccttggctaaattttagagttaactacttaggtggcctaaacaaaagcttgtattttcagcacacctaccatatgaaaaaaaagactaaaagctaccttccaccatcctgatgtaaattagacaccgaaagtatacactttacctccactattattgatttattcatttctgacctcgttcccaagacagctcactcatttcctccaccaggtccaggaccaatatcttactttaagtaaaaagttttcactcagaaaagtctggttgactattgtatttgacaaagtagaaaatagagttatggtgctgttttaaaagaactggggaggtctgattcccaatctgcataataaggctgtctttagcactgtgcattagcagcaagtaattacctccaactagaatgaaatgagggtcaagaatggttccaagtaatccagtggaagtgttacttgctttattgaacatgctaatacaaagctgtatttggaagagtcaaagaagaaaaaatgccccaaacccaaattgccttatgagctttttcacaagagcagtccagagtggtctgtacatgataaatttaagagttgcggttgtttagttttaccactttaaattaattcacctaagaatttaaatgattttgggcttctgcttttgtgtctaaatttaatgatgcattctgtgaatataaggataaacacacacagatttttatacatgtaactgacctattttcaaataggtgtgcctattcctgaataaatagattgatgtcctaccagattacaaattaagtagatacgatttatatggttttagtatgtgaaagtattagctgattctaatttcttcttgtgaaatactaagcgaatgaaacatacttattaaaactcaaactgttattgacttatagtcatccatagttctaatctgggtgggtgacaattcaaagtcataacaataatttttttattagcagcaaattagctttgagaacaaaaatgcaatcagctccagaattcatacatttttttctttcattagacattaaccaaccaaagtttagggtgaatatgttttatacatctaggtcaatgataatacaaagaatgctagcctaatagcaatatcttgagctttttaccccactaacatacagcagaaagcacgtagaaaataagctctttcaacgaaataagtaattagaaatgacggactgttcagatttaaatttgatgataattatttaaaaatgacagaagtattggaagtttatcattcaaaccaccttaaaagtttttcctagtatacactacaacaacaacaaaaggaacattacaaaaactaagactttgagaggccagacatggtggttcacacctgtaatcccagcactttgggagactgagcgggggaggattgcttgagctcagaagtttgagaccagccttggcaacatagagagaccccatctctaataaaaaattttacattagctaggtgtggtggcatgtgcccattgacccagctactcaggatgctgaggacactgagtggggaggattgcttgagcccaggagttcaaggctgcagtgagctatgatcacgccgctgtattctagcctcggtgacagagcttgaccttgtctcataaaaggaaaaataataataagacgttgggaaacttttaaagcagaagagaaaatgtgggcatatgtataacttcccctcaaatacctctatcctatgctgacacactcatattcctaagaaagatagccggagaggattgccagacaaatgcaaactttttttatcctgcagaagtttcctgtcctgcattcttgccttcttatcatcctcagatgagaggagcttaatacatcagaaaagtcaggatacagtaggctatgtttcagtaacaaataaaccccaaagagcgaattgtttaacacactaagtttattctacactcaaagtccaaaatgaatcagatggccctcttccatcttatagcctgcaaggttgctgtgtcaagaaagagagagctaaaagtttccatgaggcgtgtctataagggccaggtttagaagtgccttgtgaaaccccccacctttgcatgcatcagggcctagccatgtgatcccaacctaaggcaagggagattggggagtgggtggcccacaagaggatgtgaagtggatcttaccactgtctctgctgcgggagaccttctagctcccttaagctcatctggcttaacagccagctctgtcttctctcctcagggctgtgctgtgggccctctgattctctagaaccaacatcccttcagagaaagagaacgttcagtgaaagaggaagagagagagatggaatgacagcactagctctcatacaaagtcccaaaagcatggaattccagaatggaattcattctgcacatcattttcttcaagtggggagagagagagaggtatgggagtggggacagagagagagagagagagagagagagagagagagagagaactactgaaataagaatttacccttatatttggaataagtaagaatataaataagaatatccttctcactctactttccttcctcccacataactactcccaccatagtgaatatgatagagtgtatatctgatttctttactccaaaaagatatcaagaaccttaagctttctttctgagccactcctcactaagcttatcctcatttcttaaagtataactatagctgggccattttacattctactgaatattctgtgacactgtggtcatcagcatgaatgacactttggggactcatctaaccaatattttggatgtctcccaagtgccaagtcttgtactaactccatcctgaggctgtgcttctctcaaagagcttgtggtctagctggtgtcatccaaatactgacagatacattacaggaaacacagctactgttgcttgtaacccacaccctgaggtgtgctgccaggtatgtgctcagccacacatcacacacaaaaatgccttctgaggtaccagttgtgtactgctctagagtaatcacatccaagatgggatggcacatacattaaagaccaaagctttgctcttctcatgagtgttaagaactgggaattcgtttcttcccgaggccaattctcacagtcttgatctgtcagaacttactggggttgaggagaaagatgatgttctgaacatggcctgtttgggcctgtttggggctcagttttgccatcagagatgttccttgctggcagtggcactggcccacaatggatagagctggcgtgaggagtggaagctgtaaaccaggacaccagaagttgccctttttagacccagctcttccactaactcactctgtgaccttggaggtgtccttttggcctctctgagctccagttttcctcatgtgtaaaatcaaatgtttggactagacaagggctctttcagctgtgacaccctgttattctgggcatctgtgttcctgcctctgtaattgaggtcatcagtcctatgtcatactgggtctgcagggaggatgaattggagcagagtcaccaggttgatcaactcgagaggcatccctcccacagtgactcaccaggagaaaaaccattagacccatcacctctgggacttgttgacactgattttcgtttttttctataacttctaaatgctcacaaactgaagaaggcaataacccttttttagtcagtgcagctaccaaaatggaaagaaagtacctttgcacctgtcgctgagctagcctctccaaaatgtacttagcccattgctgaggaagtctgtgggtttagagagaggactttctagaagacagagccctgcctgtcactggaagcccagcttagcatgaggggacttgtcacacagtactgtggaattacacacctttagagctgccaataagttcagccttctcctcaccttcacacagatttcttcacacacattttgcacacagggaagtgaagcccagagaggttgattaagccaaggtcatgcacggtatgaaggactgagatgagaactggcatcttctgactcctgactgttaggccagtgctcttgcactctaccgtgctaaataattcatagacacatgaatctggtatcaagaacagtgacatgataatggtacagccaataatggtagttacatataccacatatttattttacatgtatataatatgtgtattatatgtaatatatattctttagtcccaacttataggtaagaaactgagacacgtagagatgaactaatttattcatttggtgacatacagctcagttgttccattgaagcaattttttaagtgcttgtcatgagcaggcattaaactagtcactatgatggaatttagagttaaattagagctctgccctcaaggagatgatagtaatgtataacctaagccaaagacatgggtaacagttatataagggagagatgggaccgatgtcagaagacagagctggctagatttggggaaactcaaagaaagggatgtatttttttttccagattgaatgggttagaggaggaaagacaagggtagaggtaactgaactgaatctccaaagaagtgtaggttgtagggcatagaatagggaatgaaaagccagaatgggccaaaaatatctgcatgaagccaaacagcacatcagttgacaagtttgttctttgacaagtgcgcagccacaaccaagggatagcaagtgtaaaatgcttagtagtaggtgaagacgaggaatgtgactaatctcacgaaccacctgtgataaagaaatctttgctttctgattttgttacaccaaaaaaaaaaatagaaaagccattagaaaacttgtaaacctggtatctaaactacaagcaaattgaaactgacccagctcactgttaagagtctctttgtgagggaaaccagagcattttcctgtaaagtcaacagggtttacagttgtaataggccattgattctgaatacacaaatctgaacaaaccacggatcaaatcagtctccctgaaagatggcagcttcaaaaggtaaaagccagatgcaacagagttaacctccatcaccactttaaagaggagcagagctgtgattgtctccactgaagaacaaaatgaagattgggtttaagccagtgttgtgctggtaaatatttgaacactgactgtttaaaaatgtgtgtgtgtcaaggacagaaaaccaaacaccgcacattctcactcataagtgggagttgagcaattagaacacatggacacagggagggaaacatcacacactggggcctgttttggatctgtagttattgggagggtcaggggagggatggcattaggagaaatacctaatgtagatgacaggttgttgggtgcagcaaaccaccgtggcacgtgtatacctatgtaacaaacctgcacatgtaccccagaacacaaagtataatagataatattttaatgaaatattaaaattaaactgccaagaatgtatatttaaaaaggtgtgtgtttaagcttattattaattttcccaataaagagcacataatttacaaataacaataaaatgttcagtattctttgttctaaattccatgtacccaatcgtttctttaagaatgtttttattgatttttgccaaattattgtatctatagctaacctatgggtgcaactgatgaatgaatatagtcccaaaataatatggttagtatttttggttaccttagtaggtaagaagaaggtgaaaccaaaaagacctgtgttggaacctcatttgctcctccataatattagtaacttccttactgaatcaaataacagttttcaaataatagaccaccactatttttccagttttgtgctgctcatgatgtaatgtctacaaacacagcacactttgaagtttaatatgtaatatttacattttctccatccatttctaataatcaacagtatagcaaatcaagtcctgattggtggtgtttgcttatttctatgatataatacttccttacagctggtttccagctcccaatgagatatcactgaatgcagagctggaaagagaggtaccgtagcaggccttatataacattttcactattatgcactgaatatgtgcgtgtatgtccccaagtctatatgttgaagccctgacccccaatgtgatggtatttggagaaggctcctttggtaggtaattagatttatgtaattaggtttagatgaggtcacaagtgtggggtccccatgatgagattagtgaccttataaaaagagaccggagtatcctataacactgtagttaaatatgaacagaattaacaataatacatagatttaaatagctagaatgaagatattgaatggtctcaacccaaagaaatgatcaatgtttgagatgatgggtatgccaattaccctgatctgatcactgtccatcatgtgtattgcaacatcactatgtaccccataaacatgtacaattattatgtgtcaattttttaaaactaaaaagtttaaaaaattaaaaataattgtagaaaataaaaacaccatggtcacaaaaaaataaaaattaaaaaagaaaccagagtttgcacttgtgcaccccctcgcctgccccatcaccataaaggaacaccctccctgtgcttcctctttctattgttaccacttactccccatcctctcacaactactaatctgttctccatctccatagttttatttccagaatgttataaatataaaattatacagtacattaacttttgagatgacttttttcactaagaataataccctagtttcgtctacatagttgcatgtatcatttcttttatttctgagtagtattccattgtgcagataaaccagaatttgtttaaccattcacccattgatagacatgtgggttgtttccagttctttgctgttatggatagagctgccatagacatttgtgtattttgtatatagattttatgcgaatataacttttcatttttctgggataagtgcctaaaactgattgctgggacctatgattggcgcaagaaacttccaaactattttccagagtgcctgtattattttcctttcccaccatcatgtatgagagatcaagcttctctgtattctcaccagcattttgtgttgtcactgttttccattttagcagttctaattgctatgtgctgatatctcattgtggttttaatttgcattctctaatggataacgacgttggacatctttttatgtgtttatttgccacctgtatcacctctttggggaaatgtttcctcatgtcttttacccattttctaattggagtttgtttctttactatacagttttaagagttctttatatattcgagatgtaagaaatttgtcagatatatggtttgcaagctttttctcccagtctgtaacttgtcttttcattctcttaaaagagtcttttgcagcataaaagtttcaaatgttgataaatcatatatcaatttttggtgtcatgtctaagaactctttacttagatttacatcctgaatattttcacttatttttaaataaaaagttttagaattttatattttcatttaaatccatgatccattatgaattaatttttcatgtggtgtgaggttttaaatcaaggttcatttttctgcccattggtgtccaattgttcccgtgttgtttgttcaaagttatcccttctccaatgaaatttttgtttttaatataattcatttcattataagttttaaaaataatgcttgtgcgtaacaactagctcacaaaaatttaacaatcagttctgggagccagcacagggtggctccagcactttattggtttaaactatattgtatgttattgattaggagggaaaaagtagtcatatggatggttagaaatgatgagtgtttacctaaatgcccatcagtgatagactggacaaaaaaaatgtggtacatatacaccatggaatactgtgcagccttaaaaaggagcgagattatgtcctttgcagggacatggatggagctggaagccataatccttagcaaactaatgcaggaacagaaaaccaaacacttcatgtcctcacttataagtgggagctgaattataagaacacatggacacatgtgggagaacaacccacactgaggcctgttggaaagtgggaggggagggagagtatcaggaagaatagctaattgatgctggacttaatgccaaggtgctgaaatgatctttgcagcaaaccaccatggcacacgtttacctgtgtaaaaagcctgcgcatcctgcacatgtaccccaagcttaaaatagatgttgagaggaaaaaaagaaagagtgagtgtttgtaaataaatacatatgtaaaacattataagaacataagggcccagaggtagcattagtatcattttgtagaaaattaaaactcaggtttgaaactcacattttactagcctcagagggaggaagcaggaatgggatgtaattcatgctattactttgaaattgcttaattaatagattattttcaaactaattgggtggccaggaagcttagtagaataatcatggcctctgtggtcaaatggagctgggtctgaaccttggctctgacatttaccagctttgaggaaatgccttattcactatcagtttcccttagtgttaaaatggagagaactccaagaatcaaaagctatattcattaatttaacaaatacttgatgagttctggtctatggagaagggattggggatacagcaatgagcaaaacagtcatgatttttgccctcaaagagtttacaatccagtgaagaggtggacagtgaacaaataagcacattagtgaaatggtattaccattgtgaaaagcggcatgaaggaaaaaaagcagatgtagtggtttaaacagacaaacccaaaacttagcacttttccaagcacacagagtttgctcagtggcagctattcatattactgcagattagggtacgattagtgtggtccaggcagaggtttggaggcctgtctggggacctgaccactgtcatctatgttgcatactgtaatgctcattttgcacatcaatctgaattggatgtgcttcaaggtcctcctcttactctaaaaatctgtgttccttaggtgtgtcaaacagggattagtttaatttcttacaaaaggtgagggtaaattcagcaatcagtatggtagtaattgactcagttgctatatgtgtttacattttaataatgtttttctgtgatattccccactcatgccttttttaacatagagtaaattatgaaaaaagacttagggagctagaatcctaggacaatgagatgactctgaaagtgtttacaaactttacttccaactactggcacacattgagttttgtttggaagtaggttattattaatcaatgtttttttgtaatgaagtccataaatccacattaaatacacatccagacttcttgaggtccttttgattttgcatattttcatcagaataattcactaaactcaatctgagtctttttcattttaagtttttgctgattttctactaagtgtcctctgacttattgagcaaccagtgcagcattggctgcctgggcagggaaggaaacagcaggggttatataggaatctgagtgattctgcttcttggctcttgttcttatggtttaaaatagaaggaataatcttttcaccactgtctccaccacctccagttttcagtgggaagatgaggagtaagaggtacatggttagttattttctgtttcccttctctaatttcttttattatcaaattggtactgccttattgtaggaaattgggaaaataaaaactaaaaaagggaaaataaaacttatctgtaatgttactgttaggagtcatcgtctcccatactttgaaaccggatatgataattccataatttcagggttagactctattaaagtctctacttatgcctctacagcactttaagaccaatagaggaagccatatacctaagtgaggcccaagatccagaaaaaaaaaaagaaaagaaagcataggtaagagccatataatgctgtgttacaggaactattctaaatacattgcaaatatgtttcttacaaccacactctattattaccctcatttttctatagtcacaaaagcagtaagaggtagaacctgaattcaggcccagtaagactggctccagagtccacaggctaacaaactttgtaatactacagaaagctgagtaaccatttccaacttccctcctcccctagctcattccctcctgtgggaagcctacactttcattgtttctttgtctcactcatggcccaatatttactttgttcctattttgacttgttgtgtgatgtctgtcactcctgtcagtggaggaactgttttgtcccattattctctttctagaactttccctccactcacttctactgaaggccagctgtatttccatgacctgccaatacaactcacaaccatctcctccaaaaatctggtagttttacacagtaaccaaagtcacatacaatctttagcatagatttggggaggagggagggaaatgattaagtgcggtgtttaacatggggttggggaggttttgtgaggtcactgagggtccgacgactccttcaaaccatcagggagataacctctattgattggtgtatttttcttgaatttttttctatgcatacacttttctaaagtttattttatttatttttattttacccaacttgtaattttgaaataactcaaacctggagaaaaatggaaagtattttaactgaagactttttacctttacctactatattagtttcctgggactgctataacaaattaccacagactgggtaacttaaaacaatataaatgtattgtctcacagttctggaggccagaaatcttaaatggaggtattggcagggccatgctccctctgaaggctccagggaaggatcctttccttttcctaccttctggtgattgccgacagtccttgggttccttggcttgtagaggcattcctcgaatctttgacatcacatggcacttggcctccttcctcatgggtctctctgtccctcctctcttcttataaggaatgcaattgtattggatttagggcccaccctaattcagtatgacctcatcataatttaattacatctgcaaaggtcctatttccaaataatgttacattctgcagttctgagaggacattaattttggtggatattatttagctcagtacacctgtagtcaccaattgttaacattttgacacattcgttttatttttaactccaactgtccacccacccacccacccatccatcctcacacacacagattttgttaatccatttgaaagtactagacatgacactacacccctaaatacttcagctgctggtatctattaggcaaaataacattttcgctacataaccacaatactactattatctcatatttaatatgaatcccataatatccgatatagagatcatattcatatttccccattttttctaaaaacattctttatagctgatggatttttcccccacaaatcaagattgaataaaggatcaaacattgcacttatttattatgtttctttaatctccttttagctagaaggatacctcgctttttttaatttttcatgatactcatatttttgaagagtccaagccagttgactttgagaatgtaccatattctgggtttgtctgatcatttcttcattattagatcagattaagcatttttgaaaagagttccccgcaggagacgctgtctactctggttgcctgacatcctgaggctcatgatgcccgtttgctctgctggtcatgatgccacatgtgacagctttgctggggtggcggcaaccgcttctctgcacagtcatgcacattgtttcccagtcttttcaactctcgcttcacatcgtctttttatttgtccttttttcttcagagcttttggatttctgattagaagtgtttagaaaatatctgtaagtgcttttttgtacacatttaactcagtccggcagtagtgttagttttcttccgctatgtagttgtttggaggaaaaaattttcacctgctgaaatgttttgactctcattttctaaagttttatattgactttgtggggatgtcatcactgtttcatgttttaattatcttgcgttttcctgtaccaacaaaaccagatgattctgtgtagacagcaataaggttttagagagacttaattgatttcttggatcaagaacactgtcttctgttgacacagtgaagttttttgttgttgtttttttgttttttaatagtagatggcacattttgtgtgatgggatgggggtggtagtgtgctgtctcttcttcctgaacaacccttaatttcatgatcatggtatctcccctgccaggtaagtatgtcatatggcctccttcctcattggtctctctgttttgaatgcttactttcttctgcttcaccatctaggctccaagggcacctcctctcccaaaaaagccatgcctggacctgcactctcaagcctcctccctttgtgccccagtagctctgatccaccaggtcattgacctttctctctttatcctctcaggtgtgacattttcttaccgggaatgattttatctgtgctcttccacttgctaggcctcactgcctcctcctctgcctcctcctctttgccaagcattcaccggctgactttcggctccagcaaggccttcagcgctggctctgcaggtgtcagatttttatttccccacctctgtgtaaattcagatttgtagcattctcagtctcttacttatgttgtagacaggggttatgggtggttttatttgctatccttgttcatctctgtaggtttcagagaacatgtgtggagagatccatatttaatgtctagaaactccaagcctgcatatatttattcttgctgctttgatgttttgatgtaaatacaattatatatttcacattttaaaattctgacatggtatagtataattgtatctatctttttctctctttttgtggtttgctttttacatttaactctttcattcttctggaattattctttgctttggcttgtttatctagaccttctgttcttgcctatgggcacaatagaacataaggaaacatggcctagtttgcttagcaatggacagatgcttagagaaatgaggggcaagctttggccttgtgcaaatgtggtggatgcttgctgaagcgcagagtggacaggaccagggatgatctgactgtgagtttcttaagaaagttgagtgttggtctcttggcacttgaggctctcatttctgcagagtttgtcaaggaccaacggcccatcaaatctggctgcttgtcagatgcttcagaacagctttatgtcttgtcacattcttagtcactggcttatgccccaaattctccactaacgtttcagcttctcatgagcagtgactacttccttgtctcagaggacatctagctggagccttgcccaaagtgggttctcagagacaattcagtcacctttgaaagcttctatcctgagatcacaaaaggggttacaacaaaagcagtgtattttcctttggagacggataagaaaagaaagacacctgagcgggagtgggtagaagaagtattatgcagcctctatgaggcctgaccctttgacagcctcaggtcctcttcattttcttcaataccccacttttaaatatacactatgttggtatattcaccagtagctatcagggaaaattcagccagatatcgggtgaaattcacccccgatatttcacgtagtttcttttctattttccctaagtgtcagtcggtctgagaaataaagggacagagtacaaaagagagaaattttaaagctgggtatccgggggagacatcacatgtcagcaggttccgtgatgccccccgagccataaaaccagcaagtttttattagtgattttcaaaaggggagggagtgtatgaatagggtgtgggttacagagatcacatgcttcacaaggtaatagaatatcacaaggcaaatggaggcagggcgagatcacaggaccacaggacggggcgaaattaaaattgctaatgaagttttgggcacgcattgtcattgataacatcttatcaggagccagggtttgagagcagacaactggtctgaccaaaatttattaggcaggaatttcctcgtcctaataagcctgggagcgatatgggagactggggcttatttcatccctacagcttcgaccataaaagatggccaacccccgaagcggccatttcagaggcctaccctcagggatgcattctctttctcagggatgttccttgctgagaaaaagaattcaacgatatttctcccatttgcttttgaaagaagagaaatatggctctgttccgcccggctcaccagcggtcagagtttaaggttacctctcttgttttctgaacgttgctgttatcctgttctttttcaagttgcccagatttcatattgttcaaacacgcatgctctacaaacaatttgtgcagttaacacaatcatcacagggtcctgaggcgacatacatccccctcatcttacgaagatgatgggattaagagattgaagtaaaggcaggcataggaaatcacaagggtattgattggggaagtgataagtgtccatgaaatcttcacaatttatgttcagagattgcagtagagacaggcataagaaattataaaagtattaatttggggaactaataaatgtccatgaaatcttcacaatccatgttcttctgccatggcttcagccggtccctccattcggggttcctgacttcctgcagaaagcagccacccagatcctgcccgaagttgcccataaagcacttttggagaggctagattatggatccaattaagaatccctgtactgcaaattctaaagttctggcctagagtcctgtgagctatcctgcttacaattgttactagcagcacacacatgtctctggaatgcgaagaagaaagaaaaaaagacaaggaacgtgaaaattgggtgatgtcagcctcccttggataaagcccatcaatggttttcattgtcttggggtgaggaacaaatccttgatagaactaatatgatcctccatgatctgcccatgccgccttctccagcatcatctgctactccaactcccttgctgcctgtgcaccagcccctggcctcatttcagtttctcaaacattctgagcttctttccaccagagggtgtttgcatatgccgttcccactcccttgaatgcagctactccctctttttccttagttaatgcttggatatctttcagatctcaggtcaaatttcacttcttcagaaagtcttccttgattgcccctgttaaacacacattcttgtagcaactggtatttccagggtatttcttgcagttgtaattttacatcttttgcagggtccttttactaataatgttcttctccctaccccaccaggctacaatttccatgaatgcagaaaaagagtttatttttgccaaccattgaaatccatgtgcttaaaataaagactggcccacagaagatgctgaataaaatgtttgtggtatgcatgaatgaagtgattaatgtaaagcaactggtgagggctaaatgtccaaagtgaaacaaacactgaacaatcatgtaggcagataaacagttggctgattttttttaagaagtgattctttggtaatctctgacaaagatgctgatacaactgaatatatacatagctgagagacagatggaataactaagatgaaagttgaggaagaagattgaacaaaacatgataaaaaattcagagctacttgctggttgtgtctgaaagtagtgttcatttctagtcatatcgctgccataaggagttgaaagacagtgaggagaaaagcctaagaagggcagcatggatgaccccagattaaatgtcaagccactcacagaaagtttagagacttacagtggaaagtcaaaaggacttgaaggagatgtaattacagattcaaagctcaatgactgtatgtgataatgtcacctgctttcattttaacagagacctatttacacaatgcagatcctaaagtgcagatttggaaaattccaagtaaatttatgaagggtttttcaatagcaacaaaagaacctaaaagcatagggtagtggaaggtattaaagttgctatgtgagaagaaacacttgaatctgtgaatgaattctctttcaccctcactctctgtctctgtctagtgcatgtgcacacacatttatattttaagaaaagtatttttagaaggaatctaacaaagagatggtgttaatttggatcttttaaaccaaaatactacatattcattttgcattttaatcagattttttcataatctgaaagaaacagatatatggctgctgttttccactcattagtatattctattgactccaaaactaaagggagatttataattctttactgtttaccaagagcattgaaggaaaaagctgaacattgactttttttatagagttgttatattatacttcatattggtatggagatggaattggcttctcaaagcatcattcttgaaatatatctcttcctccctatagaaaatttgtgcataggattaccagggacatttgtggaagatctggtgagaatagaaaaccagggaggtgggatgactaggaacagactgagctaaggcagggttaagtgagaccctgatagtaaagagagattgcctgttagctagaagttattgaaatacttatcacattaaagaatgtggctaaaggctcaaatagccatattttttccagctagaaaataaatcaaatttaacatgaccagcccacgctttattgataatagactaagatcacacagcgagtgctctggctaataggattgctgtgcagttacaaccattgctattacagcagatacagttctgcctgcaaaggcaccatggaattgtgcatgaccaaagacttgagttgtcctgaatgtctttgaccttgaaaagaggagataaatgggactgagcaacatggggactaaggaagacattcaggacagacctgaattgaagaatggggtgtccaaatcacaagcctggtctggtttaggtgaccatcatatacagaatggattgggagtcttaatttagtaggcaggtggagctgccagaagcactcaggctgcttctcaaaagcaggtgaatactttatgtcctcttttgtccatttccacctctacatttgtggtagacagaacaaaggtccacaaagatatccatgtcctaatccccagaacctttaaatgtgttaccttaccttaccaaataatttaccacgacttactaaaagggactttgcacatgtgattaaggttaggggccttgagatggggagataatcctgtattattccattgtgaacccaacctaatcatatgaatccataaaaggggagaaccttttcccactgaagttgaaatcaaaaagagatgtgcccccaggagaatggtaagagaaatgcaatgtttttgaagatagaggagggggccatgagccaaggaatgtgtgtggtctctagaaactaaataaagtgaggaaatggattattttttggagtcttcagaaaggaacacagccctgccaacactttgatcttagcccagtgaggcctgctttggacttgtaacctacagaactttaaaatagtaagttgtattgttttaagcccctgtatttgtggtaatttgtaacagcagctataaaaaaaaataaagtctcttaatccaagttgataacgccacttgtctgaagtacttactgcagtaatcttacggatttccctgcttccagttctgtccttccacaacccacaattgttcagagttgtcctcttgaaaaataccaggtcagtgatatttcgtggctcaaaactatccaatgaatccatggcccatagcatgaaacccagaattctaaatggccccttttcaacctcttatcacactactttctctctcatgggccccgaagttccccctcagagataaagtttctgatttttataattgcttgcttgatattttttcataacgtgactgcctaggtataatttgattttgtcagtttcttaaacattatataagtaggataatacagtaactattttttataattattatactttaagttctagggtacatgtgcacaatgtgcaggtttgttacacaggtatacatgtgccatgttggtttcctgcacccattaactcgtcatttacattaggtatttctcctaatgctatccctccccctgaccccaccccatgacaggcctcagggtgagatgttccccaccctgtgtctaagtgttctcattgttcaattcctacctatgaatgagaacatgtggtgtttggttttctgtccttgggatagtttgctcagaatgatggtttccagctgcatccatgtccctgcaaaggacatgaactcatccttttttatggctgcatagtattccatggtgtatatgtgccacattttcttaatccagtctatcattgatggaaatttgggttggttccaagtctttgctattgtgaatagtgccacaacaaacatacaagtgcatgtgtctttatagtagcatgatttataatcctttgggtatatacccagtaataggatggctgggtcaaatgataattctagttctagatccttgaggaattgccacactgtcttccgcaatggtggaattagtttaccaccccccccaccaacagtgtaaaagcattcctatttctccacatcctctccagcatctgttgtttcctgactttttgattatcgccattctaactagcgtgagacagtatctcattgtggttttgatttgcgtttctctgatgaccagtgatgatgagcattttttcatgtgtctgcgggtgcataaatgtcttcttttgagaagtgtctgttcatatcctttgccctctttttgatggggttgttttcttcttctaaatttgtttaagttctttgtagattctagatattagccctttatcagatgggtagattgcaaaaattttctcccattctctatatttcccattcactctgacagtagtttcttttgctgtgcagaagctctttagtttaattagatcccatttatccagtttggcttttgttgccattgcttttgatgttttagtcatgaagtccttgcccatgcctatgtcctgaaaggtattgcctaggttttcttctaggatttttatggttttaggtctaacatttaagtctttaatccatcttgaattaatttttgtataaggtgtaacgaagggatccaatttcagctttctacatatggctagctagttttcccagcaccatttattaaatagagaatcctttcccatttcttgcttttgtcaggtttgtcaaagatcagatggttgtagatgtgtggtgttatttctgaggcctctgttctgctccattggtctatatatctgttttggtaccagtgccatgctgttttggttactgtagccttgtagtagagtttgaagtcaggtagcgtgatgcctccagctttgttctttttgcttaggattgtcttggcaatgtgggctcctttttggatccatatgaactttagttgtttccaattctatgaaaaatgtcattggtagcttaatggggatggcattgaatctataaattaccttgggcaatatggccattttcaccatattgattcttcctattcatgagcatggaaggttcttccatttgtttgtgtcctcttttatttcgttgggaagtggtttgtagttctccttgaagaggtccttcacatcccttgtaagttggatttctaagtattttattctctttgtagcaattgtgaatgggagttcactgatgatttggctctctgtctgttattggtatttaggaatgcttgtgatttttgcacattgattttgtatcttgagactttgctgaaattgcttatcagcttaaggagattttgggctgagacgatggggttttctaaatataaaatcatgtcatctgcaaaaagggacaatttgacttcctcttttcctaattgaatacctttatttctttctcttgcctgattgccctggccagaacttccaacactatgttgaataggagtggtgagagagggcatccctgtcttgtgccagttttcaaagggaatgcttccagtttttgcccattcagtatgatgttggctgtgggtttgtcataaatagctcttattattttgagatacgttccatcaatacctagtttattgagagcttttagcatgaaggctgttgaattttatcaaaggccttttctgcatctattgagacaatcatgtggtttctgtcattggttctgtttatgtgatggattatatttattgatttgcatatgttgaaccagccttgcatcccagggatgaagctgacttgatcgtggtgcataagctttttgatgtgctgctggattcagattgccagtattttattgaggatttttgcatcaatgttcatcagcgatactggtctaaaattctctttttttgttgtgtcactgccagcctttggtatcaggatgatgctggcctcataaaatgagctagggaggattccctctttttctattgatcggaatactttcagaaggaatggtaccagctcctctttgtatctctggtacaattcggctgtgaatccgtgtggtcctggactttttttggttggaaggctgttaattattgcctcaatttcagagcctgttattggtctattcagagattcaacttcttcctggtttagtcttgggagggtgtatgtgtccaggaatttatccatttcttctatattttctagtttatttgcatagaggtgttcatagtattctttgtatttctgcgggatcagtggtgacatcccctttatcatttttattgcatctatttgattcttctctcttcttctttagcagtcttgctagcagtctatcaattttgttaatcttttcaaaaaatcagctcctgaattcattaattttttgaagggttttttgtgtctctatctctttcagtgctgctctgatcttagttatttcctgcattctgctagcttttgaatttgtttgctcttgcttcactggttcttctaattttgatgttagggtgtcaattttagatctttcctgctttcttgtgggcagttagtgctataaatttccctctacacactgctttaaatgtgtcccagagattctggtacattgtgtcttttttctcattggtttgaaagaacatctttatttctgccttcatttcattatttacccagtagtcattcaggagcaggttgttcagtttccatgtagttgtgcggttttgagtgaatttcttaatcctgagttctaatttggttgcagtgtggtctgagagacagtttgttgtgatttctgttcttttacatttgctgaggagtgctttacttccaactatgtggtcaagtttggaataagtgcgatgtggtgctgagaagaatgtatattctgttgatttggggtggagagttctgtagctgtctattaggtctgcttggtgcagagctgagttcaggtcctggatatccttgttaaccttctgtctcgttgatctgtctaatattgatagtggggtgttaaagtctcccattattattctgcgggagtctaagtccctttgtaggtctctaaggacttgctttatgaatctgggtgttcctgtattgggtgcatatatattaaggatagttagctcttcttgttgaattgatccctttgccattatgtaatggccttctttgtctcttttgatctttgttggtttaaagtctgttttatcagagactaggattgcaacccctgcttttttgccttccatttgcttggtagatcttcctccatccctttattttgagcctatgtgtgtctctgcacatgagatgggtctcctgaatagagcacactgatgggtcttgactccttatccaattttccagtctgtgccttttaattggggcatttagcccatttacagttaaggttagtattgttgtgtgttaatgtgatccagtcattatgatgttagctggttattttgcccattagttgatgcagtttcttcctagcattgatggcctttacaatttggcatgtttttgcagtgtctggtacaggttgttcctttccatgtttagtgcttccttcaggagatcttgtaaggcaggcctggtggtgacaaaatctctcagaatttgctgtctgtaaaggattttatttctccttcacttatgaagcttagtttggctggatatgaaattctgggttgaaaattcttttctttaagaatgttgaatattggcccccactctcttctggcttgtagagtttctgccaagaaatccactgttacactgatggtcttccctttgtgcgttacccaacttttctctctggttgcccttaacttttttcccttcatttcaaccttggagaatctgattcccttccaaaatggccaaataggaacagctccagtctgcagctcccagtgtgatcaacgcagaacacgcatgattactgcatttccaactgaggttcctggttcatcacactgggactgttggacagggggtgtagcccatggagggcaagccgaagcagggtggtgcattgtctgaaccaggaagtgcaagggttcaggggatttccctttcctaaccaagggaatccgtaccttcgccaaagactgtacctggaaaaacaggacactcctgcccaaatactgtgcttttccaatggtcttagcaaacggcacaccaggagattatatcccatgccgggttcagcaagtcccactcccatggagccttgctcactgctagtgcagcagtctgagatcaacctgcaaggcagtagcctgtcagggagaggggcatctgccattactgagccttcagtaggtaaacaaagcagcctggaagctcaaactgggcggagcctaccacagctcagcaaggctactgcctctgtagactccacctatgggggcagggcatagctgaacaaaaggcagcagaaacttctgcagacttaaacgtccctgtctgacagccctaaagagagcagtggttctcccagcatggtgtttgagctcagagaacagacagactgcctcctcaagtgggtccctgacccccgtgtagcctaactgggagagacctcccagtagtggccgactgacacctcatacaggcaggtgcccctctgggacgaagcttccagaggaaggattgggcagcaatatttgctgttctgcaatatttgctgttctgcagcctctgctggtaatacctaggcaaacagggtctggagtggaccaccagcaaactccaactgacctgcggatgactgttagaaggaaaatgaacaagcagaaaggaatagcatcaacatcaacaaaaaggacaaaaaaggacatccacaccaaaaccccatctgtatgtcaccaacatcaaagaccaaaggtagagaaaaccaaaaagatgaggagaaaccagagcagaaaagctgaaaactctgaaaaccagagtgcttcttcctcctccaaaggattgcagcccctcgccagcaacagaacaaagctggatggagaatgacttagaagagctgacagaaataggcttcagaaggtcggtaataacaaacttctctgagctaaaggaggatgttcgaatccatcacaagaaagctaaaaaccttggaaaaagattagatgaatggctaactcgaataaacagtgtagagaagaccttaaatgacctgatggagctgaaaaccatggcacgagaactacatgactcatgcacaagcttcaatagccgatccaatcaagcagaagaaaaggtatcagtgattgaagatcaatttaatgaaataaagcgagaagagaagtttagagaaaaaaagagtaaaaagaaatgaacaaagcctccaagaaatatgggactatgtgaaaagaccaaatctatgtgtgattggtgtacctgaaagtgacggggagaggggaaccaagttggaaaacactcttcaggatattatccaggagaacttccccaacctagaaaggcaggccaacattcaaattcaggaaatacagagaacaccacaaagatactcctcgagaagagcaatcccaagacacatacagtaactattttttttagtatgactttcactcaacagtatcattaagaatcatgtgttgcatgtagctggggtctgttcattttcattctaataactcacctttgaattctttttgatgtgttatgtaatttgtagcactacataatttgtagatgatgtgatttacagataattgcatcatatgtaaataagaaaatatttttttttccaaaaccacttttatttcttgttctttcttgattgcactgtaaatgacctcaattatgatagtgaattgaaatggtaacagccactgtttttatctcattctcaatttcagaaagaaatgtttcagaaggtcattattagggatgagctttattgaaagttactttttgttttgtttagatttgtagatagcattcctcagagtaaggaatttctctcctgtttgctaaatatttgcaaaattaaaaaattaaatgtttgctaaatagggtgatagacccgtgatgcgtcgtgatgtcttatttaaggggaatgcgtgggcaatcttagtttcatggccgtgaggtaggaaccagatgccggatacagttcagtatagctacccccaagtgttacgggcccagagcgaggagagtagcacacttgcgtgggatattgatttcacggaggatggtgagtgagaaaccactaaatatttgctaaatattttggcatggatgaatgttgaaatttatataatgatttttctatatttattaagatgattatatcacatgatttttctcttttaatgctatgatcttacaaaatggtttctgttctttccaattctatatttttccctgttttttgccttttgttcaattgattgcatagtttttattattccatttcgtccctctatgagtttataaatcatatactctttcagaatactcacattagtgtacagttgggcaaaatcatccaacacaaagcctgttttgtattgaataccgtactgaaagtgaaaaaaaggatagttctattggtaatcaaagtataatttccactgactcagtatcactttcacaccatcgtaaagtcaaaaaatcttaagttggagactgtctgtagacacattgttcaataaatatcagaaagtgtaaaacatcatacaatgaaaagtccttttcctgctttagacctgcattcatccagtttccatccctctcaacataatgtgttactttttaaagttttcatactgatctttcccgaaatatttcatgcatatgtaagtcaatataatcattttgtattagtctgttctcacactgctaataaataaatacccgagactgggtaacttataaaggaaagaggtttaagtgactcacagttccacatagctggggaggcctcacaatcatggtggaaggcgaaggaggagcaaagtcacatcttacatagcagcaggcaagaagagagcgtgtgcaggggaactcccctttaaaaccatcagctcttgtgagacttattcactatcatgagaacagcatgggaaagacctcaccctgtgattcaattgcctcccaccaggaccctcccatgacacgtgggaatgatgagatctacaattcaagttgagatttgtgtggggacacagccaaaccatttcaaatatgttactactcttccatttttaagtaagtgatacatactttacacatgattatgcatcttcctttttaccttatatatttaaaagcatttcatagctacacatagaaaaatctttattttttcaataatgtatacgtttgtcccatattatatattatacttaaatcagtcccttacttataacattttgtgttgtttctgatcctgtgtttttataaacctacaaacataatacagatgtcattttgcacatgagagttattatctgtagaataaatttctggaagtggagtgctgagtctacaagcaggtgcatctgtcatcttgatagataatgtcacttgccctccatatgggttataccattttgcactcccatcatcaataattgagtctgcttatttttacctatcctcacccacagtgcctaatacatttagatttttgtcactttgaaactaagaacaataattctgtgtaactttttttttgtaattatgagtgacagtgatcatattttcataagtttaagagagatgtgagattgttcatctcttttgcccatttttccattggtctgttggtccttattgatcaaaaaatgatcattctctagcaagggtattagtcaattgtctgaacaaatgtttttcctagttcatgaaatgtatttgaattttttgatgggtagggtttttctgctttgtgttatttgcttgcttctggttttgtttggtatatagacaatttttctttgtatatggtagaatttttcataattcctacagtgtttgtcagtgttcttcagacaaacagaaccaataagatatatataattatataaagaaacttatttaaaaggaatcagctcatacaattaaggagtttggaaaggccaaaacctgaaggatggcctggcaggtgagagacccatggaagagtggatgttgtagttccagtatgaagattgtctactggcagaatttcctcttactcaggaagcagtcaggtttattattattattattattattattattattcaggcaagtaattggcccatctaccttatgaaggttaatctgctttacttgaagtccactaacttaaatgataatctcatccaaaaacaccctcatggaaacatcaagaataatgtttgaccaaatatctgaggactgtgacccagtcaaattgacacataaaattaactatcacacaccctttatggcttctgaatttttgtgtcatttttggaagatccacccccactccaaagttataaaaaaatcccatttttatctctagtgcattatgatttcatttttaataggtatatcttaaattctcatgaaatgtttcttgtgtgtgtaaccagactcaattgtccaaatattgtggattcaatataatcatgatcatcttcttctgatttaagatgccaaccttttcctaaagtttcatgtgcatttagatatctttccaagttttatgttctgtttggattattagccttattatgaaacagaaccagactgctttaattattgaatatttatagaatattttaatttctgataaagttagtctttgctctcttatttggtttctttactattctagtatataagaataaaaaaacaactaattttattacactaaaatgccatgtgccatactggtgtttctattagattcaaattaaaattacaaattagtgaagattgacatcttttttaaatcttcatttctaaaaatgtagtatgtcttttcatttgttgaagtattcttttgcttttcacttttttttttttttttttttttagaaataaggcctcgctctgtctcccaggctggattgcaatggtgcaatcatagcgcctcaaactcctgggctcaaagtgatcctcctacctttgcctcccaagtaactaggattatagacatgcatcaccacactcagttgattttttaaatttttttgtagagaagaggtttctcttcccaggcaggtctcaaacacctggcctcacgcaattctcccaccttggtctcccaaagtgttgggttccaggcatgagctactgtgccaggcttcttttgtattctttagagctatttcagaagcttctttcttcttgatataagtctgtaaattttcttggtacatttttgcatagttattttattatttttgttgctgtcataagtgtgggtctggtgtgaaggttattgaattctgtatgttagtttataacctgatacatttctgcattttcatactgcttgcagtatgaaatataagataacagtcttataatttcttctcttttccaattttcatatctgtaagttttttctttctttcttttttttttttttttttttttttttgaggcagagttttgctcttgttgcctaagctggagtgcaataacgtgatctcagctcactgcagcaacttccgcctcccgggttcaagttattctcctgccttagcctcctgagtagctgggattacaggcatgcaccaccatgcccggctaattttttgtatttttagtagaaacggggtttcaccatgttagccaggctggttttgaactgctgacctcaggtgatctgcctgcctcagcctcccaaactgctgggattacaagcgtgagccaccgtgcccaggctttctcttaaaatttcatgagattctaagtctagtacgttattaaataataaagttaatacttaatatccttttcttatgaggatacttctagtatttctccattaattttaacactagctttgggatagaagtagatacattatcccatagttaagctactattcattgatgattattttcttgagtgtttataaagaatggatttggatcattcaaatgattttttgtatctatggagattattatattactttcccttactgaaataaaagttatatctatatatttcttgatattgaacaccacctttccatatctggagtaaactgcacttggtgagagtgatatttttaattcagcagggtgagaatgtttagtgaagcattatacgttcaaaaatttgaaataatctacaggttcattaacagataaattggagttactttaataggtggatatatgtaagtgggattaatattgtatgtgaatggagattaacagattataaacatatgtagcaaggtagataaatcttataactttgcatcctctgacccctcccaaaagaaaagcagacacaaaagaatatgtactgtgtgatatgatttgcataaagtttaaacatgagaaaatttaaatgatagtgtttaggaatgcgtattttaaggaaataattatcataaaagtcaaaatattagttacctttaaaaaacagagtgggactgggcacggtggatggctcacgcctataatcccagcactttgggaggctgagatgggcagattgcttgagctcaggagttccagaccagcctgggcaacatggtgaaaccccatctctactaaaaatacaaaacttagccgggcttggtggcacatgtctgtaatcccagctacttgggaggctgaggcacaagaatagcttgaaacccggaggtggagactgcagtgagttgagattgcaccacagcattccagcctgggcgacaaagcgagatccatctcaaaaaaataaaaaattaaaataaaaaaattaaagaagaaagacagagacagagacagaaagtgattgggcaaatgagggacttccagggtgctgatatgtttaaattcttgacctgggtagtatttgcaaaagtatgtgctttataataattcatggagttttacatttatatttaatgtatttttctccatatgtgcatattgcattatgaaaagaatttaaaaattatttgcttataatttatttaaaattttcacatcactattcaggagtgaagatgtctatagttttctcctgtttttattctttttttgaggtttgatatgttgattatataaaaagaacttgaagatttccattatttgtcttggctcagaaaatgttaaaaaatcactgtataattacccattctttaaagatttaataaaagttccctgtgccttcatctgagcttgttgtttttcttgttcattgaagagatagagattgtaaaatttggcccatttaggtttttgcaatactatgggtcacatttgataaattatgttttcttagaaaattgtctattttatctaggttttgtatatttgcatcaaaataaataaagtaatgctgtacgatcttttaatttcctctatttttatagtcccccctgagcccccatatcatttactggttgtgaatttgtaccttctcctgttcctccttgattaatgaaactaacagttttgggatttttttttaagaaccaacattagcctttctttataaatttatctgatgattcgtctaattcaatccttctcaaactttgatctctatacaaatcacctggagaccttgttaaaatactgattctgatttagtaggtctgagttggggcctgagattctgcatttgtagcatgttgccagtgatcccaacattgctggcccctactttgagtaataaggttctagcacatctatttattcttttatatgtttctatctatattaatctctttcttcacttatttttctaatttcctgaaagatatttaatacatttctttccactttatttttcattactaataagttttttatttatagttgacataataattgtatatatttatagagtgcagtgttatgttttaatgattgtataccttgtataatgatcaaatcaggttaattaccgtatttgttactttaaacatttatctctctttgtggaaatatcatacaaaatcttctctttttgctgtcttgaaatgtacacaacattgttatttattacagttgcctagctgtgttataggacaccagaactattcttcttgtctaactataactttgtacccactgaccaacctctccccgtcgtgctatcccctacacctaccttccccagcctctgataacctctactctctatttctatgaggtcaacttttttagagtacacaaatgagtgagatcatgcagtgtttgtccttctgtgcctggcttacttcacttaacataatgtcctctaggtttatgctgccacaaatgatagaatttcgttctgttttatgactaagtagcattccattgtaaactattccattctatacaccacattttctttatccattcatctatggataggcatttagattgattctatatctttgctattgtgaatagcactgcaataaaaacaggagggtagctatctctttgacacaaatgatttcatttcctttggatatatataataatggcattgctgtatcatatgatagttctatttttaattgtttgagaaacttctgcatccttttccataatggctatattaatttacattattaccaacaagtcataagagttctcctttctccacattctctccagcatttgttattttttatctttttgataacagccgttctgactagggtgaggtaatagctcatagtagttttgatttgcatttccctgattattagtgatattgaccattttttgtcatatacctgttgactatttgtatgtattcttttgagaaacatctcttcaagtctgttgcccattattaatcacattgtttgttattttgttattgcattgagttccttacatattctgcatattaaccccttgttagatgcatagttcacacatactttctcctattctgtaggttgttttttcactctgatttttttcctgtgctgtacagaagctctttagtttgatgtaatcccatttgtctatttttgcttttgttgtctgtgctgtagaaatactcgacaaaatactaagaaaccaatctcatcaacacattaaaaagatgattcaccatgatcaactgattcatcccagggatgcaaggatggttcaatatatggaagttagtaaatgtgatacatcacattaacataaccaagaataaaaactctatgatcattttaatagatgctgaaaaagcattcaataaaattcaacgtcctttaacgacaaaaactcttaacaaattgcatatcaaaggaacatgcttgaacacagtaaaggccacataggacaaattcatagctaacatcatactgaacagggaaaaattgaaatcttttcctctaagacttgaaacaagacaagaatgcccacttttaccacttacattaaacacagtactggaagttctaggcagagccattaggcaagagagagaaataatggacatccaaatctgaaaggaggaagccaaattgtccctggttgcagatgacatggtcatatttatagaaaactccaaagattgcaccaaaaaactgttagaactaataaataaatttagtaaatttacagaatacaaatcaacatataaaaattagtagtatttctataaaccaatagcaaactctctgaaaaagaaatcaagaaagcaatttcatttgcaatagctaaagaaaaaaacctaggaataaacttaactgaggaggtgaaagatccctatagtaaaaactataaaacatggatgaaagaaattgaataagacacaaaaaaaatggaaaggtaacatgtgattatggattggaagaattaatatttttaaaatgttcgtattacctaaagctagctgcagattcaatgcaatccctacgaaaataccaaagacattctttacagaaatggaaaaaaaaatcttaaattcatattgaaatgcagaagactctgaatactcaaagcaatctggagcaaaaaaataaataaataaagcaacaggtatcacactacctgattttaaaatacactacaaggctatagtaatcaaaacagcatggtactggcataaaaacagacatatagaataatgaaacagaatagagaacccagaaataaatctatgcatttacaaccaattgattttcacaaagatgccaataacatacattgggggaaagagcagcctcttcaataaatggtgctgggaaaagtgattatattcagaagaatgaaactagactcctacctctcacgatatgcaaaaatcaactcaaattaagactgtaatgtaagactgggcatggtagctcatgcctgtaattccagcattttgggaggccaaggcgggcagatcacctgagatcaagaattcgagaccagcctggccaacatggcaaaaccccgtctctactgaaaatacaaaaattatctgggtgtggtggcaggtgcctgtaatcccagctacttgggaggctgaggcatgataatcagaggcatgataatcacttgaatctgggaaactgaggttgcagtaagccaagcttaccccattgcactccagcctgggggatagagtgagactctgtctccaaaaaaagactgtaatgtaagacccaaaactatgaaactactagaagaaaacataagggatatgcttcacaaaattggactgagcaaggatctttttaataagacctaagaaggacagacagcataactattttatttattaataatttattaattaagattaattttaaaaattaacatgaaattaatgatttattaatatacatgtttctatgaatttccataagtcctgctttaatagtatgtagtaggttttgacctacatactgtggtatttttatgatttctttctctagatattttgatatttcaatatttgtaccctgtctgagctaagagttgtcataacagaaaactttttaacatttaggtgctattgaccattgttttctgaattttgttaatttctcattttttgcattgatgatactgtttctacttcttaaaatttgttgaagttttctttgaggcctagtgggtggttaatttctatgactgttacacataaaggtgtatacttcattatcaaggtatattttgaggcatatcaattagactatatctatgtcatttagcactatatattttgctacttagtacttctacaccttgactaatttttcctactggatgtgtcaaaaacagaaagaagaaaattaaagcctctttaaatgggggaaagaataggtttttcaacaaatgctacctggacaactgcatatccatatgaaaagaagggaatggaaccacctttccactccatacacaaaaattaactcataatgaatcaaagagctaaatgtaagaaatagcactatgaaattctcaaaagaaaatgtaggtataaatctttatgaccttgattaggtatggattcttagatgtgataccaaaaacacaagcaacataagaaaaaatagagaaagtggaaataatcaaaattaaaaacgtttttccttcaaaggataccatcaagaaaataaaaaaataacccaaggatttggagaaaattttaacaagtcatatatgtgataagggacttgtatttaaaataatatgtaatgaaaaaggggggcacattccaagatggccaaataggaacagcttcggtctgcatctcccagcgtgatcaacacagaagacaggtgatttctgcatttccaactgaggtacctggttcatctcactaggactgcttggacagagggtgcagcccagagagggcgagctgaagcagagcgggcatcgcctcaccagggaagcatgaggggtcgggggatttccctttcctagccaagggaagccgtgacagactacctggaaaaatggggcactcccacccaaatactgtgcttttcccaaggtcttagcaactggcagacaaggtgattctctcctgtgcctggctcgatgggtcccacacccatagagccttgctcactgctagcacagcagtctgagatcaatctgcaaggctgcagcgtggctgggggaggggcatccaacattgctgaggcttaagtaggtaaacaaagcagcctggaagctcaaactgggtggggcccaccacagcttgacaagacctactgcctctagactccacctctgtgggcagggcatagctgaataaaaggcagtagacaacttctgcagacttaaatgtccctgtctgacagctctgaagagagcagttgttctcccagcattgcatttgagctcgagaatggacagactgcctcctcaagtgggtccctgacccccttgtagcctaactgggagacacctcccagtaggggccaacagacacctcatataggtggctgcccttctgggacaaagcttccagaggaaggatcaggcagcaatatttgctgttctgcaatatttgctattctgcagcctacattggagatacccaggcaaacagggtctggagtggaactccagcaaactccaacagacctgcagctgagagacctgaccgttagaaggaaaactaatgagcagaaaggaatagcatcaacatcaacaaaaaggacatccacaccaaaaccccatccataggtaaccaacatcaaagaacaaaggtagataaaaccacaaagatggggagaaaccagagcagaaaagctgaaaattctgaaaatcagagcacctcttctcctccaaaggatcacagctcctcgccagcaatggaacaaagctggatggagaatgactttgatgagttgacagaagtagtcttcagaaggtcggtaataacaaacttctctgagctaaaggagtatgttcaaacccatcgcaaggaagctaaaaaccctgaaaaaagattagatgaatggctaactagaataaacagtaaagagaagaccttaaatgacctgatggagctgaaaaccatggcatgagaacttcgtgaagcatgcacaagcttcaatagctgaatcaatcaagtggaagaaagggtatcagtaactgaagatcaaattaatgaaataaagcaagaagacaaggttagagcaaaaagagtaaaaagaaatgaatgaaacctccaagaaatatgggactatgtgaaaagaccaaatctacatctgattggtgtacctgaaagtgatgggcggatgaagccaagttggaaaacactcttcaggatattatccaggagaacttccctaacctagcaaggcaggccaacattcaaattcgggaaatacagagaacaccacaaagatattccttaagaagagcaaccccaagacacataattgtcagattcaacaaggttgaaatgaaggaaaaagtataagggcagccagaaagaaaggtcgggttacccacaaagggaagcccatcagactaacagcagatctctcagcggaaagcctaaaagccagaagagagtgggggccaatattcaacattcttaaagagaagaaatttcaacccagatttcatatccagccaaacaaagcttcatacgtgaaggagaaataaaatcctttacaggcaagcaaatgctgagagattttgtcaccaccaggcctgctttacaagagctcctgaaggaggcactaaacatggaaaggaacaaccagtaccagccactgcaaaaatatgccaaattgtaaagaccatcgatgctaggaagaaactgcatcaattaacaggcaaaataaccagcaaacatcataatgacaggatcaaattcacacataacaataataactttaaatgtaaatgggctaaataccccaattaaaagacacagactggcaaattggataaagagtcaagacccatcagtgtgctgtattcaggagacccatctcacatgcaaagactcacatagactcaaaataaagggatggaggaagatctaccaagcaaatagaaagaaaaagaaaaagcaggggttgcaatcctagtctctgataaaacagactttaaaccaacaaagatcaaaggagacaaagaacaccattacataatggtaaagggatcaattcaaccagaagagctaactatcctaaatatatacgcacccaatacaagagcacccaggttcataaaacaagtccttagagatctacaaagagacttagactcccacacaataataatgggagattttaacaccccactgtcaatattagacagatcaacaagacaagttaacaaggatatccaggacctgaactcagctctgcaccaagcagacctaatagacagctgcagaactctccaccccaaatcaacaggatatacattcttctcagcaccacgtcgcacttattccaaaattgaccacatagttggaagtaaagcactcctcagcaaatgtaaaagaacagaaatcacaacaaactgtctctcagaccacactgcaatcaaattagaactcaggattaagaaactcactcaaaaccacacaactacatggaaactgaacaacctgctcctgaatgactactgggtaaataatgaaatgaaggcagaaataaagatgttctttcaaatcaatgagaacaaagacacaacgtgtcagaatctctgggacacatttaaagcagtgtgtagagggaaatttatagcactaactgcccacaagagaaagcaggaaagatctaaaattgacaccctaacatcaaaattagaagaactacagaagcaagagcaaacaaattaaaatgctagcagaaggcaagaaataactaagatcagagcagcactgaaagagatagagacacaaaaaacccttcaaaaaattaatgaattcaggagctggttttttgaaaagattaacaaaattgatagactgctagcaagactaataaagaagaaaaaagagaagaagactcaaatagatgcaataaaaaatgacaaagtggatatcaccatcgatcccacagaaatacaaactaccatcagagaatactataaacacctctacaaaaataaactggaaagtctagaagaaatggataaattcctggacacacacaccctcccaagactaaactaggaagaagttgaatctctgaatagaccaataacaggctctgaaattgaggcaataattaatagcctaccaaagaaaaaaattccaggaccagaaggattcacagccaaattctattagaggtacaaagaggagctgttaccattccttctgaaagtattctaatcaatagaaaaagagggaatcctccctaactcattttatgaggccaacatcatcctgataccaaaggctggcagagacacaacagaaaaagagaattttagatgaatattcccaatgaacatcaatgcaaatatcctcaataaaatactggcaaaccaaatacaacagcacatcaaaaagcttatgcactacgatcaagtcagcttcatccctagcatgcaaggctgtttcaacatacacaaatcaataaatgtaatccatcacataaacagaaccaatgacagaaaccacatgattatctcaacagatgcagaaaaggccttcggcaaaattcaacagctttcttgctaaaaacacgcaataaactaggtattgatggaacgtatctcaaaataataagaactatttatgacaaacccacacccaatatcatagtgaatgagcaaaaactggaagcattcgctttgaaaaccagcacaagaaaacgatgccctctcacaccactcctgtgcaacatattgttggaagttatggccaaggcaatcaggcaagagaaagaaagaaagggtattcaattaggaaaagaggaagtcaaattgtccctttttgaagatgacatgattgtatatttagaaaaccccatcatgtcagcccaaatctccttaagctgataagcaacttcagcaaaatctcaggatacaaaatcaagtgcaaaaattacaagcattcctatacactaacagacaaacagagagccaaatcatgagtgaactcccattcacaattgctacaaagagaataaaatacctagaaatccaacttacaagggatgtgaaggacctcctcaaggagaactacaaaccactgtacaacgaaagaaaagaggacacaaacaaatggaagaatattccatgctcatggataggaagaatcaatatcatgaaaatggccacactgcccagggtaatttatagattcaaggccatccccttaagctaccaatgaccttctttgcagaattggaaaactactttaaagttcatatgaagcaaaaaagagcccgcattgccaagtaaatcctaagcaaaaagaacaaagctggaggcatcatgctacctgacttcaaactatactacaaggctacagtaaccaaaacagcatgatactggtaccaaaacagatatatagaccaatggaacagaacagaggcctcagaaataacaccacacatctacaatcatctgatctttgacaaacctgacaaaaacaagaaatggggaaagaattccctatttaataaatggtgttgggaaaactggctagccatatgtagaaagctgaaattggatcccttccttataccttatacaaaaattaattcaagatggattaaagacttaaatgttagacctaaaaccataaaaaccctagaagaaaacctaggcgatacctttcaggacataggcatgggcaaggacttcatgactaaaacaccaaaagtgatggtaacaaaagccaaaagccaaaatagacaaatgggatctaattaaactaaagagcttccgcacagcaaaagaaactatcatcagagtgagcagacaacctaaagagtgggagaaaatttttgcaatctacacatttgacaaagggctaatttccagaatctacaaagaacttaaacaaatttacaagaagaaaacaaacaaccccatcaaaaagtgtgcaaagatatgaacagacacttctcaaaagaagacatctatgcagccaacagacacatgaaaaaatgctcatcatcactggttattagagaaatgcaaatcaaaaccaccatgagataccatctcaccccagttagaatggcaatcattaaaaagtcaggaaacaatagatgctagaggatgtggagaaataggaacacttttacactgttggtgggagtgtaaattagttcaaccattgtggaagacagtgtggtgattcctcaaggatctagaactagaattaccatttgacccagcaatcccattactgggtatatacccaaaggattataaatcatgctactataaagacacatgcacacgtatgtttattgtggcactattcacaatatcaatgacttggaaccaatccaaatgtccatcagtgatagactagattaagaaaatgtggcacatatacaccatggaatactctgcagccataaaaaaataaaggatgagttcatgtcctttgtagggacatggatgtgactggaaaccatcattctgagcaaactatcccaaggacagaaatccaaacaccacatgttctcactcataggtgggaattgaacaatgagatcagttggacacagggcaagggaacatcacacactggggcctgttgtggagtgggggactgggggagggatagcattaggagaaatatctaatgtaaatgatgagttgatgggtgcagcaaaccaacatggcatgtgtatacctatgtatcaaacctgcaccttgtgcacatgtaccctagaacttaaagtataataataaaagcaaataaacaaataaacaaaatcaataataagaaaatttttaaaaagtagctattacaattcaataatacaaagacaaataactcaattttaaaatgagcaaaggatttcaaccaacatttctccaaagaagatataaaatgttagccaaacacacgagaagattttcagcgtcattcatcattagggaaatgcaaatccaaatcacagtgagatatcatttgacaccagttaggttggctatattcaaaaagacaaaaaataacaagtgttggcaaggatgtgggaaaattggaaccctcatacgttgctggtcagaatgcaaaatgttgcaacctctttgaaaagcagcctggctgtttctcaaacgattaagaatagagttaccatgtggtccaacaattctaccacttgatatctacccaagagaaatgaaaacatgtccacacaaaagcttttgtatgaatgttcatagcagcaccagacacaacagcccaacagtggaaaaaacccaaatgtccataaattgatgaatagattaataaaatgtagtaacccatataatggaatattcatcagcaataaaaataaatgaagtacttgatgcttttgcctcacaactcttaagattctttcctttgtcctgactttagataatctgatgactatgtgcctaggtgatgatctttttgcgaagaacttcccagtgttcttagagcttgttgtatgtggacgtctagatctctagtaaagccaaggaagttttcttcgattagtccctcaaatatgttttccaaacttttagatttctcttcttccttagaaacaccaattattcttaggtttggatgtttaatatagtcccaaacttcttggaagcctttttcattaaaaaaatttttttttctttgtctttgacagattgggttaatttgaaagctttgtcatcaagctctgagattctttcttctgcttctttgattctattgctgagactttcctgtgcattttgcatttctttaagtgtgcccttgatttccagaagttgtgactggtttttatttatgctatctacttcactgaaaatttttcctttcatatcctgtatcacgtttttgattctgtcactatcttctgtgtccttgccaatattttaattaaattattcactctatggtcagttatcttcactttgttttctctgtgaagttatatttttgtgctcttattagagcatttatatttttattatattagttatctttatagttataaattgatcttagtcctctggtgtttgtttattcttactagttataactgtgaatattattatatttcttccttttctctccttttatctctggatccagcagcatactgattttagtcaataatttcttttctggtgtttgctttgatataactgtgtttctgatttatgacttgatttgccaactttaaatgaaatcctttgacttccagctgttttaaattaaacagtaaacacattttctcatcatttcaatttctttccctcttctcctctcaatgtttcagttatgttttatctgccactctaactcacatttttctagttttagtggtactgttaaatatatagtctccctcaatcttttccccaaacttattgattgactgaattttctcttttattggttcccacaaaaagacatcaacaaaataatattgctccagtttttgaactcttattaaaactattgtttgtagcccttatacttcaagaagagtttgcatatatattcttatctcaaagtctctttgcttgagaatctcatgggattgtatctggtattcagagttgctgtgtaaaaacaggaaggcagcctgaattcttctttcttgtaaaattgacctagtcttttcacctgtctgccgaaaggattctttatctttgaagcccagcaactttattgggatatgtctcattggtcattctgggtctttctttatttcttctattctatcacaccaactttgccattctcaacctctgtgaatctcctgtgatttttatactatctgattcttttgccccattttgtttttatttccttaattcttctattttttttttcttggactacacctttccttagttgtgcaagctcatatcttatctcttcctgctatgctaccatactttccctgaattattccattactgtgttatatatcatctttcatccaggtgatcactttaatttgaaggattttttttcctccaaattcatggcaagacatttgttcataactttcattggtatggtaatattttacagaaggatatactttattaatacattttttgccttttttcccttttgtcttggagtatagatataatttttattattcatctttgaatggttttcattttcctaagctctgtatttataagggctttcttgaggcaggaccaggtcagctttcctgtctagcatgcttgcccagtgcaaaggttcttcttttccacagtctccacaaaggtagaacgcttctcaaaaaaatgtgccttgtctttccaaatctttatttggccttgcttcttcttttttatgaaattcattatagtcccattagggtagaaggtcacatcctgcttctgccacacctttgccagcaaggggtacagcttctgactctcaagacatacccatcacttgcgggaaggaaattgttagtagtgtgttctgagatctgtcatggctggtctcctacaactgaggtcttgagatctgtctttagcctttcccaaattcttcccagaagaattcagttgcttttagaaaatcttaaaagtattttaagatttaggataaatacttaaaagtatttaaactctctcctgaagtttatttaacaactgagtttttgttctgagttttccattctttatttgccttagggtggttccagggagagaagtttggagaaggctgcatgacgcagccatgagtatacactgggagtttccactccatccccaatctccaccaaaaagacggtgcttctgaaggtatttttttccttctaatgccttagtttctttatacagtggccaaaaatagtacaagaatatcttcatggcaactacaggcattgctcattgtatggcaagctgatttatggaacttttccactacagaattgatggttctgagcatgaactcaaacagcagttacctgaaaatccagacacatgaggtcttatcccccaatctgtcagttctgtcagggtgaaatgtgcgccttctcagccttctgtcttctttggtgctcattgctaaatagttcagtagaaatgcctcagaggaatcatcttggtgctggctccaaggctctgtgcagtcagccaggctatgaaagaaggcagcctgtgccttctccagactcattcctgctccatcctcaacctaatcttcctgaatacactctccattcaagagccgatggaaaaatggatcactgacaaataacgaattattgtatgaattaacctcttgctggcaactgggcagtttgatagcagactcaaactgggtgatttgagaatttaataaagggactactaattcatcctatgctaatatgaaccctcatttagggttgagagagagtagccaagggatagtgcagtagttggggatttattaatggcagagagcctttaccatttcttgacctggaggggctaaatggcacaggaaacacccaagagtattgcatagctagggcttctggaaaggagcttcagccttcagtagtgggctataggctgtagaaggagggaagtagggaaaagaatctcaccctctctgtgtcaccttctcagctcctgccagtgcttctcattggccaaaccaaatcaacagccagatagcaaatggagttacttgattaagtcctcctatgatggggggaagacagtggatatggaggggcagaaagaaaataaacaaccctacagggatccaccaattgcttttattcagaataaaattttattcagaataaaatttcaaagctattttattctgtaccaaacattgcaaatgttggcttgcggaaagcaaatacaagattattctaaagaaaacattaagcctgaggccatatatcaattacaaggtgaattttagggctcaacacagttatatatcatcaagttcaaatgaacaaatgcctggatttgaatgctaaggcataggattatttcaatatgcacactctgagcattttctgaaaatcatcaagcttttattaccattttatcctaaatcccctgaccacttctcattcaatttgcatgaacaggcctcctctttccacccttattttaatcctggagtttcctaactcagccttctcctctgctaattctactccttctcatagacaggtaactttttctattctttgacatcagtttccacatcttctctagtgagatttcatactatttctttagctcagccctcccttatgaattctcagcccacagaacatagctgccaactggacattttcacctggatgctttatagacatcttaaatcatgttgaaaaactaactcattatcttaagcattcccaaacaaccttctaactcacgcgtgtgcgcacacacacacacacacacacacacagacaccctgcctattcctgaattctcaaacttttaaaatatttcatggccttcatttttgttttctaacaaaaatagataaatgtatgaatggaatgtttttttggcagagaaataagtaaatatttttaaaatttcttcagtgttttctacaatgaaaaggaaatcaacaatttctatactctacgtaggggtcagcttcccaaacccatgacccattagtaatcatcaacaccttatccctggtctcccatatcccggtggttataaattcatggttaaggcacatagctcatgtcttccctgcttggaactgtatgcccatgtctggcattaaaacagctatttcttgaatgagtaactctatgtcttttagctctatgctctaactatctccactgccagccctgcttcatctgattttagtcaataatttcttttctggtgtttgctttgaggacctatgtcaagatctgctgccaccaccttcacataggttctcagtgtcttcctcctatagcaccaaagggccttccagaggccttcctgcctccaaatattccctctctaatcctttctcttcactgcagccaattacctttctaaagggcaattgtggtccctctttaatttaattttattttatttgagaccggttctggctctgtcacccagtttggagttcgatggtgcaatctcagctcactgcaacctctgcctcccaggctcaagctgtcctgccacctcagcctcccaggtaactgggactataggtgcatgccaccatgcccagctaatttttctatttctttgtagagatgaattttcaccatgttgccaggctggtctcaaactcctgagctcaagttatctgcccacctcggccttccaaagtgctggtattacaggcatgagccactgagcccataaataataataagaaaactcactacttctgccttgctggctgggccacagacgattcctgtgtatttcccaaaacagtatgcacacacttgcatttgcaggttagagacaaagtatgtccactctaggttcttgctgcccttgagctaccttccagtttgctacctcctatctacaggactaagacccaagttcttagcatggaaatcagttttccttttcagcctcatttcctgccttacccatccactcacttagaacttggattcttcaacctcttacagtcccctaaaatgttttctgtgtgccatgccccttttgccttccccaggagttcctatttatgcttcaagaagcatctcaaatatcactccctccatgatgcctttgcgaactctctagcattagctgctccttcctctgatgttgtcctattttgtctatctctgtgttgtgcaataattacatctttacatttctgttggcccagcacaagccctacaggccagggctgtattgtagttttctttgtcatcctacccatcagtgccaaatttggaaaatagcaagaactcaatcaatagatgctaaactaatgaacactttattagcctacatttatggagcattcttggtacccattaaacagtttcatctctctcatatgtcagtgttatgtttcactgcagctttccctaaggaattttgtgagaaatatggagtattgcagcactattctttggtcacatgggggtttaattcctatttatacttttcttgtattactagaaataatgactgtaactacttatctggcaaatctctgaaatttctttttaaggaaattgttattgttggagaaatttgcaaagcccgactctgccagggctctattcctcatatctaagcagttaattctctactacgttacgtttagctttcggctctggaaacactctttgaatgcctcctttgtgcagatttatccaactctctcctctttctttcattaagcttgccctgtaaagccatattccttctgttttcaattgtgaatttatttcctctggagctttctgacttagaatctatttgaacttctatagaaactttggttgaaaaggaaaaaaagaaaaaaaagggcctatttttaaaggttttctctttcacctaatattagaggggatttctttgtgattaaacaaatttgttataaagtaacacacactgtgaaatatccaaacaactacaatgtcattataaatatatttttcttatcagagaaggcaacaggcaaatcagccactcttgcaaggtcatatttcacagagacagctgaattcacccactgttgaattatgttataaagccagtgatttagtattgtcatctattttgattgacaccaaaagccttccaggacagtaaatgtaaagatgttagaagaaaatcacttacaaaatggcttgatagttcatgttaatgagttttaaaatgcggtataacaacttaatcaaatcagacagctccataaaagaattaatttggtcattggctctctttccaaaatgactttgttgtactgagtaaggtgagaatttttctgtggctgaaacattcacaactagattcgaaatgacatagcctgggataagttatggattaaccaaagtttctcaggagttatttatatttggcctcttgttaaatgagatgcatgtcttttctgaagtttcattttaatgaaagagaaagaagaatatgaatgacatgtattaaagaccccgagcccacacttaaaacctcaattttggataacttgtgtgttaccttttagaaattagagtgtcattgggttgctattatgggtcgccaacagaaggggattcaggaatatctccatactgccccagaccacagcaataattttctgcaatgtcaagagaaaaacacaggacaataaccagttgaaagcagcaaagttctgcattattttttgctgtcctcttgtcccaaactctagaggagattattagaaacgtagtatctgcccctgtagaattatgggcttatgacaagactagagacctaaggagactagtttcttgtctatccgggctcaaacaccaacctctttcatgcacttccagactgaagttgtttctaaggtcagctttaaggagaaaattacatataatcagaattaccctccagaattcataaatcaccttccattggtatagatcactgtctcttggattgagcagcagattaagtagtcagattgcatttaggtttacattatataaaatttaatatgttttggctgggcgcagtggctcacacctgtaatcccagcactttaggaagccaaggtgggaggatggatagaggtcaggagttcaagaccagcttgggcaacatagcaagacctcatctctataaaaactttaagaattagctggacacagtggcacatgcctgtagtcccagatacttgggaggctggggcagaaggatcatttgagcccaggagtttgaggctgcagtgagctatgatcatgacactgcactccagtctgggtgacagaatgagaccgtgtctctttaaatattaggaatcaccttcagaatggcattgaaaggcaggaagtctgccaggcagtgcgtgagggaagagcagagtcatagactctcctcagactatcttattgacggacaagttacaggtacttttaaaatcagtctctccttcctctctctctctccttttctcagctttctgtctctctcctagagttaaattttaatgaaaaaaaataatgtgaattatttgtgtgttatatatgtgtaacatttctatgtatttatattattaatatgacataataatataatatttgtattattaatatttatttaaaaccatcagcacacacttagaacctccgttttgggtaatgtagttattaccaacattcctacctgacatttatttgtgtatttgttcagtgtatatctgtgtcttctgtgagactgtggggtttatgaagaaagggactatgtatcttttggctcaccatttcattcccacgactagcatggagccgaagaggagatgaaaacatttttatcaaatgaatggctaaaggagagagaccattagacattactacctttggaagttctcttagtaactgtggctcaatcatgttgcagtgttatagacacctttataatttacaaagaactttcacaaacatggcctcattataaaggtgacaagcatgattgtcccccataccagtctgtagaagaagaaactgagacttggagaggctaaccaacttgtgcaaagttgcacagctaacttatgacagaactaggtcttgaacccctgtcttctaacccttagccagaccagttggagttccccatccccagtgacctctcctacatttatggggactcttgtgtatcagagtttgtgactctgtgcccgtgtaaggcagtgatcacatcttgtccctcacaacagagatgtattaagtgcctactatgcgccagacatgcaaaaaacttccaggacgcaaacaagaatgagatgtatgtatttcttgccatcaaaacaactcacaatctaatgcagcatagtgttaaacatgtacatttctaatatactgttgaatatgtttgtggatgaaatcctatcctgcttgcagttgcaataatctgcaggttaaatggaaggaaaagcaaggcttgctggtttgcacaaacgttaacaactattagctcaagttcgaaacaagattgtaaccattctgcacaagtgttaaggagtgcatatttgcagagctgaggccaggaggcttaaattttagaaacagctgtggaactcctttcagtatgtacagttggaaggaggctggcattgtcagggagtcgctctggaaaatacaggcactgaatatattttatcttttcccttattccagtgttagtgtccccatagaattccaagtgagaaaataacctgcaaaggtgtgaggtgggaatcatattacaacattcaagcaggtgagatcctcagagatgaaaggggaagaaaatggcactttaatgcatgagagtaatcttccaggatttgtaccaggatgtgttatattttaacaagaagagttctcagaagggtcagtttcaggaacatcacatgaacccctggagaaaagtaaatggttgattggctgtcacacttactgtttcaatatgctgggtaaagcaaagcgaggaaaggtgaggtctcaccaagtgcagattacaaaacaaatgcattctttgtgtgcttttttcatagtagatgattttgaaacaaaaagagaaaaataaacctgttgagtagaaacttgggaagtaaaactgagtgatagaggattagttttcacatgtaggcggtacacagagtttgtacagtttcgtagttacaagacagggtagaatgaatatttaaagagaagactgttaggaacaatggttcagaaggatgaaggaactcaataaggttgtgagggattgagaaggaatgttttgcttgaaacatggagtatggcaacaatgaatgagcctagttttgaatcaaaatgacctgaaaaacttctgtagaaagtttccaacaaagcagtgctgtattatggaagatcctgccatatggattgaaacttttctagaacttttaatagacgagccctcataagtaagatccaggcaaccaaattactactctttgaatgctattgtgggtatcatgtcaagatccaatgttttctttccatgttatactaaagaaataaaacttaatgtctatagttcaggttatatttgaaactttaatagttctagattgaagctagcataaaaacactgtatactgagcatggtggctcacacctgtaatctcaatgctttgagaggccaaggccagaggatcacttgaggccaggagttcaagaccaacctgagcaacatagcgagaccccatctgatatggtttggctctgtgttcccacccaaatctcacctcaaattgtaataattcccatgtgttaagagcgagaccaggtggagataattgaatcatggtggcagtttcctctatgctgttctcatgatagtgacttctcatgagatctgatggttttataaggggcttcccccttttctcagcactcatcctccctcctgctgccctgcgaagaggtgctttctgccatgattgtcagtttcctgaggccttcacagctatgcggaactacgagtcaattaaacctcttttctttataaattacccagtcttgggtatttcttcatagcagcatgaaaacagactaatacagtaaattggtaccaggagtagtggatcactgctgaaaacatacccaaaaaatgaaaataaaaaattagccagacatgatggcatgctcctgaggtctagctattcaggaggctaaggcaggaggatcgcttgagcccagaagtttgaggttacagtgagctatgattgtgccactgcactgtagcctgggtgacagggtgagactttgtctctaaaaaagtgaaattaaaaaaaagaaagactccataaatgacattttaaagggaaaaaatgtttatgacaattatattgtatattcaaacaaaatgtattcttatttcataaccaatgaaaatctgtgttgactggaaaagagattaattatggtcactgagaagcagaatgtaaagcattatttgcaggaaaagaaagcctagtttcctttacatgccactcacatattggtattttctcattattagaacttacatttttttaagttcagagttttaaaattccccagagacttctgcaaaacctgaaccatcattgagtaatccatcaaaaatccagaggcattaaaagttccatgactaatatgtgtgaaatgtttgaagatgaaactctcttttgtaattatagaccgcagaatgtggaatagtttctgccgtttgaattacctacctgaggatactacttgaaagttccatcttccgtaaataacagccagcctgttatagaagacaggcagtgttttcatacctggaatagaaattattttagaatcatttccatgcaacattttttcattattactaagatctggtgactatgaaagggagtaaacttacacagctggctcttttcagacagagagattcaatttattcttgttccaatactgtaggaaaataaaaaggttaaaattaccttttggattcaatgtgatattttccctagatacctaaacaaatggaagacaggcagctttcccagctttggaataggggacagtaagggatttcccttgtagcgtgttgtgttttatctgaaatctggcccttttctgtaattaaaaaagggatttaggtactgaatttaatcctttaaatggccaatatcttgtaacttttccagatatttccctggttcatcaagaggcaagagacttactttaattctgatctaatatgtacctgccttttaattatgtgctaaaacaatttgggagatgggatggtttggtacaaacttgctcctgctgtggaaatggtgacttggttgatctaggttctggtccagaaatgtgcaggtttgggtttgttttttttttttcaattattatactttaagttttagggtacatgtgcacattgtgcaggttagttacatatgtatacatgtgccatgctggtgcgctgcacccactaactcatcatctagcattaggtatatctcccaatgctatccctcccccctgcccccaccccaccacagtccccagagtgtgatattccccttcctgtgtccatgtgatctcattgttcaattcccacctatgagtgagaatatgcagtgtttggttttttgttcttgcgatagtttactgagaatgatgatttccaatttcatccatgtccctacaaaggacatgaactcatcactttttatggctgcatagtattccatgctatatatgtgccacatttacttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcactgtggttttgatttgcatttctctgatggccagtgatgatgagcattttttcatgtgttttttggctgcataaatgtcttcttttgagaagtgtctgttcatgtcctttgcccacttttcgatggggttgtttatttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttttgttgccattgcttttggtgttttggacatgaagtccttgcccatgcctatgtcctgaatggtaatgcctaggttttcttctagggtttttatggttttaggtctaacgtttaagtccttaatccatcttgaattgatttttgtataaggtgtaaggaagggatccagtttcagctttgtacatatggctagccagttttcccagcaccatttattaaatagggaatcctttccccattgcttgtttttctcaggtttgtcaaagatcagatagttgtagatatgcggcgttatttctgagggctccgttttgttccattgatctatatctctgttttggtaccagtaccatgctgttttggttactgtagccttgtaatatagtttgaagtcaggtagcgtgatgcctccagctttgttcttttggcttaggattgccttggcgatgcgggctcttttttggttccatatgaactttaaagtagttttttccaattctgtgaagaaagtcattggtagcttgatggggatggcattgaatctgtacgttaccttggccagtatggtcatgttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgattttgctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcgaagggaatgcttccagtttttgcccattcagtatgatattggctgtgagtttgtcgtagatagctcttattttgaaatacctcccatcaatacctaatttattgagagtttttagcatgaagggttgttgaattttgtcaaaggctttttctgcatctattgagataatcatgtggtttttgtctttggctctgtttatatgctggattacatttatttatttgcgtatattgaaccagccttgcattccaggaatgaagcccacttgatcatggtggataagctttttgatgtgctgctggattcgttttgccagtattttattgaggatttttgcatcaatgttcatcaaggatattggtctaaaattctcttttttggttgtgtctctgcccggctttgctatcaggatgatgctggcctcataaaatgagttaggaaggattccctctttttctattgattggaatagtttcagaaggaatggtaccagttcctccttgtacctctggtagaattcggctgtgaatccatctggtcctggactctttttggttggtaaactattgattattgtcacaatttcagttcctgttattggtctattcagagattcaatttcttcctggtttagtcttgggagagtgtatgtgtcgaggaatttatccatttcttctagattttctagtttatttgcatagaggtgtttgtagtattctctgatggtagtttgtatttctgtgggatcagtggtggtatcccctttatcattttttattgtgtctatttgattcttctctctttttttctttattagtcttgatagcggtctgtaaattttgttgctcctttcaaaaaaccagctcctggattcattaattttttgaacggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctacaaatttccctctacacactgctttgaatgcgtcccagagattctggtatgttgtgtctttgttctcattggtttcaaagaacatctttatttctgccttcatttcgttatgtacccagtagtcattcaggagcaggttgttcagtttccacgtagttgagtggttttgagtgagattcttaatcctgagttctagtttgattgcactgtggtctgagagatagtttgttataatttctgttcttttacatttgctgaggagagctttacttcccagtatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatcttggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttcctttggcttggtagatcttcctccatccttttattttgagcctatgtgtgtctctgcacgtgagatgggtttcctgaatacagcacactgatggctcttgactctttatccaatttgccagtctgtgtcttttaattggagcatttagtccatttacatttaaagttaatattgttatgtgtgaatttgatcctgtcattatgatgttagctggttcttttgctcattagttgatgcagtttcttcctagtctcgatggtctttacattttggcatgattttgcagcggctggtactggttgttcctttccatgtttagcgcttccttcaggagctcttgtaaggcaggcctggtggtgacaaaatctctcagcatttgcttgtctgtaaaggattttatttctccttcacttatgaagcttagtttggctggatatgaaattctgggtggaaaattcttttctttaagaatgttgaatattggcccccactctcttctggcttgtagggtttctgccgagagatctgctgttagtctgatgggcttccctttgagggtaacccgacctttctctctggctgcccttaacattttttccttcatttcaactttggtgaatctgacaattatgtgtcttggagttgctcttctcgaggagtatctttgtggtgttctctgtatttcctgaatctgaacgttggcctgccttgctagattggggaagttctcctggataatatcctgcagagtgttttccaacttggttccattctccccatcactttcaagtacaccaatcagacgtagatttggtcttttcacatagtcccatatttcttggaggcttttctcatttctttttattcttttttctctaaacttcccttctcacttcatttcattcatttcatcttccatcgctgataccctttcttccagttgatcgcatcagctcctgaggcttctgcattcttcacgtagttctcgagccttggttttcagctccatcagctcctttaagcacttctctgtattggttattctagttatacattcttctaaattttttcaaagttttcaacttctttgcctttggtttgaatgtcctcccgtagctcagagtaatttgatcgtctgaagccttcttctctcagctcgtcaaagtcattctccatccagctttgttccattgctggtgaggaactgcgttcctttggaggaggagaggcgctctgtgttttagagtttccagtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgttggaataccctgccgtgtgaggtgtcagtgtgcccctgctggaggggtgcctcccagttaggctgctcgggggtcaggggtcagggacccacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagacgcaggcaggcctcctggagctgtggtgggctccacccagttcgagcttcctggctgctttgtttacctaatcaagcctgggcaatggcgggcgcccctcccccagcctcgctgccaccttgcagtttgatctcagactgctgtgctagcaatcagcgagactccgtggggtagtaccctccaagccaggtgcgggatataatctggtggtgcgccattttttaagctggtccgaaaagcgcaatattcaggtgggagtgacccgattttccaggtgcgtctgtcacccctttctttgactcagaaagggaactccctgacccttgcgcttcccaagtgaggcaatgcctcgccctgcttcggctcgcgcacggtgcgcacacccactgacctgcacccactgtctggcactccctagtgagatgaacccggtacctcagatggaaatgcagaaatcacccgtcttctgcgtcgctcacgctgggagctgtagaccggagctgttcctattcagccatcttggctcctcctctcaggtttgggttttttatgatggtaaaatatacatattataaaatgtatcactttaattgtttttaagtgtacaattcagtggcattaagtacactcacattgttgtgcaaccaataccactatccacatgcagaactttattctcatcccaaattgaaactccacactcattaaacagtagctgtccatttccctcttctctcagcccttggtaaccactattctagtttctgtctctgtgagtttaactattctgggtacctcatatacatgaaatcatacagcgtttgtccttttcgatctggattgtttcattgagcatgttttcaaggttcagcaatgttgtagtttgaatcagaatttcattccctttcaaggctaaatatgttctactccatgttatacacattttgtttatccattcctccattgatgggcatttgggttgtttccaacatttggcttttgagaagaaagatgctattgacattggtatacaaaatttctttgagcccatgctttcagttttttctatatatctctagaagtgaattgctggatgatatggtaactctatgtttaatttattgaggaattatcattctatagaaatgtgtagttttttttgttgttgttgttgttttatttgtttgttgagacagggtcttcttctgttgcccaggctaggcttcagtggcatgatcacagctcactgcagccttgacctcctaggcccaagcaatactaccactttagcctcccaagtagctgggactacaggtgcatgccactacacccggctaattttttttttttttttttttttttgagacagagtctcactctgtcacccaggtgtgatctcggctcactgcaacctctgctgcccaggttcaagtgattctcctgcctccgcctcctgagtagctgagattacaggcgccagccaccacgcctggctaatttttgtagttttttattttttagtagagacagggtttcaccatattgcccaggctggtctcaaactcctgagctcaagcagtttgcccacctcaacctccaaagtgctggaattacaggcatggaccaccatgccaggccagaatgtatagttcttaatcagcattccaggtgatgttatgatcagataatttgagaaacatttatttgtcagttacctattgctatgcaaccaaccactccaaacaattagtagcttacaacaacaaccatttatttagctcacaattatactgggtggctcttctggcctgggctgggtttgtctggtctctgttggcctagctcatgtttctgtggtcatttggctggtcttttgggtgctggctgttctcagatggcctcagtcatatatccagtggttgcttggctataggctgaagcaatggcgtgactaggcctagaacctttccttgtttagtaagctaaccccagcttgctcccagggtggcagggtcccaagaacagcaagagagcaagctccagtgcataagctcttttcaagtctttgcctatattatgtttgcttgtcctgttgggcagagcaagtcacctggccaagcccagtgtcagtatagagggcactaccaaatggtgtggacacagcgaggcagaaaaagagctgagaccattactattattattccaccacaacttaactgcttgattcagtattctgacgtgaactcagggttatctgaaaactttctcctgccgtaataaatctgtgaatggagcataatcatgtctgaagttgcatagagccctctgaaccacatgccccagcacctctgcaacgctctccatttgagggttcattcattaatttaataaatacttattgtgaatctactcatgtctggaactcttctaggacctgggtatacagctattgacaaaatagtccaagttcctcttctccagggacttacattctactgcaggtggaaaagttttaggagtgagaataaatgtttggatccctagcacatattcaggaggttttgtggttgtcattgtttaaagaggaagaagtttgaagaatgttctttattccctattcttcaccactatgtgcttttactaatatttgagtagagaaaaatattttggttaattagaatttccaggtatttaaatgccagaaggcagatgcaaacctgtgggaggatattaggattgacttttaacttgtaatccttatagcttggtgcagaagtaaccgtggcttgccgtaagggcaaaagccacaattacttttgcaccaacctaatacaagactgatggattcgcttctcacttcctttatgctttctgcaaggctttgtggctaagacttttggccccatagctacctgagggagggctactgatctttacagctcaaagggcactgaagagtcacatccagctgagcagtgatggatggctacaacagacattttctttggatacttctttattttattattattattatgtgtgtttaatcctatgggagtagaccagcattctatatttttaaagtagcactagtttgttggaaaatttgacttttataaactgaaagtgtatgtcatcagtacctggagatgagatgggtttaatgtccagctggtgctcagaggggctgggactctctgcatgggttagtttgccagctaaaactcacttcatgcacaagagctttcattgaacaacagtcaagctttgcttcagggtaagcaggtatttcagtgggggagaattaggagacagcatgtagtagtattcaaattaggatctttagagtcagacagatgtgtccgttactagcttggaccttgggcaaatgacttaacctctctgagtctcagtttctttatctataaaatgggataataacactatctgccccataaaactggcagcactaacagaaagcatgcaaagcttgtagcatagtgcctgcagtggacacttgattaaaaatgttagctaaaggctgttatcttttttttatttttttagatggagtctcactctgcctcctaggctggagtgcagtggctcaatctcggctcactgcagcctctgcctcctgggttcaagcaattctcctgccccagcctccggagtagctgggattacaggtgcccgccaccacacccggttaatttttgtattttgagtagagactgggtttcaccatgttggtcaggctggtcttgaactcctgacctcagatgatccacccgcctcagcctaccaaagtgctgggattacaggcgtgagccaccatccctggcctaaaggctgttatcttaataaatgctgttctgatctacagttacatcaccacaaactgatgcctttggcctggcccacagtgccagaatctgaactacaggggagttactctttgaaccaccctagcaccaatcctagctgagaaaaagacatttatgaaactgatttgccatttgtgtgtagccagtcaggaattcctacttgggctcttggccactatttgagcaacttttctgtaacactgaaccatagaagcagcccatccaccaccaccacaacaataaaaactagcacttcacacactagcaccttacctggaatgattttagaggtgttagagagccccagaatatctcctgtgtaactttccaccagactttatggacgagccaactaccaagctgtaaattgattgaatcttgtattttcctctttggacttagctgggcccagtgagagtttggttgagagtagattttggtggatgggaacaggagtttcatgaggtaagaggagaagagagagagaatttttgttcatgggtataggagccatgtaagttgtataatttcactataaacatggcacgcagggagagggtgaattgtgcccaggtaggcaggggaaattgcaaggctttggtgttggggagagcacagagataaagaaattacgggtaggagagggatccaaaggggaaatgaaggagagtgaaaggcaaacttttcagctgagttacatgagcgacatcaactataacacaaggtggaaaaatcccatcttcctgtcctcccccatgtgacaagaagctgatctgccttcttggatttatttccttctggggctgtatttctctccttgcgctttgtctcacctcctaccttgttataggcgatctttctccccctgaggaaatcataattctatcactgtggaaattgaagtgtcttcagctttcttaccagtcttagagtattttcttaggccaaattgccaatttcctcttttatggaaaatactaaaatacttttttttaatagagtgaccttgatcctttcccatttgctattctttccaatttctagactggagctagaaaaattgaatgaagttgtcagcctagtggcaataaccacattaaaatgtttctctgaaagtctttggagcagagtccttgggcatttttaccagtgaccatccatgaagtgacagcactatagacacagggttttgtgtccagagaactttccaccagcccttctggtatgatttactgtgtctgtcttatccaggccctaacacagggcttggagcacaatcagtgatcaataagtgttaactcagtgatagggcagatggtcattgatttaaaaataacaaccttgggccgggcagtggttcacacctgtaatcccagcacattgggaggccgaggcgggcagattacctgaggtaaggtggtcgagaccagcctgaccaacatggtgaaaccccatctctactaaaaatacaaaaattagccaggtgtgatggcacacacttgtaatctcacctactcagggggctgaggcaggagaattgcttgagcctgggagacagaggttgcagtgaaccaagatcgtgccactgcactccagcctgggcgacagagcaagactctgtctcaaaaaaataaaaataaaaataaaaataaccttgcctcgtactgttggggtacacacttccaagcagtgacccttggcagctctgggaagctctgagacgtgttcttccttggagtagtccctctcagcctgcgacactgtccatctaaatctgtggcacaggttctccaactctaggaggccaggaggcgctatgtctgacaatcgtttgaccctgtggctccaggacaccccaacactctggactaaacacactgcaccactcctctccttaaagatcttaaggattgtgctctaattagtttggaaatggaatttcttagactatttctaaaagcagctgcagcctggggacaaattgactaaattcaccagttctcctgaaaatgatatttgaaaggaaagttgagctgcttctatcttcccagagaaatctacatgtcattcagatgttggagaccctcaagaggcagaaatgtcttcatcccctgccgtttgggtactgactaaaaccgttgatccttttccttgaagtctgaggttctgctgttggcctctgaaaagcaggggacagaatattctggcagactctggcaagtagatgaccccttgctgggagtaagcttcagccttttccaaggtctgccacaacagaagcagtaacatgagagcggcactcagtaggacaatgacgatgaggctaatgagagcttttggccgtgagaaacactgcctccccaagcagcattcagatatgtagaaacggtcttgttttacgtgccttggtgcctcgggcctgtacaaagtcaccaacacattcaaactggagtggagaattggggatttaaaaatgtgattgctgaaggcagcaccatcttaacccctggagtcatcgagtgctcatttgctgctaggggacagaaaagccattagagatattccctgggtatgtagcccagttatttttgttttttaacatatatcccaagtgattcaagagcatgacaaggtttgggaattacagtccttgagcacaatctcccattggtactttacaaggttatactttagactaattgaacttgttttatttttattttatctgtaatgatatttgatattcattttgtatataaaataattttgtttttatattttgtatatgtagtatgtagtacaacataattattttgttagtaatatttttattttataatatagtgataatgataatacagtaactgcatataagtacttatatacaagatattgttctattgtaatacaatataatcattttgatagtaacatttttattttgtaatatagtgataatgataataatatagtaactgtatgtaagtactacttattatatacaagatattgttctgaatgcttttacatacattatcgcaattaatcttcacaatgactttttgaaggaggtggtattagtaacatcattttacagatgagaaaagacaggcacaaagaagctaaatgatttgcccaaggttccatagcggtcaagtggtggagcttgaatttatacccagacctggcgattcttaggtctgagacttttaactaccacactgtgctgatccaagtggcctgaagctttacaaaatttgattagagagagttgcatcactaggaaacagagagatataagaagtctgtgggaagggaaagaaagatgccttctctgcagaaataatgtttaagagttttttaagccttaagtaaattagaccatctgtttgtggccaggaacatactcagtggaataatgtcccagccaatagaaaaatagactttgcagaaccccagcagtcagttgctgacatgagtatggaatccacaggaattccaggttactccttgctccggaaataaggaaaagcactaatatgaagtagatcttggcttcacccaacctgggagtgggaggaagtctgcctctgaacgccagaaaaaacctagggatagtaggggacacgaaatgcaagcagattcctcaaatctccacttgaaagctagaaagcttcactatgtattctgcactgacagggaaagacaggtcctaattggatcgactgatccttctcttggtgggagaggccttggcctttgtgaaccaaggaagagatttttatgacaaacttttctagatgctttttagctgaagttaaagaagattatgggtgaattagaaaagggatttataatagaactttggattaatttattcattcataaacatttattgggtgctttggctgaattaggcagtactctaggggatacaggaatgaagaaaaaaatggttcgttcccaagaatcttacaactgagtggtggagacagacagcaaaaccagcaacagcttaatgtggtgtttccatagacatgtttgagaattcctatggtctatcaggcaagggcactttaaacttcttaagggttgggaaagtcaagtgcaaaaaagcccccaaagaaggaggctttgcattatgtcacaaagtagttgcagttacccaggctgatatgcaaagacctccctggcagaaggagcagtgtgtgcacaagaggacagaaggcaagggcaccccacagtcctgcgggtgcacggtgagcaaccagaactagccagctggtcccccaactcatgtcctcttttggtggaatctccacacccagctctacaacctcaagaatcccaagccagggtctaggtctcaatatgaagtcagactctgtttctgaagcctactctgtgattctatgcacaatttcatgctaatattcacctggacaatggaaggcatgaaaagccattcagcctcgtttgtgaagttagaattgtcaaggaaaggggctgatacttctcaagtaatcaggcatggggctaaaggctttctgagttttggccaggaggttgttgtttgattttacgtatcgtctttattatgagctttctcacccaactgttgctgtctgtcttaatcactgaaaaccatcctctcctaacctgcagtcatgttacgatttgttttctcctagtctcatattttctctggatgcatttcatccccagtgtgaggagaagccatccctaaatcctaacgctacattgtgtatttctaagcacttgcctcaaggccccactcccagcagctattgatccctgagagactattatatttatttgcattgacacgggggctcaccaccttaagtgaaaggataaacaattaatgtcccagctcctggaagtcggatggcctttctgggatgccattaagacttgtcttggagagggctgtttaaagtagctgctcagactgaactttaactaattattcaatcaacgatttggcaggtcagtcaatgggaaatgatgcacagtttgctgaaattgatcacacttcatttcccatcaattgtaaagccaaattgtgggtaaagtcataagtaaaggatcattgcctgccattcttaggaccatgtttccctatcccttccatttacttaaaccccagcctcatccataaaagcaagagaattttgcacttacagagggaatcagtataaaatgtttaccaccttctgagatggaaggggaagggagagtgttttctatttcataattgatatgttgcagccacataatcctctaaccttttcctctaaccttttcggcagctcagatgtggaggctggattttaaatcccatgatccattatgcatcacttacttccacatctattaccattccgtcagccaagtgacaggattccccatcagggcctttgactgtgtggggctcttcaactttatgctggcggataggcatgtggaacttcatacatgggtgatttacagacaattagcaggaggcaatggcagattaagtgtagctcttctgaaaaattatgaataaaggatgtaaaaaggaaggtccccccacccaggccctgcccaggaaaaggcttagaatgatccaagcagtgaattttatgacagtaactaccaccctctcagaagatgcaaaatggaatgtgtgcttgtccacattgattggcagcttctgaaaccaatcaccggcccaggtcagtagagccccactggtaggccaacagatcatgaagaaagcagagacacagactcggatttccacataagcttcctcacctgctttgttctcccaagccaactggccttttttcttgcacactgggacctgataaaagcctctggtacttgagatgaaccactagacaataatcagaatggaattttctgggaaatgtggccatatgaaaaaaatgatcactttttcctcacaaggatttgcaaagtggaaagagtaggattttaaaaactgtattttgtagcagagaaaactaaggtttagaaatttgaatgacttccttaacaaatatttattgagaacttgccatgtgctaagcacaatattaagcactgagcttactcggtattagtcggaattctccagagaaacagaaacaataggacactcgcacacaaacacacacacacacacacacacacacacacacacacatggagctttattatgagaagttggcttatgcaattacggaggccaagacatcccatgatcagcagattgcaagctggggactcaggaaagccagtagggtaaatcagtccaacctgagacccaggggagctgatgatataaatcccagtccaaaagcaggaggagatgagatgagatgtcctaatttaagcactgaggcagaaaaacaggttgttaatcctttccttaaccttttgtcctgttcaggccctcaatggatctgataatgccaaccacactgggtaggaccagctactttactgagtccaccaactcaaatgctagtctcatccagaaacaccctcaagacacaccagaagtaatgcttactctgtgaaccctgtagctcagtcctcacagggctcacagtccacccataaatatgtacatatattatgtatcaataaaaattgttctaattgttttaattaaaatgaagagctagtagtctagtggaggagacagacctgaatgcaggcaaaaatgatacaaggtggacagagctgaagcggttgaagtggaagtgctttgggggttcagaggaggggcacctgcctcaattttggggtggcagagggtccagcaaggtctgtgctgaggaaatgacataaggcatcaagaacaagcaggagtgaaccaggtggagaaggcttttcaggcagagggaacagcatatacaaagccccagaggcaagacagggcttcacaggcaaaaggttagaggccaaaatacaaggaggaaaaggggagagaggtgggctggagagacccaggggcctgttcggggaggcgtgtgtgagcttgtaagtagctttctcctcagagccaggcctctgatcccagcatcctgaaaggcagggggctcagtttcagctctagccaaattcaccctcctccacctcctcctcctcttcccctcaaatctccttcatctacccccacatcccctccttctccactcctccccctcatgctcctgtatctcctccctctcctcctcctgtatctcctccctcccctcctgtatcttcccctcctcctcctcctgtcctccccctcctcctcctgtatctcctccccctcctcctcctgtatctcctccccctcctcctcctgtatctcctccccctcctcctcctgtatctcctccccctcatcctcctgtatctcctccccctcctcctcctgaaactcttcctcctctttctccactcctcctcattcttgctagacggaaaaaatagttatttattttttattgatacataataattacacatatttatggagtatgtgtgctattttgaaattttcctttcggtcactgtcaagcacttctggaggtaatgccttttctacaaagtgcacaatggtcattgcacactcaaacatcccccaaccccctgccccctgaaagaaggccatatgggctaagtgatctgatcaaagtcacttggtgctaattagagatggagctgggatttaaggccaggctctctgtcccagctgctttcattgtgtaaactgaacgctgacttggcctctttgtatgtcactcaaaaaactcactgggatgcacacccttttaaatgacatctttttctttttagaattgtttcatgttggagaaaataacatggttctcaagcctttcaacagtcctacatccacaaaaggggaaagggacactgcactgaaattagaatcttcaacaacttcttcaatcttccctttttaattgggtgaaagtaatgtactcctaattatttgagaaatgatgtgataagccccattattaagacctcttttttctgagtgacatgagcaatttaaaaggaagggaaattaacaatggcatgaatggtgcattatgtgctccaagttcgggtacaatcattgaaccaaaagagagggggcaggggaatgagactgggctttctcgtaatatttctgagttggtgagcatgaagggagaaaaaagccagtccaagcttgtgtttcagactctgtaatcaggaaaaggcaaaaaaaaaaaaaaaaaaggtaaagacacagtatctttcccttccttctcaagcagtaaacactgggggacacttctagtgagtgcatctgacatcaatttctattcttcagcatcggaatgtcaatgaagtagaacaggggatgtttccacaagatattaagatgacagacagtcttactctctgttcactggagagtagaattggtagctctccaactggtatgattttagggggtgcaaatacaaatgcctaggggaaccaggaaggagctctccatgggcaaggctggcatgggtgagggtcaagggcacgggagcatggcctctctgcacgtcagggctgctgctccgctctgcatgactgtcatcacaagcaagagggacccagggatccaggtcctctgagttttcaagggaggccaaaggattctaggttttatctttatgtgtttaaatgacaaagctcctcattttgaaatgttgcagtgctgttgacacgttactaataaggtttgtgtccttatgttgtagaaggaaaagtaatggtttgctgaatattattaaaagttcttacgtaggattttgtaagtctcaatagtatgagaaagaatgaatgtgagatagggatttggtattaaatattaaatacaagtcttcagaatatggaggtcatattacagagataatatgtaaagagacataatatagtacaatggaaagaacactacacgtgggatgagaattactcaggatgtccacagacaagggcttcattagccctgcctcagtttcttcatctggagagccaaagattcaattcacagtccatctaggctctcttctaaccttaaccttggtgacagccctagacccacactgaaatccatcagagatccttcattggcgctgagcagtttatgtttcattctgaatgatggagttctcttccattaggcaacttcaggcaagaagaagaagactgtatcaggggttcacaaaataaagaaaaaagaaagcaggaaggagagttctagaaagagccaccctttagaaaaattctggtgcaccttcatcttctcaccatcacgatacccccatttttgcttctaagtctttatagatcataagtcaacttcctaccaacagttaagaatcttaacaacagttagaaactcagaatcctagcagcacaggcatcttctgagtactcaccatgcacgaggcactgtgccaggtacaaacattcatattcctcacaacaaccccaagtgataggtttctagagaactgttactgtacacatcttgcagataggagaactggggctgagaaatggaaaagccatttgtgcaaatccacacagccaggaggaggcagatcacccagcactgactccacagccattgatcctaatcactcccaagaggctgaaacatgtgctacaccagttgggctctgggaatctggcctcagtttaaatcctgcgtctgccacacagtgaatgtccttgaaaaagtaatttaacctctttaaagcctcagttttccgacctgtcattgagaagaatgaagtaactgccacaagttttgaggattagtgagctctacataagggatgtcaggtacattataagcgttcaataaatggtggtgattattgttattagtccactatcattcttaaatatcttgtttcttactgaactgctaggagttgcaaaaccatcctgttaagcaggaaaagcaaggaagccacttaacagatgcaaatggcatttcacaagggagtcagagacaggggctgagaagggactcagatggcttcagcccagctcctagctgactgaacagatcacttccttgaagcctctagaggaagcagtgaaatgatatcaattcccctgagctttggaagggaaaaagattctatcttgcttaaactgttctactgtagagaaatcatatgctttagatgccagggcaggggggagatacccctggatcttcccaaaggtcatttgttgcaggcagagggattaaatacttaccactgcttgctggtatggaacactgaaaacacatcttctctctagatagaatatatgaaacaaaaaggaggctcccttctgccagctgagggaaattgcagggcagtgcactttgtcatcactgtggaagtgcctggtagaacaggtgacattgggcaagagaaagcccttcagtgccagatttgttttcatcactgtgttctgttctcatcatattgtggtgtgagactcgcaaaatctcatgcattctcaccacgggagcctgcatcttcattgctgaagggaagtggagagctcaaagcagttcatgcaggcaattcctccaaaaagttccccaaactatctggagcatcatctcattctccacttcaagttaattccaaaggctggcctggaggaacttctgcacagaatttataattagcccagctttgtggaatagtcaggcctgagtcctttgttcatgctgatatgagtagcagaagggtttctgcaagttcttgcccagttgcaattgaagtgtttaggcggttagctctttctgctagaaaactcaccttgggtgtgcctgccactctggcacatgtcttcaaaaatgtgctttgtcacatttaaatactgatgttttgttcctagttatggaaatgtaggagtgtctgtctgatggttcatttctaacccccaaattcctatcttatactttaaactgccctgaaaatcaaaagcccttggaatcaaactccagatacacagccacattgccaacacactactttagcaaaagatccagaacatattttacatgaaaacctgtcagactggttttttattataaaaataatgtaaagaattgagccaagcacccatgttattctgatgacaaagaaaactaattgtgctaataacactaagcaaagtcttcagcaatcattctgagctgtaaattgggcatgcttttttaactgtggagcctctttatgaggtatatgaagataacaagcatgcttttgaggggattcttgtgtaattgacattttttaagtgccgagaatgtggttctaagacacatttgagactggggtcttgcactcgttaggcagtccaaagtatttttagcttccttctcattggagagctagcatttggggcgtagggagaatgaagcttatgccatgcttttgtttcctttgttgtttgtttgtttgttggggagtgtggggatacaggatctcactttgtcacccaggctggagtacagtggcacagtctcagctcactgcaacctgcacctcccaagctcaagcgatcatcccacctcagctccccaagtagctgggaccataggtgtgcaccaccacactcctctaatttttgtatttcttttagagatgaggtcttgccatgttgcccaggctggtcttgagctcctggactcaagaaatctgcccacctcagcctcccaaagtgctgggattacaggcctgagccactgtgcccggccttatgccatgcctcttactgaatgcacctagtaacaaactaccccacacttggtaattgttcattattattatctctcagaattctgaaatttgcagttagatggaggctgaggctggaatcattaaaggctccgttacacctctgggggctgatgctggctggtggcttgcacctcagcaggagctataggcaggaacacctacagatgtcctcttgttgttacccggggttccgcacagcatggctgctggtttgcagcatcaagtatcccaagacagagagccaggcagaagccacatcaccaattctaatctagccacagaagccacacagtgacactttccactgcattctgttcttcgcaggtgagacactaaggtgagcccatatttagggcaagtgaaactagattctacctcttgatggggaagtgtcaaagaatttgaggagatgaaaaacttcaaatcagtcttttttaaaaaagtagtcaaaccagtctctttttaaaaaagtattcaaacctttcttccatcccctgcttgtaaactcacatcctgaggaataatgacttgaataattctaccagaatccaagaaaccaaattggttgggggcagggggtatgttgcttttattgtttccaagatgaagttctctgtgaaactagaatgtggttcctcttatagaaccctctggaattagcaaatgattcccaaatagtacaggtaagactcctgagtattaatgacttcattatattttgttgccgccatacttcaagtcaggatgcttgatgacttgatgtgatatgtgtgtgtctcctcccatccaccttaagataagcaataggcaatatccaattgtgtgagaacctgcattgttcacatgagcctttgtcctggataacagctcctgttcatcaatatgatacattgcactctgactttctacttctgtctttctttgtggatattcctttctcctctctgattgctttttcttcttagaccattactctagttgatagtgctaggttatcattggatcccatctccctctccaataagcctgtgattgatactaatcttcctcatgggacacattttataggatgcacattggaaaaccactctctaaatcttagctttctatgtgctgacaatttacaaggttgcacctcacacacatctcaggaggcttaaggggaaatttgagagccatgtaatcacacctcctaataagaacagaaatgcctttcatacacagatgctgtcatgccattcagcagtctgtgctgcgccccccgtttgtcttttttcccccagccaacaaaatgcacatctagggaagtgctatctgggaagtggccagttcctagaagcccagcatgaatcatttctctcttctgcaggagagtagtgttttaattattctaatgaaagctttcacttgccattgaatccataaaagcagaaaattaaggaggttgcgaacacctctctgaagcagaaaccttgctttataatatacctgcacctttcctagcaaaactgagaccccaagaaatttatagacacaggatattacccttccagtttaacacatgctttggcattgaaattttacctttccagacccaagaaagtattttgtgaaaagttttaatttctcatttgaagtttgtacccctaaaatatgccagccaagaaagccaatataatgcagtatttgcttacaacaatattagattcagtgtgtcctttaaatgaaggcttgtgtccagaaaatagagggaatcatgggactcaaaactttaaagcaacctaggctagattaatgatttgattattagtttataggaaactcaaaggaggatgctgtggtctcttatacctcagtaaggtcacactatggaccagtaaagtttaagcattaagaaactgggtttgttttgcattttaacttaaaaattcagacccagttatatccattgtgaaaaagtaaatatttaaaaacttgggttttctggaattgcgagatttcattcccaattttgttctcacctctgaaaatgggatacttttttgtattggcccttttaggagaagtgacatctcagacccctcctgtctttcttcctctaccatctgtgttctttatggatatatatttcttggcaaatttggtgtcatgggccacattgtgtctccccaaatttgtacgtggaagtcctaattcccattacttcagactgtgactgtatttgaagatgcaggacgtacttaaggaggtaattaagttgaaatgagacctttagagaggccctaattcaatatgactggtgttcttatgagaagaggttgggacactgaaaacacaggccaagggaccatgtgaggacacagtgagaaggcaggcccctgcaagccaagggaagaggactcagaagaaacccaatctgccaacaccttgatcttggacttcagcctctggaactgttgcggggagggattctgttatttaagccacgcaaccagtggtattttgttatggcagcctagcaaactaatacattggggatttctcctgcatataatagaaactcatttttccatataacaaactaaaacccccttgcacatccctaggtacagctctgtgcatggtgacagtggcataaagctgtaatactctccatgacttagtttcagggccaccggcaccaggcagagactggaacccggtaagcaccattgaagctcttccagcatgggttcccactgagaggcaggcagagcaactggaggtttgtgctgacaaagcggcatggagctataatgtccagagccactcagaactgcaggatggcacaagtcaagaaggaactgtgtcagagcagaggtgaaatctcggacagctcagaaatcttggcactgaaggaggcaggagccttcacagttagattgagagtgggcagttttttctctatctgttgcactttattatattgttttttaaaattattatcatatccagcaccacagggaagggtgaggctgagcacaggggcctggtagaactgggtcattgtagcgccaactagaagagtgtgagctacaaagcaggaagaacagtttctcaaaggggccggatgggggtagtcattggggtgccatgagcaggtgtcctgtgctgatgctggcagattaagcccgcatgggtttgcttcacattttaacttcaaaattcagcctcagttatatctactggagaatatacacatgaataaaagggtcactgttaaggagacagatctgagagagcccagataacaagctgcaaccaggccccaggcagcagaggaaagggctgcttggtcagtgtgggcctggaagcttgggagcttcccagaagccaggaccacagctttattccaacaccctgcagctgacccaatgtgctccccacagagaatgttctcgtaagaccttgtacttttctttcatagcattggctgcagttgtaattttgcatttgtgcaattctttggttaatattggtcttccccaccaaaccgcatgttggtgagggcagctggggctgttttactctccactgtattccctgtacctaaggtggtccttggaaagagctgactctcaggatatttcttgaatgaatgaatgaattgattcatgttaatatcacctccccttctccaagtactcagaatcttgctactggtacaggaacttataagatgcgtggaaggccaaggacaggagacagcatctcccaggggctcactgaaaagcctgtgcccttttccagcctccgggcctcatattgcaggtgcctccaggcgggctggggagcatctcacctctgcctagcactgtgtgctctggatggccagggaaggtctccagggcgggatctgattctagggatttcgcaagggactttgatatgtgagacccagaagctccctgcagagaacaaaggggcagtgtggactgcctgtggagcctgagccaagatatgatctgggcctaagaaggcaccatggcatggctattcagtagtccacagtcctgctctggagcaaaccaagacctaaccagccacagagcaccagaatccccagctggtcagttcagggatttagagaagcttcctttctcccaactccatctgctgtgacccaccttccttagtcagcccctcaccagacaggtcctctttcttgcctctgccctttctaccttcttctgtatccttcccccgctccaggctctctctctgtctgtggattctctttgtcctgggtataggcataaacataataggcattaagaggtactggaaagcctgatcgattctgaagtcttgcactccccagccatcctattaaaaattttaaaatacctaatattccaccaccattatcccttttggctttagaatttacattcttacgcgtggacacaatttactttgtgagaatcaactgtgtctatgaacctgaaatagtctgttaaaaatggatcatggagcccgtgtgctcacgcttgtaattccagaactttgggagaccaaggtgggtggatcacctgaggtcaagagtttgagaccagccaggctaacatggtgaaatcccctctttactaaaaacacaaaaattagccaggtgtggtggcagatgcctgtaattccagatactctggagaatcacttgaacccagaaggtggaggttgcagtgagccgagatcacaccattgaactccagactgggcgacagagcaagactgtcttgaaaaaaaaaaaaatggatcatagagtagatcaattttgatcagaaaatgtcactaataaaggtctggaacatggggtgcatctgtagccacatgggatccttgggtggcccggaggctgtggtggggtgaccagttgggggtaacatggtaaggatgcttggaagaagaaagtgagagaagggggtcaatggaaagacataggtcagtgggctcacagcctcgtccactgtgccgggtcatccagtcccactcaggctccctccctcctgctgcccctcctccaggcagtcttctcccctgcagctacagggccccagctgccaggccccagagacccacccaccctccacgggtgggaaacatgaacacaggcaggtcagctcagtcttctatcacaaagctcacatacatagggaggcccagcctcgtccaaggctgatttcaggaaagaagattattctccaagattttctcttaggaggcagcaccacaaaatggaagaggaactgactgtaagttctaacctgaattctagtcttggctttggcagtaactcactgggtgaccttgggcaagttccttcgcctcccagggcttctctttcttccatggcacttatgtggtttattttaaaggtcatgcatgctatctttgacctgtctgctgccattttctttggaaaaaagagccctgggagatatgattaaggagagagtcctggcctgttagccaggggagccctcctgcccagaccctgtaagcactctggataaccctctgctcctcttatgttaatttcctcctctttctcacctatcctgctgtctccatataagggcacagcacggccaattgcatttaaaattgccttctaaaaggcacacacatgcatcctggctggtcagtctttgtgtggagctgggactgattcatctcaggggcgtaattccagctttggcactggcttgtggaggtgtcattgagaggggttcagagggctaagcttaccaaccccccagaagaggggacacatagccttggctccatgtgccaagcagcagcataatatgcagggctctgcaaagtcagcagagaaaggacagcaggtgtcaaccactgcacatgttttacttatttattgatttacagtccatcttcccagtttgtatatagcctccttcatagtagagattcagcctcattagctgtctctggcatccttagcttgcagaatggtgcctggaagatagtggaccactaaagaacactttctgaatgaatgaatgaatgaatgaatgaatgaatgaatgaatgaatgaaaatgtgttaggtacaagtgttgtgctgtggaacacactcctggattctggctcctgccccacaggcttgtccccaaactgatgaagagcaaggcaggcactgcgcacagtggtttgggtcatcagcagtccaagaatgttttccccagtgtaggtgctcccccaggttgatgggagtctgggagaggtggtgctgacaagagagtttcttcacctccactccaaagacagaaagcaacgaaagttaatgacagaagcaagcagcaggtgccagtgccagctccactgctcagtgcttctggatcctttcacggttctgtaatgtactcagtccccaaaggtatatctcctgccttctaatcacttacaacaaaaacacatgttgccctttacaccaaagataaattgaaaggtgttcaggttctcttctacttgggcttatgaccaagtctcagagcacctacattagggggcaggggtgaagtatactttcccattggcctcttccaattgctggaagtgcgagcttaagaggggtgaccatttattgagcgtttactgtgtgtgttgaaaactgtgccaagctctgtaaataagacaacatcccaaggcaaggcgactgcaatctcctgagaaatgctggcaaacaaaccaccattataaccgagttggagtaattcagggcagagatggtggagggctggactgaggagcacaatgggaactgggagacgcagagttgagagaaattgagggttataagacttaatgattgatttgttgaggagaaggaaagggagggtttaatgtgactcccgggtttctggcatgggaagccaggtgggattacaaccttcactgcatggaagacagagtggcagatctggggagactgaagttgagttcagctttagacgtgtttggtggtgatgttctgatgtgccgtccaagtggaaaatctcattaggaattggaattatttaataccagatatcatttaatgagtgggggagttttattgtttcagtatttttacacttcaatagtgctttagagagacatgtcctcttgtgtttgacaaaacactgatttgcagttctggtatccctcctgagtaagtcttatttttgagataaacatcacatcagccccgagtgcaactaaaaatgagctgggccagggcagtggggactgcagtctgtcaaggctctgtatttaacaatgcctttctccagtggcctctgccctgtgcctcccacactgtcagctctaaaggatatttagtccttgcagcctcaaattctttaacccttctttggcctcttaagacaagccctgggtatcactgaaacctaaggcatgtccagaaacaagcacaaaagaagaatgtgaccactgctgcttaacctggccagagaaattcactaagtcttgcacctgaaaaaccgaaacaaaacttcctagcaaatcaggttcccacaatcaaaggatggaaaatctcactggaggttggaaaaatgatcagagcctcttcaaaacttcaggacatcaaaagacctcactgtactcttattagaaatcaagctggaaggaaacatcatagtccttcaagtgacacatgaacgaatggaaagccgaaacccactttctgcagcttcagaaattcatatttttattcattcaaccaacatttattgagtgtcttttatatttaaaacactttgtgggacagtgtgggacacaaagaaaaagaaagttattctgtctcccaatgaagtgacacacaaatggctgagtttggtgaagaaataactgcagtgagtagtggggtttgctgatagcagtggaggaggtggaagctcctctacagattagcttattgaaccctcacagctttatgagctcgggtctagcattaccattattttataggtgagggaactaagacacagggaagttgagaaattttcccaaagtcaacagttggtaagtgatgggatttgaacccaagcaatcattattaaagacaactctgctgaataagtagcttttacataggacctggaatgttgggttggctgtcaaaaactgcagctgggacagctgggagtgcatttcagatgaaggctattctaacaggaaaggcaaggacaggttacatttggatacgtgggtggtggtccagtgtgggcatgtgtagagttcttgaaatggatcagtggaaaataagctataaagggtcacttttagaaatatagacttccctctttagggatgagggggttacagaagatcattacgttggagtgacatgatcagaactgtattttagaaagaacacatgactcctgcactctagccacttagtacaataagtggaaaaaagagaaagtttcctggcttctgaaacaacgagtatagttacattgcctgctgtcacaaagggatccccaaagatgtgtaatagctcaaaaatgacagcttttgtcttgttcacatggtcaaaaaagtgggaggttctactatgtctcatccaaaccatggtttagggacttggtctccttctgttctttggctctgtcacgttcaatgtgtggcttccaatgttactatgccatgtgtatcaaggtgtcagaaagggaaagagagtggagaagacagttgcttctgaagttttccaatgacctctgctcctgttccattaggaggcacagggctctccctagaggcatggggactagaaacgaagtccctgactgggcagccacttccatctgtgactccatactgtggaaggaaagcatgaattttggtggaaagttagtcatcaccatcatacctgagtgaggaaagaaaaacacatttacccttcagcagtaacttttcaaagtagtctgacacctcattttgaagcctggttgagaaatgagttttacgagcaaatgaggcttaaaacaacataagcacagtcccatttagcaccaaatcttatttgtctaaattattgttgaaggttccaaattgattttatactttcctacctaagtgaacaaaacttaatttaagcttttcttgatgacttaggatcaccattatgaatgtcatttatgggaatgcagtgtgttgtataccagcagcttttgagtggtgtggaaatgttagttcctgggctgaatgcctcctgaattctaggctgttccattaagtctcttcattaacctcttgggtcccttagaatttttacagtcactgtgtattctcaatacctcccatttctatgtttctctgctttctgatttctcctgccatttttattatttactaacccattcatgtaggttttcttttttcttctttaagactccccaatcctcttttctttccagtcctttcactgattttgttttgcatattatggtggaaagagcaggcacacatgtgggagtggctttggcctcagcactgacactagctgtgctgcagaaactatgaccttgagcaatttaacccctgagcccctgtttcctcaatataaactaaggtggtaatatggatctcacaggcttacattggggttaactgagatgctagtaatagtataaaaattcatctgtaaaaattgatcgtcattatgactgttattttggcagttggacctggtttttattgtcgtcgtcaatagaaatagaaagagtccataggactccagggagttggaatccagacatgaacagaggaatagctagaatactcgagacatctctatggagtggacagctgaagccatgagtcaggctcctgaaagtctccaagaggttatagatctactaatgtgcttaagcagaatctcaagaaaggtctaatataaatggatgaagccataagaggaatatcaagaaaagaagactggataaaaatattccctgtttctaagaaaagaagaagttttctaaaccttgaaactcttttaagctatcaatcctatctgccaccattcactcccagccttcttgaaggagcagggggcctccatctcttcttgccaggaatctgcttcttgtattttacaattccttgccaaatctgggcagagtcagcggagtgaaggcagttgtgtctgggcagtctgcctaagagtttccattacataaacagtaggtgcttaataacttgcattgtgcacataaaagggaaaaagaagaaaatgtgatttttcactgctacagagtaaaccattctgtggccccagaggatgcatcatgtttagcaagattaaagcaggtggcaaagtccctccccagtgggtacatcacagctaatgtccatcaatgattagcaaatgagtagacggtgcctttgtcaataatcctgtttctaccctcatgctttatttatttagctaatggctgcctagctggtagctcatcaagatggtgtttactgagcttggcaaagtgaaaaattatgattttgtttactcatgtgtttccagctggggtgctgagttgttatccaggcagctgatgaccgttcttccactctcagagcccctaacacaggcagttcagtaaacaaaccatcagcttgagaaccagagcatcaacactgccacaatctggttatttgctactttgcagtcgtcagtgtccagaacctcaaatgatgactcattctggaacctcccttatacttagataataaaacaaatagaagtcaggttaagtgtaattggtttagtttgagctattcagttgtttatgagaaaaatgagtatttgctccaaattaaatatttgatttgggatagttttgtctcttgctctatactcaagcatgtaaaaatagaatggaaacccaaacagaaaacctgggagagactatcactctggaatggttctcacacatgcactaactaatttagttatttgtacagcaaatatatagtgagtacctactgtgtattaggtcctggggatattgtggtgacttaaacccaacacaaacatgaacctagttcttcagaaccttgcaactttgtaggaaagagagacattgaatcagtgattgtcaatatgatgagaattataaagggagaaacagggtgcttcagtagtcttggagtttagggaaggatccttgagaaagtgatgctttgaatgggagatgaaggagttccaaaaatcatagacagcgaaaggcagagagggtaagcttaaatattattattatctcagttaagtcacaaaataactctgcgaggtcagtattattgctccggtttacaattgaggagacttgggttccaggggaagcacgtgcaaagacctgagaccagactttatgaatagtgccacttggagctacaaggtcgagcaaaggcagtgtggctggagtagagaggaaccatgagaggcatgagatacagagggacttgccaaggagttcctaattaaaagtgcattttagaaagccactctggctggtatggagaatggattgaggtggatgtaggaggactggcttagaggcatggcagtgactgggtgaaaaagatagtgagttgaaccaggggtggagtcaggggaagcaacctgcaggaagatagaaatgattaacgtcaacagacatacaggaggttgggtcagcagggtcagtgagtggctggatatgaggggagaggcactgacaggttattctacatggctctctttatatctgtaacaattgagccataataatactaatagctgctccttactgagtgtctaccatagtcattctatagatgagaaaactgagactgagagtagggaagtacctaccaatagatgactgaactgagatctgagccccagcctgactcccaagccagtgctctctccactctaacactgtatttatgattctggtcaattcaatatttttctcatttggttgactgaaacctcagatttttcccccaatgtaattcagctatatatacgactccaagttctcataattcttttgcatttgaccattaattctcagttatcttccagatttcgagccatgctatgtttatcttcaggccatttcaaacagcagaggccagagaagccagttttgtggaatcgggcttgtcgggccacattaaatatcacctcactctaatgaaaatgcaggtttttgtttgttctaatgagcgcagggggcctttatgtccaatctcttcctagaggaagtaattgcatacgagtgacctttgaaggaaatcacatcagggagttatttgaaggcactgaggtgagccagtgcgtaacatcaaccaatgtactagcatttcagaaaagaaacaaataggcctgtcccactgacaactcatccatgccccctttggacagagaaaaatcatctactgcttgctgagaaagtgaggcactgaggcacagagatttctttaactatttcttgaacacctactgtatgccatgcactgtgcagaatcgctgcctcatggcactcctgttttagtggcagggaacagacaatacagaaatttttaaaaagtttaaatcattaaagattttgataattaccatgaaggaaacaaattggatcatgagaggtggtgaactgtacctcaacttcctcatctagttaaaaaggagagaatggtggaacttgcctcttggggctgtcttcaggactaggttagataacgtatgtattgggctcggaagaggtcctggcacattagttgaacacttagtcgtgttatgtggggtaacatcgttgttatagaataagtgggggaggcagtcaggaagggcctcctggaggaggtgacatttaagctgagacctgagcgatgaggagccaagcttatgaacaactgggaaagcaaaggctggagaccagagaaggaatgcttactgtttcccaggaacagaaaggagagggaaatcagccaggccggagaatagagagtagggtggggagtgaaatgagtgagggccatgaggcagacaagattccaaccaggtaattaactcagttttactctataagcaggggaagggagtggtgtgagctatgctttgaaaccccactctggcagctgcgcagagaatgacctgaaaggtgaaagctgcaagacaaaggaggagaactgcaaagtcgaggcactggtgggagggtgttaggcagagggtagcgaccttgttggtggcaaagtattagtttcttagggctaccagaataaattatcacaaatcggctgtgtaaaaaccacagaaatttactctctcacagttctggaggttaaaagtatgaaatcaaggtgttggcacagcgcttgttccccctgcaagctctagggaatgatacttccttgcatcttccagcttctggtggttgccagcgaatcctccgtgttcctcacctactagatgcatcaccccaatctctgcctctgtcatcacgtggtgctctccctgtgtatctctgtgttttgtgtctcttcttataacttcaccggtgactggattgagagcctaccctcatccagtatgacctcaccctgacttacatctcaattacatctgcaaaacctctgtttctagataagatcatattcacaggtaccagagagtagggcttcaacatagcttttgagggaagcagaaaacccacaacagcaaggtgagtcctgactgtcccacctctaaggggatgtcctggcttgaaagtagccccccatggcccagcttctggggtaagcaaaaccgccagccatgcacaaaggcattcagcatctttcctgtaattgggggttgaaatgctgtatagcgattcccagttgcttattccaaataagcaggcaggtggtgcagaggaaggcagcctgcagagtgagggcagcatgtcaaacaagggatgttccttcttatttgtctgtttccttaaaaccacttacacttctaggttgcaacttaagtgtactattatttaaggattccttttcggtgagtacccagtgactttgaacagtctatggatacaggtggattttcttggatttttagaagtgaggagacttggggttcatcccagatgctacctttcgtgtatggttttgaacaaatcccatagccccctgaggttccacttcttctgtaaaatgaggatgctggcccagcccagtggttcttaaccttgaggatgaatcagaagcactggagggcttgggaaaacacagattgctgggccccatcatggagcatctgattcagaaggtctagggcagtgcctgaatattcacatttctggcaagttcctagactttgttgttgctgctggcctgggaaccacactgtgagaattgctggcctagatcatctctgagatttctgcaacaatattattccataagtctatgaagctcattttaatgtaaatgactagatgaagtgaattttctaaccttagctagcaaaatttggatcccatataaaaatatgtcccagctactgctcactctgtttttcactttgggtttacctctctagacttaagggtgttgtacagagaatagaaagagagaggggccatttaaacaacacccttaagtatagagaggtacccaaattttgctagctaagactagaaaattcacttcatctcctgtggctagtggggcctccacatacaaggctcccagagaagtcagctgaatgttggcttggagcccaatagaatcacttagctttggtggcacttatttagggtggagggtggggcatagtagatgcaattgaaagcctgagaataatggcataaataagcccatgaaaagatgttcatcattagtcacttggaaaatgcaaatcaaaagcacagtgaggtacttcttttcacccattagaataatcaaaagagacagtactaagtgatgacaaggatgtagagaaattggaactagtgggtgggaatataaaatggtgtagccactttggaaagtagtttagcagtttttcaaaatgttaaacaaaattgtcatatgacccagtaattcccctgctagacttccattcaagaaaaaaaatgaaaacatatgtccacataaaaatttgtatgtgaatgtttataataccattattcacaataaccaaaaaatggagacaaatccaatgtacatcgaatgatgactgaataaacaaaatgtggtatggacaaaaataatcaaagtactgacacatgctagatacatatgtgtatatgtacaagatgacgctgaattttgatgaacctcaaaattactatgctaaatgaaagaaacaagacacaaaagactatatattttattgttccatttatgcgaaatgtccagaaaaggccaatctttagagataaaaagtagattagtggttgcctagggctggacatggaagggacagtgactataaatggacatgagatttcttttcaggatgatggaaatgttctaaaattaggtcatgctgatggttgcccaactctctaaatatacaaaaaaattatttttaattcatgttttaaattgagggattttatggtttgcaaattaatctcaataaagctgttaaaaataattttacaaatagaatggaattaaataaaaaaactaatgggatttcctgcacctccctctgaaggtcatttagtgctgaaggtggttatgacatatgcagattccaaatactgggctttagaaaatattatcctagttacccagtcagaaaagatcaggaactgcttactggaagaatggggacacttaaaacacaataaacacatctatttcacactccttatgtgccagacactgtggttaagtgctttacatggcttatcattcacttattctttgcaaagtatatttgttgaacaccttctatgtgctgggcactgtccttggtgctgaagatactgtgtgaataacacaaagtccctcctttcggggagcttaaacgtgtagatgtacaaatattatcttaagattattttaggtagtgatacatgaatttaaacaaaaacctggatgatgagaggtagttacagtaggtgggaaagggaacagtttagattgagtggtcaaggaaagcctccctggggaggcggtctgaggtaacacgtggaaaagtcatcatgcagacatgaggagaagagtggcttgggtgggaggaattgctaacataaagtatatcagacagcaagcagtagagaaatgacagtgtaagcaagggagagttctgtacaggatgatgctgaaaggatacacaaggatagaagctgcagatcttgagagccatgacacagagctcagtttaaagtttggcttttcatggaatagtatacagccatgaaaaatgaaatcatgtcctttgcaacaacaatatggatacagctggaggccattatccaaagtgaattagtgcaagaacagaaaaccagatgccacatgttcttacttataagtgggaactaagcattgggtgttcatggacatacagatggcaaaatagacactggagactactagagtggggaaggagtgatggggcaagagttgaaaaaactattgagtactatcctcactacatttgtgatgggatcattcatgcctcaaaactcagtatcacacattatacccatgtaacaaatctgcatgtgtacccctgcatctaaaataaaagttaaaattataaaagtaaatataaaaataaatataaaataaagtttggcttcttattccaaaagcaataagaagcaaatagtaagatctaagcaggtgagtgacataatttgatttacatattaaaggggaccctaggatctacataggaacagaaatataaaagatagaataaaagaagtgaacttaagagctaagagtgctgcaggaactacaagacaatgggggcttagatgaagatggtggcagcagggatggtgagaagtggtaggatctggggcatatgtagtaggatagacccaacaggattgtctgagttgtaaagggcagagaaaaagaggtatcaagaaagatccttgaatttgggcttgagcacctgggtagaaggtgcaccattacttgagatggcaaagcttccctttgagtttggctttactatcttcgtgtcatagatgaaaaatggggctcagaaaagctaagcaactttgcttcaaattacctttctaatgagtagaagaagcagagtcaaagtcagtgactcaaaaaactatcttctaaactgctcagtactgccttctgcccacggatttcttgcatccttggccagccagtagatggaaatcagatgaggtggcattcactgggtggagacagaaagacttcttggcagtgaaggctggtgggtgggcttgtcatagaacaaaaaagaaaggaacagcttggaagagtaacacttttctagtgaatcacattaaataatcagcatggcttatacccagtgtcagcctgaactgagattgacagctaataaaaagcacagtaattacaggaaaacatcagattggaaagtacagagattcttgaaacacctgaagccatttaatatgtcttatgtttgctccagactaacaggcagctcccagagcaagaccggtctcattactgagctaatggacattatgctctgaggtacttttccctctgccaaatatatcagaattttaaaaacggaagcctgatattgccatgctgcaaatgtttacaaggacatcgctgagtgttttaggtgtcaagtttaatttcagttggcctggcctattctcttaaggaaggctccagagcagtcagccaggtcacagggagaattccttctgctcttgctcttcaggctgtgacagaaatcagaccttgattccctgagcacgcttcccaagaagggattgctcctgtcaccacagcccaaaggagttagttgtgatgaaagttgtcatgcttcgctattccattattttaggtatgtttgggggttttgttggtgatggtgctggtttttgttgttgttgctgggggtgggcaggggtgatggaaggagaaactcattcacacattctaaaatattcatgagtcctcctctaaattgcagatagtatcttagattctgggatgatggcaaatacttaaaattaccaaagcacaaaagagacagcaaaaataaaatggtaagatctgagtgtgcattcacatgtgtgtgtgtatctgcacactccctctagagaccccacccacctgcctcccactggctcctgtacagcatgctggcttctgggggcctgggctgtagctctgagcatcagcagcctggagaacagtcactcttccatgtgctgtgcattttcctgggcatttttcacctcacaacagctctaatgaccttggcatcaagctcttactggggattaataactggctgggcttaatggtccttactgtgtcccgggccattttcccagccagccattaattccaggcagtgccctggactctggtcattatggttccctgggctgagaggctgcccagtggcaaatggccacagcctcctctgcagacagaggtttccacagcctaccaccctttctctttgtggcatctttagcaaggcctggggtttacagccaaataattggttatggcatcacattatgtctactttgtatgtggcagcaggtaggtttctcagaggatagataaggcagggggttgggtttcattcactcatttattcatccatctattcagtattaattaaatgatttttcttatgagtcaggatggaagagagactactaatctaggagtgaactaagatagatgcctatgtttcctaagaaggaacagagtgtctcaccaaatgaggctttacggaaaatgttccaaagaatcggggaggctgaacactatgaggaaaaagtcagagagaaggccttgctcagcggagagcccgctggagccacctcccctcttgtgtcttcggcagtacatcatctcccaggccgacgggcagagattcaagttcacctccctgtgttccacttagtgattcatcaacccagcatctgaatgcttaagggaagaacatgtaaatattgcatcaggaatcttgactcaccaaggcatgaatatttccacccatatcattaagacactaaaggttataatggtactgagagtgtgggagcatgcttctctcagaggactgtaccaaatcatgaggaacagggtcgcacaatttgtacaattttttgccattctgcctcctaagatatcatcagtccccctgaatacaagaaacagacttcattttgtcctttggaagtgggtcagcctttagtacatgctcttctcagctgctggaattgtaacattatgtttagaacagctattgtcattttattggcacgccttaccaaaagcacctaaggcatacttcagacttcgatcttttttgcattgtttgatgcatctgcacaactcaaagaacgagtgttagtgtctgacataatcaataccagagctcagatttctcaggtagcagaaatcaagagggtggcttttggggactgggtcaacctggcatgttctagtggtgcccactaatcacagagggtcagtatggcaaggtcaggaaacttggccttctcggaaagagtgttcagctggcctgctctgggcaaagagaaaagagagagcgccaggtccttggaaggcccctaaggcgatgtgtttcacctgccaaccagtctctgttctgagaatcaaagcagaataattaattaaggggaaagagatgctactgggacctttcttcagaatgttttccctagtaataatgactacagtaaaattacagatccaaccggaaaattcaggataattctaggtgagcgtgatgagaaaaagcagcttcccatggccttagggtccactgggatgaacttacaaagtaaccttattaagcaaatgtgctgagttacacagaacctcaggggtgtattaagtcctcagtgaaggtctttagaatgaatgaacaaatcaatgttgtctggccacaagtatttagtgtcaaagtcagtcctgccatgctccaccatcaaccctctgtcaactctttgcagtcagctgtggtctctacttcctcaatccgaccacgatcacactcttgtcacttctgttcagctgagactattttggccgaagtcatcaaatccaaagcacatttcccaagtcttgttttacttgtcctatgacactgttgactacttgctcctttttaaaattgtctcttctgctggtttccattacataatcctttcctggttgttctctcacctctctggctcttctggataggcttaaatgttccctcatctttggtcccatggtcccttgtgcctaattgcattatagcacttacagcacagttctgtcatggtttgtctgggggcaccctcaatgtggactgtatgctcttttattgtgttattaaggttggcgcaaaagtaattgtggttttggccattacttttaatggcaattagttttgcgctaacataatatctgtagcaccaggttcagtgcctggtacgtaataggaatttcaccattgaataaattatcatggaactcttccctcttcatcatttatgtatgggatgtgcaagtaaaataagggaaaggaaagttaagcatttcctccattttttggccactgaaattgcctctcatcccaacagttcgcccagggattcaggactccttactccagatttcagtagttttctgaggggaataggggccactttctggacatctggaatgtggcacttcctaaagaaggtttggtctcaaccacatttcagcatcatgtacttaatgttctagttagatgaatctatttcaaatgatcctccaaggaatggaggtctttggtagaagattcttgtcactttactgcatccactgagcccagtgccctcagagtggtaacaacactactgattaaaaaatagcatcactgaatttctaagaggcaggaaagaggcaatgaggtaagaaaacatcccataacactgattctgcttattctactgcactgtgttggcatcatggtgaatccctttgtctctgcagtcaggtttcttgggttcaaatttcaacactgccaccgccttacagtgtgatcttgagcaaactgcttcatttttctacccttcaatattctcatttgtaaaatgggagtgataatatactatcttagagtattatttgaaggattaatggaattatatttataaaaaatcagaacagtgcctaacacagttgtggctgaaaagcactcagtaaatattaactgactggccagttttcctttgtgcccccagctttgctgtgctctccacagccccttactccgacttcagcagagcctcctctccttatactgtatcacactgtattgtcctcctttactgaccactgtccctcactaaagtgtaagctttcaaggctatttgccccatttttgcattctgactgcctagcacagtgcctgtcatgtaagagtaattagatgttgggggaattatgagaatttgcaatggtagaacctccatttcataagccctgcatcaattataaaccctaagtgttcactgctgatatcgtgagtacttattgtacaattactttatggacccctgcattctcttctaaatgggtgataggaaccctggacaagagcaaaaggctccgcactgaccaataatcctaatagcacctaacatttagtgaatgatcactatgacaatcctatgctaaaggttcaaccgtatgcagttgctatttttgcaggccaaatattggcagtttcaaagggctcaatcgaatacggtatctatcttaatttttttttattctaccatagtagaatgaggttttaacctcagttagagatgagaaaactgagacttgtggaggttagtgtcttaccaaggtcccacagctagtaggtggtggaagcaaggctgggcccatcctgctacatcccagagctgatgctttgaggcaccacaaggcaagggaagttggctgccctcgggtgctctcagtgtagttctgaagacacagccatgtctcaggaaactcccaaaataaacacaaaactgaatatatgcactactaagttggattcaatttcctgagacagtacaggaagccagcgtgtcctgttcaaagttaacagagaagaagcgcatagactctggaaaaaatctaacaatgcaacatcccttcagaacatcttgttattttcttgtacatttgctggccttggcctcgggccgtaattacattatcttcaaacagcaactagaaatattgctcattaaacatgaacacgggaatgtttaatttgttaggacgtaggtgttttgaaagcaaatcattggttcagggcattgaactgagtgctgccattggagttgtctttggtgaacaccatgtcctggccagaactttgccatgatgcgtgttcactgcagatgagagaaggacctaggccctgcaattcctagctggggtctgtggctctgagcttgacgctttctttatgtttatgaaaatgggacaactcagtttctctccctcatccgttaaaatagaagaagcaatcctaatgtcacttcaaaattatggcctctaaggggttacaatcagcatgtcatttcccatatgatgcttagatgatgtgtatttggtacaaacatatttgtacagcatccaagaattttaatcaaggtttaactttcaataaggtgagttaagagcatcacaactagtgtcacagcaatttgcaggatagtctttgcttcaacttgggagtaactttggactcaaaaatacctagttttgaaagccggaagcacaactttattactggctaggaataaagggcaactttggacaaatttgttaacatctctatgcttaagtatcttcatctgtaaaatgaccacgagagaaaccttgctgggttgatgtgtcgatttggttatttaatatcagtaaagcccttagttcagtgtttgacaggtcagtgctagctcccttttgctcttgtccattgttccctgtcacccatttagaagagaacgcaagggtccataaagtaatagcagaagggatatactctgacatgatggggaggagagaagagatgggtgcccttcttcaaaggcagggaagtagcctgctggtgctgagtgagggttaagccctttgcccctgacagtgtccttctccccctgccttccagcccctgaaaatgcactgcagggactgtgccctggtgaccagctcagggcatctgctgcacagtcggcaaggctcccagattgaccagacagagtgtgtcatccgcatgaatgacgcccccacacgcggctatgggcgtgacgtgggcaatcgcaccagcctgagggtcatcgcgcattccagcatccagaggatcctccgcaaccgccatgacctgctcaacgtgagccagggcaccgtgttcatcttctggggccccagcagctacatgcggcgggacggcaagggccaggtctacaacaacctgcatctcctgagccaggtgctgccccggctgaaggccttcatgattactcgccacaagatgctgcagtttgatgagctcttcaagcaggagactggcaaagacaggtacaaaggcacagggaagaagatgcaggggagggtgaggataagtcatcactggctgactcacccaaagcaaagcttttgctacaggcttttgttgtgggctccactgctcatgtcattgctagagttcacttgtagggtcctctgcgtgactgggctgctcaagctgactttacaagacaaagtgaaaagaagcatggagataattatatggatatttcagggccttatttttgaggaagaggctacacagctcctggccttcattggttaaaagtgcagtataacagctttattgcatttcattttacttgcataaaccctcaccaaaaaaaaagtatatgggtttattttttcccattcaaaggcaaacatttatttagtcaaccaatatttcttgagtgcccactacttgctcatcactgtgcttggccctggggaaacagtcaaacacaagtatataaagccttggacacttaccaagtagtagccagtgcactgagggtcttgagagggaagaaaatggtgctgtagatgtgccatgggccctagcccatggaaacccaaactgttagctacaactccatattaagacacgaaatcaatgtagtgaggcactgaaagattttttttctaaagtaatgggaagaatgggataaaatggaacagagtagaatagaaaagacattatcagcattcatcccacatagtaagttaggtaaggtattgtttcatgaaacttttatttcagtttgatagagatggagatagatggatagggatttcttctcaaagtgatgaaaatgttctgaaattagtggtgatggttgcacaatcctgtgaatgtaaaataaatatcactgaattacacactttagaaaatgaaattaaaactgtgtctgtgtgtctcaatcatgatgtaaaaatgtatttttcactataggttgaaagatttggaaattactggtctgggagataaggaaaatgctttctcaaaaagatgtacataagctgagacccagggcaataagtcttggataaagtaaaggacctggggagtgggagggagaaacctccctggaggtccagggaatcaggtgtgagagaacatgcagtgggttggagaaaagccccctgtggctgcagtcaggagaactagggggtgggggtgacacaaggtgaagaagagaggtgaaaagatgtcagctggacaaatctaggtgaagaaaggacaatgaagaatcaagggccactagagagtacagctctgggttggaactctggctctgtcactctctagttgtgagggcctggacaagttatctaaccttttagagactcagtgaccttacgtgtgaaaagggaatagtgactactaatcgctggatggactggtctaataatcaaattgcctcatttccttaattctaaaacctgtactttcatacgtttgtgatgtaatttacccctcttacaaaaactgttactgagtcaattgcttatctttaaactaaaggagagtcagacttagtggtgcatgcctataatcccagctacttgaaaggctgaggcaagaggatggcttgagcccaggagttcaaatccagtgtgagcaacatagcaagaccccatctcataaaaattgttttaaataaagtgatatgataaatgcaataaagaatataaagtaataaatccattctttggctagcagctcattattagagaatagtctcaaagaaagacttaagtacagtgcccccaaattctttgtgtggaagagctagatagcttttaaatcctagaaaccttgtgactagtcaaggactgcaccaggcaggaggcatgggtctggtggaggaaggagaaagagctggctgttggcactgtggccttcctcactggaaggcccagcagaccccatgggcagcccagccagcagatcacattggggattctgatcatcatctccagctgccacaaaatccagtcatgcattgacctttgcaactcacagataagagagactgtcactcagttgaatgagttatttaatcaagaaaacattttataaggaatcaagaaggaggggaattatttagtttcattttttacttgttggaaaatttgaaataagtagaaaccatctcaatagaaaacacttttctcttttttagtttaatggttgattgctaaataagtattcctaaaacactgccgcaatgttagctatttagtataattaaacattgttctggactccttgagaaatcattttaagctgataagttagatactaagtcatcataccctttggccactcaggatctttaggaacccttctcacagcaaggcatatcctgctcactaaattcactaaatactggccaatgagaagctttttctcaccaggtctttcttcctggtcgtcctggctggtacggagggagccaaagctttgtggagtggctggtgggactctttccacagacatccatctgccagggtccacgtagtccctactcaggggaatcacacttatgaatgtggaggatgccagagtacactgctgcttccagaaactttgtgcctcttgccttcgggaaacagtcttaaagaagccaatactctattgacttaatattctttacctgtagcctgctccaagctaaaagaaacaagtcagaaatggccattcaggacaaaactatttctgtaaattaaaacctaaaacatttagggtgtaatggtatttctcaatgtatgcttttcttcaaacccaacaaaacagtagcatatgatacataaagtacagaatatctaacttgcagatctcatgatcaggactttccttttgggtgaatattttgaagaaatagggtcatttaatagattgtgattgatagaagtttcaccctccttaaaagtggagaaaaaagtggctcaggaacaatctgcaattaagaagcatgacaaatgacttagatggccaagtggtattctttgatattaaaaagtaactgtacttgaaaataactttataattgaataagggtacattaggaaaatatgattcagaaccaatattatagtaattagataaaggaagcgtaaatgaaataactgcaggaagaatatttccatagagattataaatgagattctggtggagcagaaaggcccttaattgtaatttagtatgcactatagaattatcagctcagtgtgttacttcatcatataaaagaatatctgataattttccctaaaaagcacatgacagctcttcatattctttcattacagctgattaagtgtaaaaacagtagatattcctttgttagaaaaagagttcaacaaagagttttagaaagacagcacaaagtgttgcatttctatagcacgtgaccccagaaggctgttatttaggaagtctggggaattttaagtgttactttaaagaactcttcactttagtttctttcgtcctctaccttgcattcttttccccattttacccacaaagccttttcctgtgcagccacatcctcctgtattcaggctgtggtttacaatctctactacatcacataaaacagaaccagagttatgggagagtttctgcccttggagaaagccccctttggtgtgtccaatagctctaaaagcagagggaatataagtgtgattcccagattaggctcctgaagctgtaagtgagctgtcatcctcttcctgggttccacatcctcccagttattcactcacccagattaggtctagaacacatggccagtgcattgtcgcagcccataggtgaaaacagcttctaacttaagggaagccacttcctcttcttaccctttgccattcagtcagctcttctccattccagctccttcagtctcaaaggtcttatgaatatatagccttagtgagaaagaaggaaaatcattaatacctatgtaggctgaaggcttctgaatttcataattcctgccctgactactgatggcagtccctacacagcccccagtagcagaatgttggaagaattttcttcatggttgctaaaaagcaccaaaaagaatggtgaaattatttaccttgattgctcaacctagaaactaaaagaggaggaagagatgtcaacgtaccaacataccaaacttggtgcttttcatacatgcttgcttatttagctctcaagtagcccaggggacagagattcctatgcctcctttatagataagaaatgaagggccaaagatcaacaataacttgcctcaggtcatccagctggttatgatagaaacaggtaagattcagcccacttattcccatctttaggagcttttaaatatgctttctgggatgttactaggtcaaaatacaatggaataggggaatgaatgagcaaagggcttaagaaatagaaagttgaagccatgatccccaggaataactaagccacccatgctgtcaggtattggacaaaatgaaggactccttaaaaatgtcctctctctatttttttttcttttttggtccttatatgaaatgaaaataatgatgcaaactgatagacagaaggttttccttcttctcaaggatgggtgccacacagtgcaagtagaaaagccttcctgcacctctgttattcacatcacaaatgatgctatggctgggcaaagtcagacagtctgaccttggggataaggtgtttgaaactggctaatgaggcatgccgtaagtactgaaggaaaagtaaaagcagcaacccccgaagaattgaaattaatatccacagtagtgtagcatggtaggctgagtcattctcacaggatcaaattagaccttggtgttatgtctccacagttatcctaaggtgtagcatatggtagaagctcattacagatgtctgaatgggaaaattaatgaatggtggggtgcaccagttcattccttaaattttgtcaatttttggtctcctagtaaaaattttctgatatgtaaaatgaagcaaatgttcagttaaatataagcattcctgtggctcttttcctctggtcattagcccatacccaaatgagtgtacccttcttacggaaagatattcaatcaagatgttggtgttagtctacttgaaggcaagctttcaccctaagttcagtcaatcaaccaattgactaatagatagataaatacatgtgaatgtttatttatatttaataagctactcattatctagcctgtttggggaacaaggagaatttctagttactcaagtgttctcgttaagaaagagttgttaaacgggggctgtcataagaaattgagttgtggtaacatacacttaaacatttaaacactgatcatcatctttgatgatgcagaagtcccttgagcatctttcattgtcacaaattcagcatgagcattaacatcaattatgattgtactgtggaatatggtaatgttagtaagagatgtcaatttgataaagttccagatatttaccaaatggaggagagagggagagactcttgtttatagttagccttactctaggaaagaattaaagatggtagtgggtataatggttactttaccagcttgcagacttaattattgttccttccaggaagatatccaacacttggctcagcactggctggtttacaatgacaattgcactggagctctgtgacaggatcaatgtttatggcatggtgcccccagacttctgcaggtaggatttattctgcaagtgtaaatcatcagccgtgttgtgcaggatttataaatatctgattctgaatatcaaccatgaaacatgtctaactgtcttcttgaagcaattaattagcatgtcccaagttctcattctagaaacaacaaacagcatttaattatgttatataaaatattgaaagtttttgtttgtactgctggagaataaatccatcttgtgggctccatttatcctctgaatatttatcagccagaagtaatgcaataattggcataatattaacgatgaacaagcattaagaaatattagttttactctcatttcaaaggaatgtgataattttttaatgaattaaagagagcaattcctttgacagtgagggcttttttctaaaattaaaatatttctctgagcctccttcccttgccacatcagtggcctgggcttgcacttctaaggccaaaagcacaggcataaatattttgaggtgtcactttaaagagaacatgcatacatctctgttgccaccttaactttcctcctggcatgtgcccaggcagagttcagggcataccacaaatgcactcagcaatattcagggcctgatttttggaagcctgcttgaaaactcgcctgtaatttaaaatagtgagaccagaaattccagaaagtaccctagtttttgggaacgcctgatggcctgcacatggactcaatcctgattttcaaatggcaaaagctggggtggggggcatttaaaacttgctttttaaattgtgtgcttacttatactatctggtgttttatttgtttattttttctaacaatgtctcgaaggccatgagtctttaggcaaaagctgcaatttggaggtttaaagcaaagatgagaaacagcatctaatcatcccattaacattttaccacttttctctctttttaacccaaagatccaacacagcaacaatactaattgatatggaagagtcaggccgcaaaggaggagagagaggtacagatagagcagacctttgatgtaaggtcagggtcaaaaatgctggggctaggctgcacaggtgtaaagcctggcctggtcacttacccacctagtatgaccttgaagaagtcacttagtgtctctaggtctcagcttcctcatccatagacgtggatgtgatagtaatagactctgcctcaaagggctgtaggcagagtaaataagctaatacatgtgaaatgcttggaacagtgcctagtaagtacatggcaagcacaaggcaagttagcttggatcctcacccagtgctgcctcacttaattcactggccctgtgtccctgtttaacaatctatacacaaaaagtaagtagaatggcctaaaaaggcaaactgcctcctcaaaccaacaggctaacagagacagtgagaatggcacttatgggcatgcaaagagccatcaacgttgatgggtatacagcagatataattatgcaatattgccattaggatgccagaaagaaaaagcatgaataaattgaaatgttaatgacttcaagtgttcaaggaaatattccatttattatggaaaacaaatgaaaggcaagttaacctgtcatttctcctactcagagttagttcatcatgacttcatgtacggtaggatcgaaacaatttatggaaaatactaacaaagaaattaagataatgtcaatgcattacatattgccactggctctgagtttctcttcctaagctatcatccccaaagctttgatagttgtttgcacaagacagtttcagcaagaactcttcaaaaggacccctacgcccaagttctgtcagagaagtgaagagtgtcatctggaggaaaggttcagtgctggagagagcattctgctcagtcataaagcctgttaaaggaaggttaagaaggaagaccaggagtagcacagatggattctacagttctattcatctgcatttccaggacatgttgactggaccaccaggcatccagtttcgacttgttgggtcttgaggcttgttttccttgtttgtaaaatggggataagaaaataagaagacgaacaagcaggtcatggtgagaattaaatgagataatagatgtagagtgttggatgcagttcctagcacacagtattcaggaaagagtatcaatatcattaatattaataagatatgtaaaataatttatattattaatattatcccaagcacttgagagtttccctgaaagataccaagaattctgagcagggggctggttcacaactataatcccagcactttgggaggctgaggcaagcaaattgcttgagctcaggagttcaagaccagcctggccaacatgacgaaaccctgtctctacaaaaaatacaaaaattagccaggcatgatagtgtgcacctgtaatcccagctactcgggtggctgagcatgagaatcgcttgaacctgggaggcggaggatgcagtgagccgagatcattccactgccctccagccggggcgacaaagtgaggctctgtctcaaaaaaaaaaaaaaaaaaaaaacaattttaaggggggcttcaaagacacagcttcttgcctcctggaggcttataataagccttacccatgccaaaatataaagaacacagcaaagccacttaccatgtgactataaaaagatgcagcttttgcaatcttcatctaagagttaaatgagtctgtaaacagtaccttcctcaccaccagagaatgaaaaagcaactggtaggctagtctgctactcatttgaccattccctcttttatctttattttgaaagaagcagagaactatttggggctgaaaacatggtacatgtatcatgagctctatggcttaaggaggtaagctatcgccagggccaaaaatggttgtggatggttttgtgtggtggcagagctcacattggctgggcccattggaatatagcctccctgagggcagagttctgtgtgtttacttcagtgttgtagacctagaacacaggacagtagatatttactctcctggcatatggcagatacttcataaatatcaagggaatgaatggctgtgtcctctactctccgtagtgctatagtaaagggtgttgtatatggataaaaatagccatttctgcctctcagaaactctgactttgagaaagttacctgacctcactgagccttagtgactgatattgggcaagctacctaatgctccatctcagaagccttacccacaaaatggtgatgacaattatcatataaactctcttgcattgagagtttatacgataattgcatgaagtcatagatgaggaatgcttagcaaagtctcagggcctgttcagtacacagaaagttatggggtgaaaggattcactgatctgcagttgtggatgctcattggcgcattttacagaactggcattatgtggcctccagctccttgcaggacatctcatgggctgctcaaagtgtgcctggcctttctacagcttccctaagttcccagtgtctcactgcaatgaagagctagccacgtggagccagatttcagcaggcaaaaagagagccaactcttcagtttgggcaaattaaccatttcagaccataagacaaaattagtaccctcaaaaaagtcactaactaaataaaccacaagccttttattcattcagctaactcgtgttgggtaccagggaggtaatcagagatgaatgagacagggtctctgccttcagttgcctgagactcagttgaccacaattaaatcatgaggtacagaaggttactcgaggtgcctgtgggagaagatgttcactctctgcctgtcagcagcatctgacccactgagctttattggaccatctgtctccaactttcaaactggactcagagaagtccttgcattccactgattctatcaggtggcatagggataaggagccaggacaacaggaatattggacccttccacccgacttggtcaggggcagacccagttggctctgtttgcatctggactattgtataagatttcttttcaacaaaagagcatttgacaaataagaactttaacaacctctggtctaagacacaaccatgatgctttccaatctaaatcaaactctttcacacttttcaggagagtagaatcatcaccttattattgtcccaaagagaatgtaagctgtcataggcatggtgtgagggagcagaggcagtggggcagagagagaagggctaaattatatcttgggggagcaaactgccaagcaatccgtgagtgcctgatccccaaggggaagtgtaggtaacctggagagtcatttcccatcaggtgtcctggaggtctgccttctcatctcacccaaagggcctgagttacttctaggagtcagtcattggcaagaaaactaattgtaccccctaaaagtattaagcccatggacttcttaggaagaaagatagcattgcattcacatttaaaaccccaagtggaagtggtgggcatataaatggccatggtggcagatgacagacatatctcattcaagatctggcagaatctaactgactcaaagtcatttgaatggcatgcagcatctttcatttggtactgtgatggcctcctggactgctctctccatcacttgtcttcttcctctccaaacatgactgccttactagatgacaaatctgactgtgaagagtcacttaaaactcctcagtgacttcccaaagctttgtgagcagagttcatactccctagcttagcacacaagaccttcaggatagggcttctgcataccactttagtcacatcttctctactgatgcatttatgtgtttatttgtttattcaaccttactgaaaaattcataaaggaactcaccctgcagacacctgttcctatgacctcagtttggactgcccatcccctacttccttaagctggctggttttccactggctctttactaataacattaatggctgatatttgttgtgcacatacttcatgctggctctgtgcttaacatgaacacatgcattattttcttgaaccttataataatcttatgaggtaagcatcattaatatcaccattttacatagaaggcttaaagacatgaaacagctgcccatggtcatagggcaaataaatagcagagctggaatttgaatgcagtctgcagggctcaagagccaatgctcttaatccttcagttcattgtttcagatacagtggcccttctttctcagctctccttagccccctgtctgagtcagacctactgggcccactgggcatccctcttcctctgccttgccccatctcactgattggtttgtccatctcctttgtttgactctaggctccttaagaggagggccctgtctcaatccacatttgtatcattagcacttgtcattgtgtctggcatagagtgtatcttcagtacagattagttcaatgagaaacaaaaataagccctgtccatgggggtgtttaagagattgattctaaacgttattattgcaagaccaaaagtgccaggcacattaaaactataactagcaaattcagattttgagaagtcaatgagggccacattgttttattttcagccagagccagctctgggtactcaaagaggggctcaggcatcagcccccatcctgcctgtatcaccagacttcaggcacatcaaagttgagaaagctggagaaaattaatgccatgttgcaccagaaacagcatcaaaatatattattcagtggacagtggactcttaaatcatgccatatccatactgtaagccaaattcattctctctagatggcctataaattgcgtgaaaagatctgttgtcgttgctttccaaactaagttatgctaagtatttaatctcattttccattataaattatttgtgataataatgggccaagcatttaaattctacctaataatcttatttctggtcatacttagcacattaccaagtttacaactctctgttacccaccatttcttgagtattaattagcggggtaatgattcagagtgatcactgtcatggaactaaattaatatctcatccgcaatatgaaggacatctcaaaggtatcatgaatatcagagagttgatgctgccagaattattagctagcgaacattaataaagctgccagcctaacagggaaagttcttacttggcgacagtccaccgggtagaatcggaagcttactcacagaagacgggtgtggaatggcaatgccgcccatgtggtttatgttttatgaagtagacttaaaatatatggttgtgtttctcccagggtgagggtggggcttgagtgattcactgtggctctttgtcccatgaactgtgggcagctgcaggctcttggtgctccatgcgcctagacacacaatgctattccatgggcttccaaggtatacagctcttttcctcccataagaagatccaaggaccagaaatcaaggcagcagaataagggtggctcagggcacctccaggactgtgacagatgcttgggaaggactgctgcaggaatgttttcttctcaatgcctcatagtgtcaccaagcccccagagcaagccaattgcagaacaacctagcagcttcacagctattaattcaactctattctctctattcttcaaacatttcctgagtacctactatatgccaggtactgcaccaagaatagaaatgtgtttaaagagagtgtctaagagttctagagagaggcaaagacaccattctttcctcaggatatttgcagccttctgcatagtccagccccaaacccagtgggcagggttaacctagatcacactataggagagaaaaagtaatttcttttcctcatccatcataggttctttgctgagactcctaggaaaaaaagacagattaacaagagaaaagcatacacatttatttaatataaattttacgtgacaccagagccttcagaaatgaagagccaaagaaacagggagacctccttatttttatgctaagcttgatgaggaagtggatagctgtgaagaagtaggattggacaaagcaggtgtgatctgatggtaataaaccagggtgggtgggaggaggtagcaaggtatgtttgttcagattcttttgacatttccttgtctttgaagataaggatgttcatttcctccggatatatggagggtacctctggaatgaaagtttatgacctgctttagacgagggcaaagaaatcttttatgaactgcatcagaggagaacagtgaagggaggtgaaagtgatctccctgcttctgttgtttcctcaaatgccaaggtaccatattttggagcaacatgtcctaaacctcgtcagtacccagaaatggaagtgtcttcccttgcttgttagggttatgaggtttttttcagttgtaaaacttagctttagaagagtcaaaaagtggaacattacaaacccctgttgccattagcaccgatgggcagaattgcacatgagcacaaagcctctgtttaacaccctgagcagctcgcaagcaccacacatggggctcctctgtagcaagagctcggaggaaagcggcaaggacaagctgctttcaaccacacactgttgatcccagggaaacctgggtgccattagtacagaaaccccacctgggggaaaggagtttttccaagacacagaacctcactcttaagagtacagagtcaactggagtcaactggctttggtccaaaccttggctgcgaaacttcagtttttctgtgcatgagtttcctcgtctgcagagtaggggtgctaatagtagctctctgctatagtttggatatgttttgtttgttcccaccaaatctcatgttgaaatttgatcctcagtgttggacgtggggcctagtggcaggtgtttgggtcatgggggcagatccctcatgaatagattagtgccctccctggggcggggcatgagtgagttctcactctatttgcccccaacagagctagttgttaaaaagagcctggcacctccccctttctcttcttcctctctcgccttgtgatttatgcacatgccagctccccttcactttctgctaggagtggaagcagcctggggctctccccagatgcccaaccttgaattttttgagacatcagaatcatgggccaaataaggcttttttctttataaattacccagacttgggtattcttttctagcaacacaaaatggactgacactgtcttataggggtgttgtgaggactaaataagtgagtgtatgtggagtgctgagcactgtgttctgagctgaaatagtcaagtccagcagcttggatggacaataagtcaggttgtgtgctgaaagccaggcagtggactgtctccctgggtatcagatgctccctatcaaatgggagctgcaatacttgcctcagagggctgatgaggatgtaaaggagatcacatcagttaagcgcagaagctgagcaggtacttacaaaatcagttgtctcaaacttagctgcatattagaatctcaaggagctttccaccatttgaatcttctaaaaagctttgttgttatgatatgtattatttaaaaatatgtttatttttgtttcaaataattttagagttacagaaaggttgcaaaaataatactgagagttcatataacttttatccagcttcccctaatgcggatttgcattcctatggtccaattatcaaaagtaagaaattaacatgagtataatgctcagctaaactacaggcattattgagattttaccagtttctctactaatgtcctttatgtcctccaagaacgaatccaggttccctttgcatttatttatcaggtgtcctcagtctctaaatccatggccgttcctcaggctttccctgcatttcatgacacttttgatgaggactagtcacgtatttcatagaatgtccttcacttggggtttatctaatgttttcctgtgcttagattgaggttatgcattactgagaaggataccacagaagccataggcccttcccagaatctcataacaggaagtatgtgatgtccatacgtcttattactggcaatgttaaccttcatcacttggttaaggtaatgtctgctgggtttacctattgtaaagatagtatttttccctttgtcattaataaataacttgggagagatactttcaggttatgcaggtagcctatttctcctcatctttttccccattaatgttctgttcatttggtgcatcttgcctgcgacaattactgcaacgttctgaggatggtttcctagtccctcattttttctacattgtttattggaatttttctgtcttgaaatgctgtttcttctcctccatttatttgtttatttattcagttatttattgaaattatcatggactcatggatatttattttattttattggttttataatccaatactgacattgtttattttggttcaaacctaagacactttctaaaatacctgtgcctgagttcctctccaagtcatccgaagcagagtctatggggttggagcataggtatttccttaaagctccccaaccgcactaaatgttagttccctcactctccccacctgcttcctctaaaaagaaaaaaaaattcttcctcaaatcattctgcagggcttgttctcaaactggctgtcagagtgtgcatggcaggctgcagccacttggggaactggttctgtggttatctccattcctgcctccccagcccgcatatcctttccttcagctcacggggcccacaatgggaacttgagtaccagaattccttttacaactgcttcctcatgtggaaattccgctgaggtttattgtagttttcactgaggtcaggtgaaggaagaaaaaaactagggcagtctttagaaagtcaggtttgagaaaagacccaaggaagtatgaccttcagctaggagtgtctttctaaatggcatagtgaatttagtgaattccagctgatggcaggctcacagctggggtagatgttcctgcagtttccagcgctgccttctgagtcccagaaagcacttttctgctgcttggacagagttttaacatgtggaaacaactcgcttacatgaataacttatcttgacacctctgaaatcacagtaaccaaatatgtaaatttaattctctttttaggggatcaatatggagtcagataagttttttttccaaagagatggtcttcctgaataaggaaattgatcctgtagcatctttagctggtttccaattgccccctactcctaggtgccgaatcaatcttatgatatttttagaaacctaactgtttctttagtcagattgatgccaataaaatgtccaaaacttagatgaatcaaatttaaagtgatttgtgatggaataaaagcttaaccccaagcataccatggcaacatgaaattggcatggttcccccaaattatgccatatgaatatgggaagatatgtctcacaaattcttatttttttcttcatagtggtcagcttcaacctgaatttttgttagaaggcattttttgtgttaaaaacaccttctattaaaattttaatgggattccaatttctagggtaagtaaattaataaaatctgcaataactagtcaggaaaggatccagtgtttcactacagaacatagagataattccaagacgggcatattagagatgcaaagtgttaattcagcatagcatccaaaccaggataaggaatgtttagatgctgcatgacaaaaataaatctctcttcctggaagaactttaacctaagaggagaaacagctcaaaggtttattgttgtcagagccaaaaacatgacacccctcttgataaaagacttcgatccctgaccccagtagagttgctactctaaaagctatttgtgtattgatctcctctgaagaaaacgaataggtgtctggcaggatgagcatctttgggaaaccaagttattatacttagaggagagcccaggtgaccaaagtgggaaccctagggcatcaggctctgaaagatgatttgcaagatgctgggaagcctgggccttttctcttcttagtctctgcaacaaggccagttgctgagcatagctcaaattaggaaagtttgtctgccaagaaaccttgactaatcttaccattcattcttcaaaagacagaagaggtgggctagactggcctgttttagaaaccagtctgagaccaagactctttagtgcgtaaatatttattaaccctcaaacaagggcacctaccacccccacatgttaatcctatgcacaccatcttgaagaaatgagccagtacttcctgtttgaggctgagacagagatatagaggcagaaaaacactcggagactctcaggccaccaaacaaggactgaggatgtagagtttctggactaaaagactgtagactttgagtacataggccctctgaagcatcaaaagaaaaatcgtggcctcttgtttgctgtcttcctttttctcccataggatcaaactaagatcatcaactttccaaactcagagaagaaatttgcgtttagctgctaattccatataaatttagaagtttgctatttagctgctaattccatataaatttctttcaacaacataatttttaaaattatttattaagcacctaccagggactgttccaggaataagacaaaacactgccctcatgaacacccaataaacaagtaaacagcaacaacaattccagacagcaattgatgctataaagaaaatgaattcaagtgagatgaagtgaggggagcaagtgtcaggtaaggcctctcagagaaggatattacttgagctgacacccaaaggtgaggagtgaactcagagagggtattccaggcaagtgaccaccatcaagtgcaaaggccctgaagtagggatgagctttgtagagttgaccagaaaggccagtatggtgggaacatactgggaatccacaaggctgggtggattaggagaagacttagaaggggagccacatcataatgcatcccagcagccatgctctctgtataactggaagcctctggaagcttagtggagtggggaatgggaatgacatattttgttttggtaatatctctgcagctgcttatggtaaatagactgtaagaagagtgaaaacaatactattgttgtgacttattaatatgtagggtctaaatctgaggagactgaatgttctgcagctcattttcaatctctttgatgaaaatgatgggcactgattttatttcacaacctcaaaacctctccacttccttattgtgtaatcagaaaaaccatttgttcaaactcatttaactagaaaatacaatttttatcagcttattaaagataacatcttacctcaatcagtcaaaggaaaaaaaatttttttgctttaatcagttatctcaatttcctcctacagggatcccaatcacccttcagtaccttatcattattatgaaccttttggacctgatgaatgtacaatgtacctctcccatgagcgaggacgcaagggcagtcatcaccgctttatcacagagaaacgagtctttaagaactgggcacggacattcaatattcacttttttcaaccagactggaaaccagaatcacttgctataaatcatcctgagaataaacctgtgttctaaggaatgagcatgccagactgtaatcccaggtattcactgcatcagacaccgagacactgaacttcctgagccaccagacaggaaagggtagcagaaaacagcttcactcctcaggaagtaccatggacagacgcctaccaggggtgacaaagcagtgcagttggattgtaaggaaaaattcc

SEQ ID NO: 8 - DNA, 37349 bp, Homo sapiens
cggagagaagcaacattgctggctctgatggaggaaggaagccgaggaatgccgccagcctctacaagctgcagagacaaggaaacagactctcccccacaacctccaaagagaaacgcatgctgccatcaccctgatcatagtctggcctgcagaaccaggagtgaaagataatacatatgtgttgttttaagccaccacgttcgtgaaatttcttaacagcagtagtaggaagctaatatacccgccaagtagagattgattaatttggttaataaacaacaactcctaggaaaaagaatgactcatatcctaatgcaagtcagtgtaaccaccatgctttctgaatctgagttccaggatactgcagaacaaaggcttatgcaaaaagggcaagccaggaaggacttaatggcaatttctggcagttaaagcatttttctgtgtttggaaaaaaaaagaattcaggcagggggtaaaagatagaagctccaagagacagaaaaaaaaagttaaaatggatgggaaaagacctttcacatcaccctaaaccagctgagagccaatccccctcccctactgtctttgacagctgagcatccatgtacaggtgggaggtatacactctcaggcacaatcttaaaccagcccagcctggctctcccatctaatgcagaggagaggcccacctgagcttagaaatgctccacaaacctaagctcattcattgcttaaagaaccagcttcaccaaaagtacttgtagggagcaccagagaaagcccatgacagctgggcagcagggtacttagaggacaaggaagtcacgctactaatgtcacaagaatgatgggatttttctcttcacttattcaacatctctataccaggtgcaaggcaatgctatgcgccaaacgtggaatgttcatgccaatacaataaagttactacttaaattttaagatgtgagtgaaagaagcaaaaggctacaaaagctgacagccaagcagaataaactgattgttgttagaaaagaaattatgttctgttagagagcctttgttgttttgcttcacaagtcatgtgctaccacagtaggtgctcctttgggctgttagtagatgaactggttcataagcaaccacattggggtaaccagcatcatactgccaagctctccaccagaatgatggctcagcacactacagcaggaagtaacagaattataaaggaaaaagggagggcatacctgaggctcaggttctctgtctggcattaccccaaaatgacttaaaatttgttctttcatgcgatcctggagagacgcgaaccaggaaacagactgttgatgcacagaatcgtggagagcggcaagttcttcatactctggaccctccacctgatcagggaaagaggcacagctgtgtgaaccattcacagtaatgcacgtaacacagtcagcgacctctgcacctccactaagtggatttgtggcagttagcattttaataattcatcagtttcacaaaaatggtacatgctcaatatagaaatctgcattttttgcatagttgaaatctatcaattgtatcctgatttttctcttaataccataatataagcacatttcctgtaattttgaataatgttcaatggctgcatgcaattatatatttgagatacatgccaatttacttaactattcacgtaagttatttagaatattctagcttttttatttttaaaaataacacaataatataaacatttatggaaaagttgttttgttttgttttgcttttttgacaagggagggaggtatggtttcctcagtgtagtttcctagagaccttgacagaattaccaagtcaaagggtgacattttaaaaattgtattccatatcaccaaactatattcctaaaggcacgacagggcaagactacactcattacattggcctgggctgatggactccagcttgtggtcggccacagcaccttagactgaccaagcttggcctctggtccctatgtcactatcacatctgtcatttaaattacgcctcagtcctgttcaggaacacctggtagaggaggaagagcatgggactgggaatcacggggccagggtttggtctggcttcatcaccaactctcatgtgtgaatctagccagtctcacagcctcgttagggcagagttttctcatctgcataataggaataaaccatgaaggtcctttcctgttacaaaattccagtacctacaaaaactacggtgtgctgagaaattataatataatgcatataccaccctcaatttgatttatacaaatcaaatattcatatgtgatagaggattttcttataaaaataagctaaaattatttcatgttgtagctatttaagcccccatttaaaataagcgcatacactattaaaagctgtcatctacaacaacggtcaataaaccctgccgtcaggtctatccatcccacagagagaccctgagaattatcactttcagctgtagctttgaaacccagctttctggtccagcctgggagctgggctccctgctctgctcccatgcactgggatgaccagaaacagcagctggaggaggcacagagacagtgtcctgggtgtgactccattcacaaatcctaagtgtacaccactgcccccaaaatgacttccagtgtgatgtggggtggctacgtaccctcacttccacaattccaaatgtcaaccaaagaatttaaaagagggatacaataattccaaggatttcctccttttaagtattttaaaatttcttgctgcagtataatttacagaccaaaaagtgcatagatcttgttgagctcaaagagttttctcaactgtatacaccagtctgaccatcacccaaaaccagatagacatttccactacttagaaagattcttcaccactccctccagtcaattacaaagccaaccccacaagccttttctgacttctgtccccagactctagttttgcctgttcctggaagtatacagatgaagccacgcggtatgtgttcgtcctgtgtctggcttctctcacttagcataatgtctgtgagagtcatccatattgtttcatgcacgagtggttcatttctttttattgacaggtagtattccattgcatgaatggaccacaatgtgtttactgactcaagtgtgatcagcacctgggctgttcctggtttggggctataatggagtaagactgttatggacatccttgtgtaagtctgttggagaatctctcaaaacattttgctaatttgtcaaattatatgtcctgatatttctattagacacatgaaaaaattcttaagggttaataaattcaagtcttttatatttagctttgggaggtattttttaagttgtagattttgtcacattctgaattaataccaacctagagaacagggactgacagactgctgttcatgagtcaaaccgtgctcaccaccatgtttccggaagtcacatttaacggaaaccagtcatgctcatgcctttacacattgtctatggctgcttttgcactacaagggcagaactgggtagcttcgacagagaccacatggcctctggagtctaaagtacttattagccggccctttacagaaaaagtttgccagctccagggctacagcatcaaatacaaatcaaaagcctattttgcaatgcgcaggtttacatgttgcataagtacaataaggtctttttttttttttttttttttttgagatggagtcttgctctgtcgcccaggctggagtgcagtggcacgatctcagctcactgcaaccttcagctcccaggttcaagcaattctcctgcctcagcctcccaagtagctgggactacaggtgcccgccaccacacatggttaatttttttatatttttaatagagccagggtttcaccgtattagccaggatggtctcaatctcctgacctcgtgacctgcccaccttggcctcccaaagtgctgggattacaggcgtgagccaccatgcctggccagatcatttttttaaaaggagatttctgtaccagctcccaactcaggtaaaaatccactgagaaaataaataactgctgaaggcaggggctcatgcctgtagtcacagcactttggggctactacactttggttgaggtgggaggactgcttgagcccaggagtttgagaccagcctgggaaacacagggagactctgtttcaacgacaaacaaaatttaaattagccatgtgtggtggtgtgcacctacagtcccagctactcgggaggctaaagcaggaggatcgtttgagcctgggaggtcaaggctgcagtgggccaagatcatgctgctgcactctagcctgcacgacagaacaagaccttgactcaaaaataaacaaatagataaataaataacttaagtgatgaattaaggacttaagtaatattgtcagtacaagtttgacaaagcttttccacaatgcaaagggaagcgagaggaccgactgctataaaatacaccagtatgataagccttaccttttcatcttcaagatattcaatgtccgctgtgttatagccatctctgtggcggtggcttagcactcggaaccgactgatgccaatcgcgtctacaacagaacttccatcaggaaacgttctcacgtccttaatctccagcatgcatccatactctgaaagcctgaaaagacagttaggagaaatgactgtgatttttaaaatgcagggggccttctttttccctggatgagagtttacttttaaaaggaatacaaagccacacaaaacagtgtctccacatcagaccagcaaggttattgtcgctaagagacacgtgcacatggtcgcttctgttagatgttaaatatagtggtgatggtggctgcaggggaagggctccaggtgagacaggacttgtgccttagcggttccaacgggctagtgttttgggaaggacccgagagatgggaagagatgaaatctcaaatgtggctcctcagccaccttggcggggcaccatcaggactgcccagctggtgccacgcacacactcggctttccaaagctctccccagctcttacccacactccgattgtaactatcacccttatcctagtgatattctcatgctaccacgtgccaagcaacacacggagcagtttataatacatatgaattcaagcccacacttaaaatttgattcatcaaaagtcaacaaagtgaaaaaacaagctatgagttccatgtgcactgagaatatagaacactaaaaagaatgtgaaaaacgacaaggaaaaccagataaaccacaaaacatatgtctcttgaacccaccagagggtggagattgctcagggtaaccaaacaaagatcccacagggagagagtaggcagaacccaggaagagacacaaaagtgtgtaggaagcattcagctattttttttttaaacaaattgccaatgaccttgtgtgggctggcaccagagtgcaggtctggagagctgcactcacaaagggagtttgcatcacacacaggatcctgtccacagataagagcctccttgatgagtcatgccctgcagtgaggcaggcttggaggagctgacgtttatctggaggcctctgctggtgctggttgctggggcagcaagtcctccaccttcaaaggcactccgctcctcctccctcctgccttcgcccacaaggtcttcacctcattccaattctgccagctctgccctccccaaccaaagtgccgtggaaagcagtccccggccactgccttcatctccttgcctccccctcactcctccatatcctaccgttccattaaaatgactccaaaagaagtcagagatgccctctgaattgctcaaatcacttgacaggctcctgtctgacctccctaaggcacggccctgcagactgttgctgagctaatgcttctgctctcctgaaccctctctaaccagcccggcccttcacagcccctacctctgcatgtccctcctgctccatgctgcccagggtggtattctaggctatgtctattctcattccaaagctctccccagctcttacccacactctgactgtaactatcacccgtaacctagtgatgttctcacgctaccacgtgccaagcaccacacacagcagtttataatatatacgaattcaagcccacaaaacacggaggctcagaggaattaacttctctaaggccacagggagatttagagccaaaatgagaactcatggcagtgtgattctaaagttctcatggtgagcagctttactacacgtcccccaaactaaagagcagcgatgattcaaactgccacctggatgcctctacttatatacttaataaaactctctcttcctggtatctaacaggatgatctcattcatagcatggtgaaactggaggcgccctgaagattcctcttcaagggaggactgaatgccccagcaaccagcagaggcctccagacaaatgtcagctcctccaagcctgccttgctgcagggcatgactcatcaaggagcctcttatctgtggacaggagcctgtgtgtgatgcaaactcccttcgtgagtgcagctctccagacctgcactctgatgccagcccacacaaggtcattagcaatttgtttaaaaaaagaaaaatagctgaattcttcctacacacttttatgtctcttcctgggctctgcctactctctccctgtgggatcttgtttggttaccctgagcaaccttcactctctgatggcttcaagaaatacatgttctgtggtttatctgttttttcttgtttttcttgttgtttggatgggaataacattcttttcagtgttctatattctcagtgcacgtggaactcttatagcttattttttctctttgctgactttaatcaaattttcatatattctaatttactaatctctccctctgttatgtattctcagcaccttgtataaaaaatctttccccactcctaattataaaggcagtccccaatatttcctcttaaatgtttttatattttgtttttcacatttcacattaggaatgcaaatgtgttatttttttatttatggcataaggtaaagctttttccccccctctcatttggaccacccactaattttctgggcaccctttactgagtagtttgtcttttctcatacaattgtctataaatttggcgtccacatatgagtggacctgtttcggatctctacattattgtgtcactggtctacttactaaggcttgtaaacttgatattacaggaatgttctcctgtttgttcagccagatctgggcttagtcttttgcttttctacacggattctaaaatcagcttgagcaagtccatgaagaagcttcctggagatgctgacaggaattactctggatttgtggaactggatagagatggcatctctacagcattgagtctgtgcaccaacggacatggcatttctctcctttgattcagaacttcttatctttcaataaaatttcagaattttctccataaaggtcctacacatattttaaaaagatctgtccctagatatttatggtggaaaattctgagtggccctaaaaatgcagtctcctcttcttcctgggcacgtaggtggactatatttgccaggctcctttgcagcaggtgtgaacaggaggcagccccctttctccagagtcctttaagagcatgtgcacctcctccatagctagcacttgaatgcagtgacctcatcatgactatgtagggctgacaaggccctaagggatgggagggtcctgagtccccaaatcagtccacagaggggaatgacctgctggcttgcaacaccctctctggacaaagacgtgaaacgaggggaggtgaaaaccaagcttagtgtgtttttgtaagactgaaaatgatttggctgtagagacagagaaaaagctttgcgcaggatatagacatttttctttttaaaatgtttttgtagagatggggtctccctatgctgcctaggttggtctccaactcctgggctcaagcgattctcccacctaagccttccaaagtgctgggattacaagcgtgagccaccaagcccagccgcaattttcctagacctcagaagttggactagatttgtttgtatataaatggggataaagaaaattgcaggcagagggaagcacagaggtgtggaagcatgagctgtcacaagagaagggcaagtagcatggcaatggactagtgggtgtgatacttgaaaggaagaggtgggcagtgaggctagaaagaagggatgggactgcattgtgggcagccttgaacttggactttgttacgtaacgggagccactggaggttttcaagcatcagcctaaatcattctgcaagaaaaatgacaaacgatgcccttcattaggaccctttgaaccaaatgctaacagttcttaccccgcgtgctcagcagataaacacatgccaaaccgcttggtgccagtttccatgcatcttcttatcataagccgatagcggggctcaaaaacgtggagtggacatgggaccgtggggaaggccatggcacacacaaagatggggacgtctctggtcagactgcagagcaaggggacatgttatctcagatgtatgagctgttagatcagagggtggtactggccaccaaaacagcaaaagccagccaacctcagttctcccctctacaaaacaaaaccctcaggctaagagggacaagaaagccaaggaccatagcatgtgaaaattctctgctcacccaggtttcctgacaaatctgtcttatttaacttgaggaaagagaacatgctgaattatattactttgcttggaaaagttataccttttaagcactctaaaaaaattctgataaaagcaaaaactacatagtagtcaaaggcaatgagttttagaagagtggaagagtgataagatcgctactaaaatacaaaacttttaccattttaaaagatgaaaactgtcaagcctgctgtgattcgcaatcctgggtattagttctcattctctctactttttaaaactgtgcttcactttactccactttgcagacattacattaaaaattttttgaggtaaaatatacgtatacaatttgctattcttaagtgtacagttcatcagtaacaaatacatttatattatttgccttttatttatttttaatatataaattatttttaattatttataataattttttaatatagaggtggggtcttgctatgttggccaggttggttttgaactcctaagctcaggcaatcctcctgcactggcctcccaaaatgctaggattacaggcatgagccactgtgcctagccttctttgctttttaaatcctgaaaaattcagtatcacttatttacatacaaaaagcaactatacaattttgttaaaacactttaaaaatatcttataaaaaaagaaaacaaattcttataactgcttgcaattatgtttccaaaaatattttgcaattaacatccttttccatttacagaccaagagagttctctgccatgaaaagaaaatctgaggtgaagctgaagttgacaaagttcaatctgaacttaagaccaaggacacacaacatgagcacttactttgacagttctgacatttcttcatcataaattctcttcctatcagacaattcatccggcaaatatcgaaatattaattcttcggccagaacagttatgttaaagtttctgcttgccaataactgtaacaaaaaaaagtcaaatgatactgtatggtaattgattctaaaggacgaagcttccgagtggaaaggtgaacaaggaggtggtgggtgggatctctgagcaggtaagaaggaaaagggatggagagagaggcgggccagcctgtaacaagagcaggggcagcccctccactgtgagaaaaggccaggaggaggcgttcacctggatgaaggatgaggcaactcaatcttgacagcatctacattttcaaccaagtgccatgatgttggtgagaggggaggaagtgaagtagggcatgttgggagaggagagacttttgcaatgatcagcttggaaagtgaagaactggaactactagagaaagaatgtaagaatgattacttatgttttgagtctaagacttaaaatttttcatttaaactgacaccaatcttcccaacattatgtttttttctagctttgttgtattacttaggatgcatgcaaaaggcaaaggttgactttttttggattgagaaagagagagagggaccatggattaaagcgggatgtgaagggaaggtaggagactgaacaagaaagtgctgggatcggtgggtggaagggccacaatgtggctgaactactactctgcgtgtgtgtgtgtgcgcgtgtgtatgtgtgcacacagattagtagtttggtaggttgcactgttttattgcaggcatgtatactagcatatagtagctcttttcactgacattctgatgcacatcagggaccactgcaggtgctttattagtcctgaaaacagtataatactatagttgttctctccactgcgctcataaagctgtgattcagaaagggtaaggggtcagtgctgagccaccatggcatagcgaggaccccaggcctggcgggcttcagggctctgctctttccttggtggcctgctgcatttctgggcttgggatggctccacgtatttccaacacaccatggctgggtgagtccttcgcatactgccaggtttccttgtggttggtgtgaaacaaactaaatgtattgctgtgattgactgagaaccaggagttcaaactttggaaacgcctatgtttgagaaccaccatcacagggtaactggtagagaaacaggctatcatctcactcacaaaactgcttcataattgtcattattaatgacataggtatttaataaatggtttatgatgtccttttattgaagagtaatacaataaaacatgctctacttggcatgatgctagccaagggttctggagattcatatataattgatgattcaggtccctggtagtgcatgcaaagtcatttatgtgcatgatgtgactcccgcattgaagaaagacaaaactataattttggattttatttcactttatagcattctaatttctggaacattaggaacccatgtatagtttgcatgtaatcattcattcattcattcaacaaagacttctagagtctctggtgcatgtgctagtccctggaaatacagggaaaacaggtcataggaagtctcagtacttaagcagcttctattcttttttttttttctttttgagacagagtctcgctctgtcgcccgggctggagtgcagtggcgcaatcttggctcactgcaagctccgcctcccgggttcacgccattctcctgtctcagcctcccgagcagctgggactacaggtgcccgccaccatacctggctaattttgtttttgtattttttttttagtagagacggggtttcaccgtgttagccgggatggtctctatctcccgcccttgtgacccacccgcctcagcctcccaaagtgctgggattacaggcgtgagccactgcacccggccaagcagcttctattctagtgacgacctccagctatcacttcttcactcagccccctacaaggcagcatcgaaacagaagtgagtaaggtctgtgttgtaaacagggctcacacatacatgcattttattcttgtaagaacagatgagcctgttctggcccaggcaggcaccaaaacaagaggcagtgggtccgatgcatctactagcaagaagagacagcaaatgcccagaggaaaactgcacaggggccaccaaggaaacagctctgcagactcagagcacagtcaccactgtgacacacagcgcacagcacaataattgatgttcacgagaactctgaagaatttaaaaagattcagtatgcatgcaatttaataaagcaagtatgtgcatacaatgttttagaaaatgttttcaattgtaactagttattttaatgttttggcagtaaattttaaaggttataattatttaaaacttcacttaagtataatatctcatcttatcacatcagatttaaaaaataaattttactgtacgtttgtaaaaagaaaaaaaaactttatcctacttaaaatgcattcaataagtttaatctctggaaagtaattaaggcaaatattatcagtctcatttaatgaatgcaaaacaaaggaagatactccccacccccttaagatgttatatgacttgctccatagaaagttcatggcactaataggaccacagcccaatacagctgatatggattcactatttcaggaattgatcagaaggtcttcagcttttaaatactcttcattgtatttaccatacctaacgtaaatggatttaatagtttatattggggctaaatatcattaaatagcttccccatggaacctggatttaatagtttatattggggctaaatatcattaaatagcttccccatgggacctgaattttactggttttgatttcagaccaaagacaataataactgacaactgtaaaagccctaaagggactcacctgtggtcagaaatgatcaagtcttcaatcctacgaaaaactctcaagatgaaaaagagaattcctggagcacattaagtgcaccatgacaacgtctcaaccatttacaatgaacgtaatgtagggttcataatgttagctattttcaatctatctcaactaaaatttctacctaaaaatgtccttaacatttagcaatttctgtatgtcaaccttccttgtgtatttcttgattcatcaaagagatgagaaaagacctatctttgattggagaaatctcagtttctttaacaactgggtgggggaagcaacacgagacagggagtaagcgtccaccaagggatgagaggaggagctgtcccgtcatttcctaaagtgtacttacttccgaaagtttgtctttgcacaaaggacagtgtggggcgtggtcaaggcagcgctcaaggcattttaggcaaaatgtgtgtccacagggcgtagtgacaggttcaaagagcaatctggaagaaaatatctgttttcagccagaaatgtccaggacagactttcaaatcatggactggtttttgaaggattccttatgcaatcccctttctgttctagaaatcacttgcatgcactttcattttatatcttattaaatctttagaaaataaatcaattattactgagctctccctagtttccgtgataataaaaagcccattacactttggtatacatttcagaaaggctgcagttttaaaagagttgcacggattctgtaccatcctacctcatgcagagggcacactcaaagtcagttacatcaagcgagagcccctgactttcttctgtctcagagtttgggctcctttgaagtgagagatctgaatgcgaaaaaatttaaaacgctgtaattaacacctaagcacctgaacaacagcatgcaagaaatgtattttctctggaccaaacgtgttgtatcaatgtaacaaatcacactgggcagaaatagttcctgcccagttaacagcatacagcaataatttatctggatggtaagcatgaataaaattttaaattatagctaaattttctctgctatttttgactatgaagtctttgcagtataaaacatctaaaatgctctataatcttagagctgatataatcatttcattactaatattaaatgttgtaaaaatttaaaaaatatattgaatactagttaacattctatcactttggagtcacagaactgcctgatgaaaacagttcactgacctttcttgggaatttttccaggggcgttcaggtcaggtgcatcctccacgtcatccggaaactgtctctttaagccagcgctgggtgctgttggaaggatgctttctaacgcctttttatcctcttcaaagtgtagacccagtataaaatacaaaactgaagaattggtatttccaagcatatcagatttctcagatgaattctggttaagtgggaaaaaaaggaatcctgagtattaaagaaatcatagcataagagaaaaagaatgcagaagcctgtactagaaatctttggaaaaaaaaaggggggggcatacactcttcttcataattggtttcatctgttaatttctaagatgagctttattcttttcacagtaaaatacaggataatttcttcctgagccagggcaagtgaaaagttatcttcatatgcaatctgtctgtctgtctatctatctacacacacacacacatacacatacacacgtacacacataaaatcatatatcatattcaaatcatccctttgctttatttttttttaaattacactttaagttctagggtacatgtgtacaacgtgcaggtttgttacatatgtatacatgtgccatgttggtgtgctgccccctttaacttgtccctttgctttattttctccaagccaaaataacttcaagtctcctgccgtttggggtgatttggtggtgttctaaagcttctttcaatctttaatcattttcattacttccatagacttcatgtaaaagttccaactcccaggttgaggagctacaactggtcttgagaaatatgtctaactaacataatgccataatgtgtgaataatctgtaaactgtttaaaatgaagccattatgtaaagcttaatcaagagaatcctgacaaatgcatgcacgtcatacctccgagctccctgcatcaccttcttccagcagagcctgggcattcatgtggctgtgaccctgagcctttaatctgctttggatggaagatgttaaattttcatgcacatttgctgtagctgaaaacagcacttcacacattacctataaaattgccaagaaaagaaaaaatatatattttaaaacacttttgtaaaaatatagtatgtcttatagattcagaggaaactaagaggccaaataagcctaaaatgttgaaaagaataattttaactgccaaccttttaaaatccaaacatttttgaaaccagagtcaatattttaagttattttagcttccaatccctttccatcttacacttcccaatgacaaaatgatagcaataccacttccttctacctggtccttacacactatataaaatctcccctaaaagccacacagataaaagagaaagggagtgtaaaggttgctgggggccttgaattaaatctaagctgtgatcacccacagggctgaggtcactatacagaactgctttatttatgagaaccagaagacccacctcgtaaagaactttaaaggaagagagagggaaaggccctaattgtggttcaagaaccagggaatggcattggtgggggcaggggaagggtggtcagcaatggccagttaggcattctagctgacacccaatgctagcagacactcaaatggtcctgtcaaacctcatggcttcagctgcatccaaggcttgaggaaagcagaaaggagtgactgaaacctaaacaaagactcctcccactctccactgttcctcatggttcaaggtgagtgcgctagaatccatggccttgcagcaatgcgcaccaccaccctcagcagggacatcaatgtcctcagccccagctctgagcagcctcaacagagctgctggagatggagccacattccatgtgaacaggctaacattgtttttggtaccgtctgtgatacaagatatctatcagccatagaatgtccaggggaaaacaccatgtctgaaaacgctccaggtagacaacaacccagaagacctaaaccctggtccaggaaccttggtgaatgtgcttcatctctttgaccttggactgactttctcagaaaagtgttatgagaatcagttgagatatgttttaagattcttaggaagtttccgtataggacaaagcaggcagggatagctgaatagcaggctgaagatgcaatattattttgacaagttgaaatgatggccaaaaaccaatgagtgatactggtcaattgaacaactgtcaggacaactgaatgggactaacgccaatcaattgcacaagagaagataaaaaacaacattgctctgaagttcttacttttaaaaaagaggaacgaggtatttaaaaataaacatgcccctaatgtgaacacaagtgaaggtaaaatttcaccaactgtggctgtcaaatgtagatgctaaaacacagggtacattagaacacatccagaagaggaaatcttagaaacgccactctgtgagaaaagaatgtttggcccacagggtgacattaaggcaaagataatagctgttcccaaacatctaacgtggtttgaattgtacaaggaagaactgattcattttctgttgctccagaaaatagaactacacaggtaagtaaaaattacagggtaaatacgtggtagaagttgacaataaacagtgttaaaacagggaagcgcaaacataaaaacataaaaacgctggtcattggaaatgctaagtaaataccaggtaactattgtataagctttttaacaggacagatttccacattcagtgtgactggatgatgggtaaaagagcaggtatttctgcactatgctggtgaacctttgctgaaaattacaggtcaccctatagagccgaattgatacattttacatatatcataatgtcttttatgaagcttctacacaaactataataaccttgcctaacatgtgtctttatgtcaacagaatcgaggcatgtttacactgtctcatgaaacactctgctttacccagggacaaaatataatgtttacctagaagttatccaatgtatgaaccttacaattattgccatgcgttttttattgcattatcacgaacattcagaattatatttcttgtttatttcacatgcaagggttactcagcatggacatgaaggctataaataagacctgatagagaaagtcctttaacagaactcataccttctgtgcttctttcttcacagagttacattcaggattcagagcaaggcagtagagaaattcctttaacacttccttacttcttcccaatccagaaagagcctgagcttttacttgatgtccctagattcaccgaagacaaagtgtacatttttaaaacccagcatgattatatacttgaatacaaacttccctgaacaaatttattagaacaatttgttttaatttcacattacatagaataaacaaagcccatcaaaggatgactctatcgctactttctctaccctggaaacttagcaaacttcaatagctcataaatacaatctacagtcagaacacaggagctaccgtacctgaaatgttctgctcaaaggagttctaagggacgtgctaagagaaaactggctatccactttaaattcattcagcagttacaggtcattaccatcttcctggcttccaggagtttacagtctcatgagctaagacagacacgactaaaaacaattacaatacaaatcataatatactaagtgccacaataaaagtaaacaaaatacaatatggatcagtaatttcccatggcattttcttttcatcttatgaatgcagtattttctcaaatctataaaaacactatttttgtttctttttttactggtttacatatagttgaaagactttctcttagcacttgaaatatgttgttccaatgtcaaccagcttccacagtttcagatgagatgacaaccataaatattatttccctgtatgtcatttttctcattctcattccatgtcatttttctttactgctttcaagactttccttttatctttggtttacagcctagccatttgattatgacttgagtttatcattgcttataagttgagttaaccttcttggatctgaaattaatgtttcccactaaatttggaaactttttacccattatttcttctttttttttcttgccaaacattttctgtcttcttctgagattccaattgcacatacgttgtaccacttcatattgtcccacaagtttccaagattctttttgtttttctttaatcttttttctttctgttttttgcattgaataatttctcttcctatagatctatcttcaatttcactgattattttgccatgtataatgtgttattaaccctacctagaaattttaaatttcagcattgataatttttatctctagaatttcctttttttttcttttttagagacagggtctcaccctgttgcccaggctagaacgcaatggcatgatcacatctcactgtgacccttaactcctgggttcaaacaatctgcctcagcctccagagtagctcagactacaggcacatgccaccctgcctggctaatttttttgtagacttggggtctcgtgatgtttcccaggctggtcttgaactcctggcctcaagtgatcctcctgcctcagcctcccaaagcattgggcatacatgcatgaaccatgaacccagccagaatttccattttttatagtttccatctccctgttgagattgctcttaagtcaaaggtaccatattgtccttcaattctttgcatgcaatttaactctttgaacttatgcataataacttcttcaaagtctctttgtggaaaatataatatctgggcccactcagagacaattttagttgactgttttttttttttttttgagacagagtcttgctcgctcgtccaggctggcgtgcagtggtacaatcatggctcattggaacccctgcctcccaggttcaagtgattctcctgcctcagcctcctgagtagctgggactacaggcgcctgccaccatgcctggctaattttttttttttttttttttttagttgagatggggtttcaccatattggccaggctagtctcaaactcctgaccttgtgatccacctgccttggcctcaccaagtgctgggattataggcgtgagccactgcacccagcctccatggctcctttttaagccttgtggttctccctgatgcctatgaaatttggaaataagccaggatttggccagagctgggaatcatccactccgggatttctctgcttttagggattcccctaatttccagctcttctgttagaactcggaactctgaactcctggtactttcacgtagtgatcctgagtgtttgtcccagtactgtttttgtgcagctgcagctgtggagatagacagaactcagggaccaaaaagacaaaacaaaaaacaaacaaacaaaaaacccacacacaattcttttccttttcatgtgcaggtttttttagaaactctcctccagcttctgtttttggatgttttatagtgtctttattttttttaatacagttcttataactgttttcccctctggattcacatgacgacttcactccttcactattaccagaagtaaaccactacccctgttaatgtcattttaattatttctgtataaaaattctccagaacattggcagccactgatgggtaaatgtgaaggtctattttcaggtcctgtcttactgcacttctctctccattgtttgaaataccatgactgtgctgatggtgcccaggttccatctccagcaccaacatctctcctcatgcttgctaactgtctattcacacattgcttaccttgcagccctctggaagagcagccatttcaaaagacatgatgagtactttagacaacaaatcatcagtttcatccctgagctccctgaagtctcaaatacacttcagacaatcagtgattcatctatgggactttacattgataataaatgtgaagttttactaattttcttattctcctttcacaaaagcagaatcacaaaagattcagcttttgtggagcctgaatcttacataatttggaaagtctgtttaaggaaaagtacaaaattgttattattattattttttgagatggagtctcgctctgtcgcccaggctggagtgaagtggtgccatctcggctcactgcaacctccacctcccaggttcaagtgattctcctgcctcagcctccggagtagctgggattatagctgtgcaccaccacacctggctaattttttcttggctattttttgtgtgtgtgtgtatttttagtagaggcggggtttcaccatgttggccaggctggtcttgaactcctgacctcaagtgatccttctgcctcagcctcccaaagtgctgggattacaggtgtgagccaccacacctggtcaggaaaagtacaaaattaagaatacaaagttgctagggcccctttcaggccttataaaagtccccaactttcatgtttcagtagtgtctaaatttgcttcgattatcaaaagttctgagaaaataatactgtcttatacgcacaaagaacttcacgtaaagtttcaagtttttcatacatgtgcacagaatctcaattgagatttgcattttttataccacagtgtatcagtaaatatttattaactgaattaactggcttttaagtaattttaagtcttataagttcgctgtttgggtaagatcaaactaatcatgtgcctatatctatttctgcaaatgggcaaatattttgctggcaatggattatctccagttgctccaaaagctttgaatcattagccatgatgaatattagccatgcctggatgcttgaaagggcagttttgcttgagtgagacacactgctgtaacccacctccccccagaatctagaagtgcttctcaaagtgcttggttctaaaacagcttccatctcagcttgatcacactcagccaccttagtcttcccctcagtgaacttacttcccatccccttaccttaccttccaatggcacttcttccccaatccttagttataataacaaacttagaatatatcttttactatcttaaacttacttttttttttttttgaggtggagtctcgctctttttttttttttgaggtggagtctcgctctgttgcccaggctggagtgcagtggtgctatctcggctcactgcaacctccgcctcccgggttgacgccattctcctgcctccgcctcccgagtagctgggactacaggcgcccgccaccatgcccagctaattttttgtatttttagtagacacggggtgtcaccgtgttagcctggatggtctcgatctcctgacctcgtgatccgcccgtctcggcctccgaaagtgctgggattacaggcgtgagccaccgcgcccggcctaaacttacttattaaactacgttttggctgaagctgctcttcactgggcatctgtcaagaattgaggtccacagatttgcagtaaaccctgcagatatgaccaccgtctcataccatctcaaacactaaatattcatttgctgcctcccttgacaagttataattagccacgtacctctgtagaaattaagtctatcttttgtgagagtcacactgtcaagtttttagctcaaagaatactacggagaggaatctagcttcagagggcaatgcagagctgctgtcagtcagaaataatagttataattcataataactaaggcttgatcattactgatagaaattagctcagaagaagagtggcaggggagaggaattggggcgacgtcagccaaaagatacagaatttcagctgaacaggagaaataagttcaagagatctattatgataccatatgttgactacagttaataacaatgtactgtattcttgaaaactgctaggagaatagattttaagtgttcttaccacaaaaatggtatgtgaggtaatgcatatgttaattaacttgattttgccatttctcattgtatacatgtttcaaatctacatattgcacctgataaattatataaatttttgcttgtcaattaaaaacataattttaaagaagaatggatgaaggcataggagaaagggcatttgaaattggagtctaaactttttttttagggaagcaaacaagcaacaaaatagatttctgagcttagtccaacaaacatctgcttccatccttgggcttatccctaagttgaacttgacactcaggctaacctcaaagcatttgttttaaaagatgggagggaggccgggcgtggtggctcacgcctgtaatcccagcactttgggaggctgaggcaggcagatcatgaggtcaggagatcgagaccatcctggctaacacagtgaaaccctgtctctactaaaaaatacaaaaaattagctgggtgtggtagcacgcacctgtagtcccagctatgcgggaggctgaggcaggagaattgcctagcctaggggacagagagacactccgtctcaaaaaataaaataaaaaaataaaagatgggagggaaaaagggcaggcttcccagtgcttgtctactaacctggcttaatgtctctttaatgtttataaaacaaagttgatataaagtaatatagcaaatatttttaattattaactgactaaaagagcatgctatagctgttaatttcaagttctttaaaactttaaaattcaaagattcatgaaaaggcttttattctttggcttcttaaacttctttaagtacaacttaagttatcattattagatccgcaaagttcgttttttgtcatgagagaaatagtaaacctttccaaacaaaacacagagactaaaattagtgtaaaatgtacacaaaatgttaactctttcaccaatagcattgatttgttcatatgcatattaggacccaacagctaatcatgatcattatgtgatcttcctatttacattataattttaaatattttttcttcacttacaactttataaaatttgatgattttatttatatattttttcaatgtagagagcatattattcagctaaatatctattaagtgtaatagaaattagtgtttctcagctaaatcagttggagatttagtcttttaaattaggttgctttagtgtgaggtggattgctaaacgtaggctacagtaatgtgagggaaacatactttgtctataggtacctgatcacaataatcttacttttgtttttaagaaaatcatataaacttcacattgattatctccaaagctaacaaatacaaataccttaatcaagagaggttcattctgacaagctgcactggcatcttggagagcttgctcatagttcttcatggtcaaatataactccgcccgcagcagcaataatgaattatcatcaggagctgaaagacaggaggaatacaaatcaataaaaatgactgcatttaaaaacaagtaatcttaatgtcattacatatattaaagtgtatatatacatatgtataaagtataaatacaatacaatacaaaataagtataaaaacaaaataagaaagaattcctccctccaatcatatttagagtttagttatttgataagtatattttagacagctcctctcaggaaaacaggaagaagattaacaagacttgaaaaagcaccaagaaaaacagactgccactgagtattcctacacacacacgagctacatcatctccaataataaattcagcaactgctgaatcctctcactgctataactaggtatttttagaagagatttaaaataatttttatgaaagtatgcaaggaaattcatgtttaagaaacagaaaagtaaaacataattttttttctttttttttcagacatcgagtctcgctctgtcacccaggctgaagtgcaatggcatgatcttggctcactgcaacctctgcctcctgggttcaagcaattctcctgcctcagcctccccagtagctgggattacaggtatgtgccaccacgcccggctaatttttgtatctttagtagagatggggtttcaccatgttggccaggctggtgtcaaactcccgacctcaggtgatccacccacctcggcctcccaaagtgctgggattacaggtgtgagccaccatgcctggcccataatttgtttttctacacaacttggtagatgttgatttgtccccataattgtacctacagtatattctcttaaggagggaaaggaaaaaaaaactcctttctctgcattcctcaacagcagaggtcctgataacaactcacatgctgccacagacttaagtccagctacacagaagccaagactggcctctctttgaactgacttgcagtctacgaagtattgacttggcagggtcccatggaaaaggctggaagccagacctcagaaaggcagaaccatcacagccattttccatactgtggggcctggctcactctacctttgcccacctacgatccttgtaggagggctacagctatgcattttagttcaaccacaaattttctgagctcctaagatgtgttctcatccctctacctaatgtacgttttcagtttcctccaaaaccttgaccttgattcttttcaaactacccacttggtgctttccaaatgccactagcctccttttagtttatgtaggtaactgagcaagcatacaccgaagaacttacacacaaagatattacatcaagacatggtgaaaagtaactacttataaatgtgtcatcaccacatatgtgtaatatagagaaagtataacaagaaaaaagtagaaggggaaagaaacagcaagagttaaacaatacaattttaattattaagagagacattgctgggtatggataactggctagagcaggtggcagaaactttttttctgtaacaggccagatagtaactattttaggctttgcaggcaaagaggcaaactgaaggatatcatatagatacttgcttaacaagaaggaaaacaaattttgacagatttcttattgacgcaatttaaaatatggtaacaataatttaagtacttttttgtaatacagataaactaatgagaagaatggaattcttgtttggggaataacatttttcttaagtttccaagttagtgtttcctatcatcaaaacaactgaaaatattcatctgttaattatgatctaacatgagattttatgtatttcatctttgaaaatgcacatagtaactgtgaaagtgctggcatcaattcatatgattttaaattgagcattttaattgctgggaagacattatagaattctattagattctcctcacggtatctgcctttttagcatgttattagattatttccaactaaaagattggtgaaaatgcctcaatcacacagttaaatgcattttgaaatatacaattctcctttggagatttccaaaaatccaaaggagatttggggaaaaaaatgtaatacttactataatgctgatttttttccacatcttccaaaggagatttggaaaaaaaaattttggaaaaaaaaaatgtgctcctggaagtatagttttttaggcttgggttatgcctgctgcaaacctgtgtgagaatggagatctcatatcctgtttccacttggctacagtttcttattagtccaatctgccaatggattctcttgaatattttaaacaagaatgtcatgtgcaattcactccttttcattctagtatttatactcctatttcctcatgctctcatattgcaataatagtgacagcattttctcttattcttgaatttaaaaagcatgtgtctaatgttttaacataaaatatgtttgttgtaagtttctgagagaaaatatttatcaagttaggtgatttctctcccattcctagttttctgtaaggactttataacaagtaggtgttgaattttatagactgctttcagcatctgagagattacatatagttatctccttcaacctgatatggtgaattactctgaaagatttgtctagtaccgaattatccttatggtcctagtataagctcttcttggtcttaactcctattacactgctggactcaaaatactaagaaatttaattaggattttgacatctatatacatatgtaagactagcctacacatttttttttcttgtgcaagctttacctgattgtggtgtcaagattatactaaccttattaaatgagatgaaaatcttcccacatttttctatgatctgaaataagatggaaattagtcactgaaagctgtaaggactttcttgaccttagcgccttttcagcagaagagaatccctgaggagcatctcaatttttttgaaggcttttacttcttcatggataaatattgataatttgtattttccttaaaattgtcctttttatataagttttaaaatcttttataaatatccttttatatccgcaatgatgcttctttattccttatggtatttatgccttgctttttcttgaacacatttatcaaatatttgtcccttaatggccttggcaatgaatcagtttctcacctgttaactaactcaatttttttctgttttactaatatcttgttcattattcctttgcttatactatctttgtgttagcttaattaatcctgataaagtttctagtgttaaaaatacatttcatttacatttatttttaatcattcttttctaatgaatacatttaagtctctactcctcacattctaaagggtgctttaactgaactccaaatttcataaaattcacttcccatctacacttgatcttagccaaaaggccaagaaacaatcacttctcatctcgacactgaatgaatcactgttttctttgttgacgtccaccatttggtgatacatttgtgaggacagcacttcacaatttagtcttttaaaacacataaaataaatgcttacacattttctaaggattaaaccttaggctcaacaaaactaaaggagttctccaaggatccctcaaaactaagtggaagaggaagtgcaaattattaaaagtctttgtgtagagaaaacatatggaagaaaaatgtacatatgtactttccaaagaattgatgcaacatttcagtaggttcaccaattaacccctctatggggaaaagtcataagagggcagcctaagacccaggctttgagaggaaaagaagagatgtctaccacaactgtgtttagggtcgaccaaaggctgttttccaacagcaacccagagccactgttgtactaggagctagggttactgctataaaatctatcaaatgtgtgcagtggtgagaaatggaggattacatgttattttacacaagttaaatgagccaggcgtggtggctcacgcctgtaatcccaacactttgggaggccgaggtgggcggatcacttgaggtcagaagtttgagaccagcctggccaatatggcgagaccccatctctactaaaagtaaaaaaattagtcaggtgtggtggaacatgcctgtaattccagctacttgggaggctgaggcatgagaattgcttgaacctgggaggtggaggttgcagtgagccaagactgtcccactgcactctagtctgggtgacagagtgagacccagtttcaaataaataaataaacaaacaaatggacacataaagcaataaaaactgggtagtgttctctatgaaaagaaagaataagtggcaatactcctcaaagcctatttattcaaattgatggaagactgtaattacagagtcaagtccacaaatcttaggtgtatatctcaacctttgcatgtgtacccgtgccatcatcatgtagttcattcccagggcctaagaaggttcccttgtgcactatcccactcagtgtgcccctcctaaaggtaaccaccattctcacctctgtcactttggattactttatcctgttttctaacttctataaatggatatttataaatggaatgtacttttttgtatctgacttctcactaaattatcattctgtgagattcattcttattgttatatgtctcagtaatatttttaaattaatattttaaaaaatttaaaaattgctgtgtaatattacactgtatgacttgatttatttactcattctactagtgatgaacaattgaactgttccccaaatgtttctggcatatataaataaagctgcaatgaacattcctgtacacatattttgatggacataagcattcatttttatctagtatatactcaaaagtagaaatgccacatcagaggttgtacgagtttagctctagcaggtgctaacaaacacatttcttaagttgttgtacaaacttatgcttccatcagtaatttaagagttccaattgctgcaaataaaaactaagtattgccagttcttttcatttcagctactctggtggggatgtactaacttactttcattttaatttgcatttgagcactaattatgttgtgcagtcttttagatgttaattgctcactttgagatctagtttttaactctttgcctattacgtagtttcagctaaagttgtttctatcaatggtgttaagtgagtacttactgtgtttagacagattggctttttctttttgaatcataggcattatttattctgcattagaggtctcagtaagatatttgtatactcatccccttctcacttttttgggggcctctgaggaacagaagttttattgttatgctttttgtgtcttatttaagaaacaactgcctaccccaagtccttgaaaacagtctcctatgactcctagatacttaattgtaattttgttatatgatgtgagataggtattcaggtttatttttttccatataaaaaagcaactgactcttttttccccattgaatttttccccattgaattccattagcatctttcagaaaatcaagagactgtatatgtgagagtcagtttcaatgtgtctatttttaagccaatacaatgctgtcctaattactgcagcattatagtaagtattggaatctgccagtgtaaatcctccagctttgttgtttttcttcactgttgccttggccattcatcaatttccaccaaaaacactggctaggattttctctgagattgcactgaatttaccattcaatcagcagagaactgacgtcttgccaatactgagttttgcaatccatgaaaaaaaatgatatatccatccatttaagtctgctttaatttctctcagaaatgtttcatgttttcagtgtattgaaatgaaattttcagtgtagaggtattaaacatctttcagctatttcaggatttattccaaggaatttgtttacataaattgtttaaagtttttttcctatttgttttttctaagtatatagttatgtttgataacctctatattgaccttgtagtcagcaatctggataaatcatttataatttctaatagttcctacattcttctggagtttctatgtatgccaggtcatctacaaataatgacagttttttgttttatcttttatttttccaatcttaatacatagctatctagaatctccagtgaaatgctgagtggcagtgagaataaaacagtgttaccttctcattcaatgggaaaacattatttcatcattaattatgatagctgctatctcatttttgtagacttttaaaaaattaagaaagttcctttttattcgtagtttcctgagagatgcatcatatcatttttcttttttctgtaaagatggtgaattacattgcttgattttccaggattaaacaaaacttaacctgcttgctactgatgtgatattctttaagggtatcaatggattcagtttgctaatattttatttaggatttttgcaactatattcgtaagaaacattgggctgtatttttcctgtcttgttactgattttggctcctttatttccttctttgtactctctttggattctatttgcttttcttttcctagcatcttgaaatggaagcctaaagatcactgactatcagctgttctttggtagtatgggcatttaaaacagtaagtttccctctaagcactgttgcattgcatcccacagtgtttgatatctgtattttcattatcattcaggcaaaatagaaaattttctggccgggtgcggtggctcacacctgtaatcccagcactttgggaggcagaggcgggcagatcacgaggtcagagatcgagagcatcctggctaacacagtgaaaccctgtctctactaaaaatacaaaaaattagccaggcgttgtggcaggtgcctgtagtcccagctactggggaggctgaggcaggagaatgatgtgaacctgggaggcagagcttgcagcgtgctgagatcgtgccactgcactccagcctgggcaacagagcgagactccatctcaaaaaaaaaaaaaaaaaaaagaaagaaaattttctaataattattagaaattctaataattctaataattattagataattagaaaattttctactttatgttgtgattcattttacccatcattatataaaaatatattgcttaatttcaaaatatctgaagatattctatttatgtgctatttaattttagtttaagtccacagtgtttaaagaacatatacagtctggtttcaatcttttaatatttattacgacttctttcatggcctaatccaggagttggcaaacacaaccacaggccaactccaacgctctgcctatggtcatgggagcctaaatggctatgtttttgcagtagttgtatgtagtgacacatattaattaaatctaagtgctgaagtatgttgtatctatatccttacttattttgcaatccttactttatcagttactaaaagttttgttcaacatctccaattatttccccttttgcttttgtctccttttgttctctccatatgtgtgtgtgtacacttgttgttaggtgcataaaaatttaggcatattattacacattttttttctgttgaactggcccattcatcataaatgtctttatttcttctgatattccttgccttaaagaatactttatctgatagtcactttgccatatcaggcttttgtttgtcagtctttgttgccatcctactaattttaacctttttttgtgttcttacacctaaagtttacctcgtgtgtaaacagcatgtagctatacttcacttaatccaatctgccaacatttagtttttaaatgggaaatttaggtcttcacatttaatgtaaattaaatccccatttttctatttcttttctagttgtcccacttattctctccttctctattcttccctcccattttcttttggattaatccagtattactttactattccactatagcttttttttaattttaccttcctattggtggttacccaagacaacagaatatgcaaacctgatttagcagtctactttaaattggtactgttactacctccaaaacagtgtacaaaccatacaacaatttaactgtatttacccattctggctttgtcctgttgccatatctttcacttttatgtatgttacaaataccacaagacattattattgttatttgaaatagtcaatattgtctcatattgttacaccttctagcactctttactctgtgcattagtttcacgcttccatatggatacgtttcctttagcctgaagactttccctcagtatatcatgaaatgcaattctgatggtaataaaatcctttagcttgagttatttctttggtttaaagcaccttgattttgtgaaaaatattttcaggtaaagaattccagctaggttttttttttctttcagcactttaaagacattattccattagcttctagcttcaataattttgtctaaaagtcaactgtcagtcttctatgattccttcgaaggaaatatgtcctgtcttctctaaatgcatttaaattctctttatctttgattttcaggaacttgactataatgtacttggatgggttttgtgtgtatgtttgtgtgtgcacttgtgtccaccctgttgggcttagtgaactttttgattcagtgatttaaagtttctcatcagatttggaaaattctcaattacttttttctttaaatatttctcttgcccttcccctctctcttcttccaggattccaatttcatcgatgttggaacttttgtctgtgtctcacataactcccatgctctcttttagtcttcttctgtgattcagtttggatattttctgttaacttgcttctgagttttctcattcagatttctgatgtgtgccatctggtttgtaacaaatctaattctcaacttcagacattgtattttgaatttccaggatacccacttggttcttttttatggacaattgtcttctgaatgctttatattttcatacatttatttacctctttcaacatacgtactagttattttaaattccactcataacttatcggccaaaagtagtcacatggctccacctaatcacaagtggagcgggaagtgcaatcctaccttgcctggggaaggtatagagatagaccagcactaatgactaccacacttcgctaaggtcacataataaataagcatcagacatcaggtgtggtggctcatgtctataatcccagcactttgggaggctgaggcgggcagatcacttgactacaggagttggagatcagcccggacaacatagtgaaacacgtctctactaaacacacacacaaaaaaaatacgaggcatggtggtgcatgcctgtaatcccagttacctgagaggctgaggcacgagaatcacccttgaacccaggaggcagaggttgcagtgaccgatatcatgtcactgcagtccagcctgggtgacagagcgagaccttgtctcaaaaaaaaaaaaagaaaaggccaggcatggtggcttacacctgatatcccagcactttgggaggctgaggcgggcggatcacaaggtcaggagattgagaccatcctggccaacatggtgaaaccctgtctctactaaaaatacaaaaattagctgggcatggtagtgcgtgcctgtaatcccagctacttgggaggctgaggcaggagaattgcttgaaccagggagtcggaggttgtagagccacgccactacacttcagcctggtgacagagcaagactccgtcttaaaaaaaaaaaaaaaagtcagagcttggatctaaacacaggtatttctgattccaaacatctgtgaactttttttttaactatatcaaaacctctttaaaagggctaatttattttgaaattaaatgttttcataaaattttaagctaatctttgaatagaaaaatgaatacattctatataagttctcatatgaatttactgaaatagcctattttaaaaacgtttaaattaggtctaatatatatacagaaaagctaaaaatataagtatatagtgcaatgaactattgcaaagtgaacacacttgtgtatccatcccctaaatcatgaaacagaacatcaccactaccccacagatccctctcatacttcctcacaatcactattcccttttcatccccccaaggtaaccattgtccttacttctaacatcctacagtaattttgtctgtttgggcttacagataaataggatcatatagtaaaaatgcttgagtctggcttcttccacttaacattatgtttgtgagatttgtccacattgtagtttgtaactgtagttgatttattttctttctgtatagtatgctatgaaaacataatcatatattcaccccttctgctcttactggacatttgggttgtgtgcacttttggggtatctctaacaatgacatacactcttgtatctaattgcacattcttttgggggcacatatgcatatacctctttgaaactatttggccaaggacaggcttaacatctgtagatactaccaaatatttttcaggggcataatttgcagtcccattagcagcatataaatatcacagttttcatttttctacatcttctccaacatctaaatacagatgaagtatttctgatgaaaatttgatgttggaattgggtagtgcagtaaatgcaaaatatataacgaatttcaaaggcttagtttaaaaaagtaaaatctcaattattttttaaaattgaaggcatgttgaaataatattttggatgtatagggttaaaaattgctaaaataaatttcacctgcttttttcacccttttaatgtagctacaagaaaatcccaaattatgtgtggcttacacaatagttctaattggatagtgctgctctaacaccatcaatacctaaattagtagaaaactaaaaaatatgcctgttaaagtatggatatgttggttgcaaaaactacagaatactcgttagaaaagctgagttaagtgctctattccagcagagaatatcccaatttagatacagatattgaacacttgttcaatatttggatctttttttttgcaagacaaaattgaatgctagtcactttataatttgtgccttctaaaagggaaaaccttaatcctaagtttaaaataaaatgtgcactgactacagcatggtagtagattattttagtaacaagagattcaacaagtcttctcggctagtgctttaaatcgtatatgccctattataaaaccggtgaaaccagaaagcaaaccgtcctcctcacactgcccaaaacaactgccaatagagcgcatactcatatgtcaaagccaaaacgatgacagaagtttggtcttcctttcagctaaatagtgttaacaggtggtggctgggtgaaggcaggagagtgcctgttgctggccttaggcctcagataaataaggaaatgactgaatgaacaatttaaaactacacacactagtcagtgtaactatctagtaagttaaatacgccatgacatctaatgatggcctctgagacagagagcaggctagagccggagcgtttgacgtgattacagcagagtggaggcggttccttcctggctatattagctgaaacccaaagcaaatcttgccccagcacaaggcacccctttctgcgcctgtagtgtgtcagctatgtgcattttccttcaggatgagcaaaaatatttcgtcatcctccccgctcctcaacagcgcagaagatgccgaaaagcaattacaggaccttacagagctgctccgggggccgcgggaaacttaccagcatcctggaaaagacaaaaccagtggggtgcacttggcctctcctggctgcagggtgtggccgcccccacctttcaccttcccatccttaggaagcaaagtgacccctaagcctagacaaagctctcgaaagcccaaagcctcgggcccaccggccagctccccaccccgctgctgggccggacaggtgtaggggaggcggacccgccccgcagccgactcacccagctccagggcctggtcgcacctgagcagcgcggcctccggctgctgctggcgctgcaggctccgcgcctggcctgccagcctgcgcagccggcactcggccgggaagcacttctccagcaggccgctcagcaccacgttcacgcgccgcacctgcggccgcgcgggccctggctccacgcagcgcttgcagactgtgagcccgcagggcagcgtcaccggcttatgcagcagccgccggcagcgcgggcagccgagcaggtcgcggggcgcgcggggctccggggccggccctccctcgccgggcgcctcgggctcgccgcccgggttctccgcggacagcggccggtcgcgcaggcccacggcgcgcaccaggccgcccgccagctcttccagctcctccggccgcagcgccccgagccgcgcggcgccgcggaacgcgcccagggcttcggggaggcggccggcgcgggccagcgcgtcccccagcctcaggcacaggccgcggtccggctgcgccagcccggctagcatggagcgaaagagctcggctgccatctcgtagtcgcccgcgcggaaggcctcgtcgccctcctctaagcgctgggcgatcggctccgcgcggtcgcagccaggacactggggcggcggcggcggcgggaccggctcggggctcatcaccgcggggctgcgacgacgcgggtccggagcgaaggcgcggagcagggaggatgcgctgctgctgggaactggccggcgggagcgcggtctcagccctcgccagcagccacgcgcgtctgggggcggcgcgctgcgagcggctgagaccgcgggcgggggcgggcgcctggcttgggcagcgtcctcagcgcggtgtgggcggcgagccccgcagggctgcaatcgttccggggtgggggccgggacaggcaccgcgggcgcaatctgagcccctgcccacgcgcagcggcctctcagtcccgccggcttaggtaacccaggtcgctgcggtaacgcagtgaccgcgctccaggtccgcgtctcttgcgatgcttcccccactcgcctgagggctcctgcgcgactgcgcgcgcgtcctctgcctgccgcctccccgcagaggtgccggggccctgggagcaggtggccttggccgcgggctgctggcgcgccggcaccgcggcacctgctcttccccagaggcctggccgcccccacaacctgtggctccgcttaagcaagaacccaggaaaagtcaccaaacgcatcacgcatctctagcttcgacttaggaaattgtcctaaatgactggggaggctgaagtgggcacccagaggccccgcctcagcgagcttcttctcttaactctaggctgaggcctttgagaactcattttaacagagaacgtggagggccaagagaaccagataccaggaggaggagggattcgagaagtggacaattgtattgtgcccttgattaggaagcagaaatagaattagaaatagaattctaattaatagaattagaatagaaatagaaagggtgccctagtatggagtactgcagacataagttgctggggagagggagctaaac

SEQ ID NO: 9 - DNA, 528 bp, Homo sapiens
cgggatgaggcaccgcatcctggtaccagaggcttggacaccaaaatgacttctctagggtgcagcaaggtgagccacctggcttatcctatccccatcagcacgcgtcccacacctctcagtcccattccggaaatggagctctctcaggactggatacaggcaggagacctccctccccaaacaatgcattcagcccgagttcacattcaagattcaaaaagaaaggggaaaaacatagaaagaacaataacaatagcaaacatgatttttttttcagttaaaaaataaaatgagtctcttaccatctcgcctgaggttggcgttgcgcaaagctttgatggatgcgctctgcggggttgcagaagtgtcccgacagctgcaaaagtttgcgcagattagagtgtagacaaagatgagccggtgcatttgggatcagcgactagagacagcgtcgctccaagaaaaagccgggttctgctcccgggaccgacgccgcgccgccctgcgctctcgccgcctgcgctc

SEQ ID NO: 10 - DNA, 143661 bp, Homo sapiens
cggtcacttgctatagcagccatcccgggaagtcactgttcatcacggcatgctcctgtcaccctcccagccggcagcctgcaggagtcctgtgatgggctgaaaggccctcagggaacctgtaattaaatcccagaagattgccacttctcctgctggtgaggggaggaaacagcaaggcacagcaggcgtgtccagacagggctgagcagaggcaaccaggcagggacaggcttcacggctgcagtggccaagagcagagaatgcagggagctgggaatatgtttagtcgtggggaataaggggccagatggaagcaggtgatttctagctagacctaggctgagaagggctggaaacttttatgttctatcagacggaatgaaattagccgaggtccctacccattctaaaattctattacccatcaatccacctggtgaacaaacatttgctgtgaccagagccacttttcaaagcaaaaatccagttatatcactcccctgctccccactcaggcctgatggtcagctaatatgcacctgcacagccattctgacggttcaaatattaaaatattttcctaccagctcataccagtaagtagctgctgtcttcagcaccttctccaagtatttcacctgttctttccccaccgcacccccagtcctccatccaacacacacactgctcccatgccctccaaaaccctggagtttccctgccaagacttggtccagcaccacggccagtgtctgttctgatggttggtgccggtgtgttgttaaagattttgaatgtcattcttactactatttaaactccatagccttatatctgccatattccttttaaacatcaaccctgttaacttttacagcctcatctctcacaacacaatcaccacaaaccccaggtacatgaatttcccaccattccccaaaagagacatgcaaggcacattcatgtgcctggatttccctctccctcattttccctccaaaactcctactcatccctcacaagctttctcaattgtgccccagttcttataacctggcttcctgctcagttaggggaactggcttgatagcttggatatgccctgtatataaccagatctttgtgttggtttcttttccaggctcttgttttagtgacctgtcttatgcggcagccccttctcaagttgaggaccctgccttgatcgtacctgtgacccactattgttggcagctgcaagagacagggaaagagactggggcatcagaatgtcactatttctaataacctaagccaaccctcaaaagaccatcaagtaagggttgctttttctttttcttttctctctctctgtttttattgttgttgttgttgtttgttgtctttttttttttttttggcttcctgagtccattatgtccttcagtgctggtgatcagaacataataaacaaattaatcaacatttcatttatttacccttgttctgaccatgcacatgtgcctctccttatccatcacccatccttcacacccccaaaatgacttatttctctctcctctacactaccctcattcctccatctctcttgtggcctcaagaacgtcaaaactgcagtttttctctctttatcattcccatgtttccaggtctcttgatgcccaagatatttgtctaattctattgatccaatatgttctatttctctcaacaaaacataactacaaaatattccccagcatggatgaccatataattatgccttttccttcacatatctataaccaaatacattttatatactttctatttaacctagtaagtttccctactcaatgataatagatcacccccgacccgatcgatagtaccgatcacctctgtgggaagatgagactctgatgtggatgctgacctgaattcctagtccctgtgccccctcctcatctcgtccctctttgttcactctacactattctttctcccatgacccaagctttcagcactgccctttggacagctctccaatacatttgccccagggttagaatccagtgatggatgacagccaatcctacacagcagccttctttccaaacacagacaggtagagccatcccatggagatgcccataagcctcctcatcactcctaactccacacctgctctaacatatttttgtagagatggggtctccctctgttgcccgggctgtggtgcagtggtgcaatcatagctcactgcagcctcacacgaccccctgggcttaaacaatcctcctgcctctgcctcctgagaacataggaccacaggcacccgccaccatgcccggctaatgttcttattttttgtagagaaggagtttcactatattgcccaggctggtctgaaactcctggcctcaagcaatcctcctgccttgacctcccaaagtgttgggattacaggcgtaagccaccatgcctggcttttcctttaaacatactatttgcatgaactgatttgacaaattgaactggtattcatgggctgcaaaaaaacctggtactgggagatgtaccagacacaaccaccaagcttggctctgctgctcccggccaggatcaggtctctgtgtggcactcagcacaccacagccatctgggcagccatggccaagtggctgttctgcccctgtaccccgagaaggctcctgctccccaggaggatcatcctcactcccacagcccaaacaccttttgtcaaagtcctgtccctggggcacccacatgctaagagcaaagggagaggagacctcaccagaaatcctcaccagtgcatgcatgtggcagaaagtgccaaaaacgccaggcaaagtggttcacacctataatcccagcactttgggagactgaggcaggcagatcgtttgagaccaggagtttgagaccagcctggccaacatggcgaaaccccgtctctacaaatacaaaaattagccaggcatggtggcgggtgcctgtggtcccagctacttgggaggctgaggcaggagaatcacttgaacccaggaggtggaggttgcaagattgagccactgcactccagcctgggcaacagagcaggactctgtcaagaaaaaaaaaaaaaggaagaaagaaagaaagaaagaaagagagagagagaaagaaagacagagagagagagagaacgtgccagaaaaaccaattacaaatagtgttgtgggagccatttcttcaggtaccctctgagagagtgaacccttgtaattaaaagaacaaactctggaccctgtgctcaaatcttggctctaccacacacttgctctgtgactttggggaagttacctaacctctctgggcctcagtctcctcaaagtaaaataggagtaacaatagtgttaactcaggatttgtgaggattacttcagtttcatatttaagtgcttgatatttataaatgtaatatttatatttataaagcatttacatcagtaagagaaaaattatacacacataaatgcttataaaaatatataatatatatgcacaaatatatataatgtctatatacacaaatatagacattatatacagtattatatatttagatatactgtaataccattgatcgatatattaaagagatatttatgtactatatagaatatgtgtacttcatataatgtatatgcatacgtgtatgtatgtgtgtgtacacacattactaaaggttgcaagagagagagaaatgaacaaatgtactaccctaacacagctattattttctaaaaagtattttcttttgatctttttaaaaatttgcatacatttttacatcatgcagggcctacagttttgtgtgttgagttttttttggcataaataatgtcataaatgctgtgtcatgtggccacagaaacttagagtttcttttgtatgactgtataatatcccaaagagcatggagacctgaattgacttagctgttgcccttgtatctgcaggagtgctttaggctgcaagtaacaggaagccctgactcaactcccttaagcaataagggattttcttatcacacacaaaagaaaacttagaaggaaaatatctctggagttgattaattttgcagctcaacaatatcaccacagaaagggcgttttcatatttgtgctttgccatcatgaggatgatagatgatgagttgtccttaattttgacccttacagtcataatatgactgcaactatcccagctgaagtggaagaagaggtcgactcacatctcttaagagtaagagaccttccccagtctcccagcaacaccggatcacacgcctacttctaaaccaatcactgtcaagggaatgggatagccatgtggatttagaccaatcaggattcactcctggactggggatttaggagctcattccccaagagtggacaggtaaacagaaccaaattccttctggaggaaggagagtagggtggacagatattagggagacagctcacagtaattgtcttgttcccacttcacacatttctcttacatccaacttggaggaccaattattcctgagtaaaggaattaaaattcttaaaggatatgacatttgatcagggctttaaaggatgtgtaaatgtcaacataggcagggccaacatttcaggctgaggttccagcatgcctagaggcagagaggcagtaagttgtggggcattttccaggaagaatgagtgtccccggaaggctgtggtgtcaggtggtgggagggaggaggggtggaaggcgaggctaggttgaggacaaattgggagaagtgtttaaatgctgactgagaaagagtcttgacccagaatgttgtggtcatgggaagccactgaagatttcagagaagaaaatagacacagaaaagctgagctttcggggagagaaaaacctggctatggataaaagatgcatagcaggagagaggtgggtgcagggaggccagttaggaacacgccatgaccatccgagggtgggtcccaaccatgcaatgttcacgggaaggaggtgagagattccaccgatgcaggaaggtgagcttcacggaaccagtaggtgccttcacgttaggacaggaaccgaggggctgggggtgacaaggtgaaagatggcatcattaaccaagcccccaaaggagagaaaacagaggatctaccaagaatagggcagtgcctggggcgtgcacagagtcctgggtttccaggcaaggtgccagcacctcacacagtgacagcagacagcagcccaggagattggaacaaaaatgcatttatgccaacatcagaggaaaagggggaaaaaattagctgaatgaaatggcgagtacatggtaaaatttgggaagcgtgctctgtgaaagtttttgtttgttaattgaggcggggcttctaattggatttcagaaaaacagtcttcatgaatacaagataggaaaaaggagtgacaaagccttctccagggacagacacgggacagctgatgcagggcatgagaagtcatcaccgatgtgttccacagccacctgactgcaagtcaatctggtccctgtcctggctttataaagtaagggagggattatccatttattaaggacctgctatgtgccaggcaccaggctaggaaggcagccatgttcaaagtagtcctggtccctgccgttgcaaaactcatggacagtctagtgggtggaggcggcagacaactgaaagatggttgattgcaggcacagtggctcatgcctgaagccactgggcctgggaggccggtgctggtggatcacctgaggtcaggaatttgagaccaccctggccaacatggtgaaatcctatctgtgctgaaaaaaaaaaaacaaaaaaacaaaaaaacaaaactagctgggcatggtggcacatgcctgtgatcccactactctgggggctgaggcaggaaaattgcttgaatccaggaggcaaaggttgcagtgagctgagatcacatcactccactccagcctgggcgacagagcgagactccgtcacaaaggaaaaaacaaacgaaaaaaaaccttagataaggaatcccactggagaagcaactcattgaagaaagtgacatatggggtgagcgcttagcagtatgaaggagtcacgtaagtcaagatagcatagagggctgatgacaattaagtgtccaccgggatagaagcatttaataacggcccaattaattatctcaacaaccctgtgaggtagatattagtactacccccaattttcaggtaaggaaactgaggctcggagggtttagaaatatgttcagagtttgacgccagaagccaagcccttgacctctgcactgagtggcctccctcgacaaccctccctccacccttgctcacccagactgtggtagcctcctgacaggtctcccatgtcctctcgaagcccctccaatctactcccaacgcagcagccagcaggatcttttgtttttcttttcttttctttttcatttttttgaggcaaggtctcactttttcacccaggctggagtgcagtggtgtgaacacagctcactgcagcctcgacttcccaggctcaagcaatcctcccacctcagcctcccaagtagctgggaccacgggtacgtgcctaatttttcaatttttttgtagagatggggtctcacggtgttgcccaggctggtcttggcagaaggatattttggcgatgagaatctgaccttgccacctctcgccggaatccttcagtgactcccgttgttgttcagagggaggaaagatgcctcacctggaccggcctcacctgctctgtggggctcaggcccggcccctcccaagtctccacactcacccactgtgctccagccacacaagccctccctcggacccctcatgccattctcctctgcaccacagggcctttgtacatgccaatccctgattagaacactttccccacctctgccctaagttcctaccttagttggctcccacccatcctcagtgctccacccagccacctcctccaggaagtcctccctgatgcctagcctaggcaaagttcattcgccacacacaggtatcactcatcctttcttcagaccatgcttcttaaccctggccacccactggagtcacctagggagagtttaaggagcatcgatgcccacacctctgcctagatctggtgaatcagaatctcttgggaggcgtgtggggtggggagtggcctggacatcagcatttcctaaaatctccccaggtggttccaatgtgtggacacagtggaggattcgtgctttatcatcatttcctcattgcttaagtcattcttagggttattttgttcaagtttgtctcatccactagacgatacgttccatgtcccccagtccctgagaaagtgagcactcaataaatacttattcagcaaatgcagataactgtagcagccagcatttatctagcatatgccctgtctgtggacttcacaagcattgtcttctttcattctcacaaaaaccctatcaggtaggaattcctattagcccagtttgacagatggggaaactgaggctcaggaggttgaaaggtagtgagtcccagagtgtagattccagcccttgtccatctgactccaggacctgccttgcagaactttctccctacccaactctgcccagctcctcaggaccctgcagtaaacagcatctgcaatgtcgccgcctctgagcgacactcctgtgtgggtgacttggcccttcccagtctctgggcccctccaagacggcccccagcccagttctaaggaaaacaaagttcttgtgagtggaaagaaaagaaaagaaaacaaaacaaaacaaaacaaaacaaaaaagcccaggctcagtctgtctggttcatcagtctgtctggacaccagggagaggcttctaattggattcagtcaggctgcttcctgctgacatttggtgggtggtgacattcggcaggtgagggactaggttagaaagtcgccaagcaggcccaggcctcgggagagggagtttaacctgtgtggctttgatgctggtcagaagccacactcccttgagagctgtcctgatctctatcccaagagaccagacaccagccggcgctccacttaatgccagccagaggaaggctaaggggcttagagtctggctaaggatttctgtccctctttgcttccctccttacaaactagcagactgaaaactctccaaatcacggagtgatgattcacagaggttattaaggtgcagggacctgggaaagcagtggttctcagccctggtcacatgtaagtatctcttccagaggagcttttaaaaactaacaatgcccaggtcctacctgagacctattgcatctgaatgtgcaaaggtgcagcccaggtacctgtatttctcaaaacctccccaggtagttccaagggacagccagatgtgagaatcactgcgctagaaggtaaataaatggctcctgggaagggacagacggtgacatcatagtgtgtggtgtggactcacccagcccattctcccttcttctgttaacagctgacttagggaactatgcctccccaaccctcggtcctgatggtttgggattggtcttgctcctagacccggggatggtcacacaacccaggcttggccaatcagagttctgaatctccctaaagacagtggttgattcaagaagggcgtgtaacccaagtgagcccggtgggaatcagccgtagggcctctgtgggtgccgctaaggaagaaaagctctcttccctctgggactgctaagtacggacatcctcccttctggagagaatctgcctgcgaataaagccgtaacagaggaactgcaacatcaaaaggtgaaaagagacagattccagtgaagtagtttgagtcctggatccagccatgcctgaaggatgatttcagttacttgagcccataaattccctttttcctattaccctgtctaaattgtgtttcttttatttgtggtttggaaaagtattaactgatgctgctgttactgatacatctgccccatggtgagattgatgaggtgaagctgtgggctagattccactccacataccccaggccaaccagcatggcgtgagcaaaccaggaatgggagggaagaacagctctctgccctcctccatggaacctccttccttaccattaccttcctctcctgccagcatgggtctcctgcagcccagattataccctagaacaggccatgtgcaatagccaagccactgcacagccaggcctcccccatgtatgcagtgcttcctgggtgtgtgtatgagagtcagaggcttggattgcagccccatctccaccttttggccagggctggcacttacatgcctctggggttgaagggcctcctcaaattttgcattctagatccctcatcttagtcccagcttgctcctagcagccgattgacttagggcagattccataacctcaacgccttcacttcctcattgagaaaccacaatagttttacagagtgcctactaggtgctgttctcatcgtttttcctgtgatgcctcactggccccacatggccagccccctcacctcctgggggtcttcactgaagtgacaccatcccagcgaggcccccctagactgttctcttcacaattgcaaccctccctgctttattttccttgtcaccacttaacaccatctaacacgctccacaggtcacacatttatttgtggtctgattcctcccactgggatgtaagctccaggaagacaggattgcttttcttttcttcactgctgtattttgggggccttgtacagtgcctggcacatagtaggtgctcaagaaatgtgcactgatggaaggaatggattcaatgctcagaagtaagcagtcaggtaagtccaattagcatctcaaggtagacattgtccctgagaatacagcatttaggaggtcctgagcatatagtaggtccttaaaggatgtcattcacaaatgctcttttctttctttttttaaagagacagggtcttattctgtcatccaggctggagtgcagtggcacaatcatagctcactgcagtctcaaactcctgggctcaagcaatcctcccacctcagcctccctagtagtggagactacagacatgcaccacatgcctggctaattttttgttgttgttgctattgttttttatagagatggggccttgttatgttgcccaggctcacagcaagagcctggtcttgaactcctgggctcaagtgattcttccgcctcggcctcccaaactgctgggattataggtgtgagccaccgtgcctggccagctcttttcttgagctgcagagcaacttgagaaagaacttggtgatgactttgccaggtatctctccaggtcatttataataaagcaaatcatttgacatctgcttcttcactcgggctcttcgtggggccaatcaaagggacaacaaatttcccatctcagagctgctaatgaaggttaaataattaatgcctggaacaaagtagaggaggctggacagcttcccggctgcaatctcctgcccatgcctgtggacatcccgctctgatctcaagcccaccgtgctcaaacggctggcttcatgccgctgcctccatcccagccccactggcctttctcctcatggcaagcacagagtatagaatgggcagaagttgtttctaggagcaaaaactcaaaccagaagagcccttgaagagatactcagaggcactcctcatcagggaaatgcatgttgaggcaatgagatgtcgttttatgctttatactgattagataggcaaacagtagaaagctggagaatgcccagtgttggtcaggatatgggaactttaagcagtgcaaattcaacgtaatctacgctgtgactccatcagcctgcacctggatgcacactccaagtggatccttggtccttaggaggacacaggtccttaggatgcacacaggtccttaggaggacaggcctgaggatgttctctgcagcttcctttgtggtgacaaggatttggaaacaagctcgttgtctatcactaagagaacagacaggcacaggaggagcgcagtgtggagaatcaggcgggtgttgggttaggtatagacacagccacatggataatctcaaacagagtgcatgaaaactgaagaaacagaatgagatctatagcacaaactgagatcaactgcattactgttcagcagacattcacagccgtccttcttggggaacagtcttccccactgtttcagtccattctcgtactgctataaagaaatacctgagactgggtaatttatgaagaaagagtcttgttctgtcacccaggctggagtgcagtggcatgatctcggctcactgcagcctctgtctcctgggttcaagtaattctcatacctcggcctcccaagtagctgggattacaggcatgcaccaccacacctggctaatttttgtatttttagtagagatggggtttcaccatgttggccaggctggtcttgaactcctgacctcaagtgattcacctgcctcagcctccctaagtgttgggattataggtgtgagccacttagcctggccagaacagaggtttcattggctcactgttctgcaggctgtacagaaagcatgatgctgacatctgcttggcttctggggaggcctcaggaaacttacaatcatagcaaaaggcaaaggggaaatcagcaattcgcatggtggcagcaggaggaagagagaaaggtaggagatgccacacaaccggatctcactagaactcactatcgccatgacagcaccaagtggggatggtgttaaaccattcatgagaaatccacccccatgatccagtcatctgcagcaggccccaccttcagcattggggattatagatttgggtggggacacaaatccaaaccatatcacccatcctactaactttgggcctgaacatgtgacttgctttgtccagtgacataggggcagaggtgaccatgtgccatcacccagccagggcttacacagtatcccagatcatggctcacccctgttgcatttccaccgctgccataagaatatcccctggtgctggccccagtgtgacaggagatgtgtccagcaagaagacctgaacacaaccctcagcctggacccaaggtaacccgcccaacctgcagactcacaagcaagaaaaataatgcttggttatggaagccacttgctgagtggtggggtgatttgttacacagccttactgcaggaatagctgactaatacacatactattcatatgaatttaaaatacatgcaaaagggggcacctttgtaaaaacacatacaagcagaaatacttcagacagaattggatggttgccagtatggaagggaggggaatggagaaaagaataacccattattcaatcaactggagactggtatggaccattcaggaccatagccttgacctgagcagcactctcagctcactctcttctcccgagtttctgtctcaccagaaacaagtccatgagggcagggccctagaaatcatactggggaggtacagagttggtgttcaataaatatttgtgaaggccaagtgtggttgctcacacctggaatcccagcactttgagaagctgaggtagggggtttgcttggggccaggagttttgagaccagccagggcaacatggcaaaacccccatctctataaaaaatttaaaagttagccaggagcagtggctcatgtctgtattctccactactcaggaggctaaggcaggaggattgcttgagtccaggagttctaggttacagtgagctatgatcatactactgcactccagcctgggtgacagagcaagactttgtcacaaaaaaaaaaaaaaaaaaaaagtgtgttgagccaatgactaagataaaaagtctgaagacttctttgaccctcagaaccccagaacctcccttctggaagaaaatttgccactatcttctcaaaatgcaaaactcaaattccagaggggtcttccaatgtcaccttttccttgaagtccaagagaggttcggaaacaggcctgaggtcccgtagctgctcagggctgggccctgcattcaaccctcgatctgctggtagccaaagtccctattttgaaccctgccaccctccacggggaggatgaagggcttggagttgaactcaattaaatcttcctcactctctcagccagtttatttgtccatttgagtcttaaagaggcgttgatgagaactccacaggaaatcatgagacagcagaggtgctttgcagcagagaaggcagggcggggcagaacaaccttccccagcacgcaggtcattagttccatttgcaagggccactccccgccaacactactaccctccagctcatttaattcaaaataaatgtacagggcaggaaagtcattgaggtgcaagaaaggagggaaggctttaaaagcgagctatgggccaggcgtggtggctcacgcctgtaatcccagcacttcaggaggccaaggtgggaggatcacctgaggtcaggagttcgagaccagcctggccaacatggcaaaaccccatctctacaaaaattagccaggcatgatggcaggtgcctgtaatctcagctatttgggaggttaaggtaggagaatcgcttgaacctgggaggcggaggttgcagtgagtctagattgcgccattgcactccagcctgggtgacagagtgagactctgtctcaaaaaataaataaataaaataaaataaaaacaaaagtgagctatgaatttcatttccaaggaaaggagaatacggaagagagagtggagaagttgaagagacccagaggagcatggcaccatgggagagctgtggctccagcgtgcagcggccctgggttcaaattctggctctgtcatttcgcggttgtgcgagggtgtcacatgcttagcctctctgaacctcagtttacccatctgaaaaatgaggaccaaagtggcacctatttcctggggctgttgggaggatccaatgagaccatgagctgatctatgcataacacctggctcagagcaggctctggaatgtagctcacatattttctgggcacctactggatgccaagcaccatgtggggatttggcattgaacaagacaggcaaggcagtgcccttgtggagttcaaggtcttgtgaagagaacaagacagaaaacatgtgaacgcataaaacgagatcatttcggggatttgcaggagggacaaagcaaggtgacttgagaaggtgtttattttagacagcacggtccagggaggtttctccaaggcgaggacattgaggtgagactcggatggagcccattatggggagcagcgtcaaaaacagtgagcaggggagcccctaatcccatcagcaaacagctcccacctgccctggaatggctgctgagagaggtccctgtgggtccccaggcctctgagagctgccacagcccggccagccttcctgagctagtcccatcctgatgggggaatggggggcttcagagtcaacaatgagggctctgcttgcgtttttatttctgatgccaagtggtgtctatgatgcagggtctgacttggggctcttgacaccttgcattttggggatattaagtcaaaatcttaaatgaccacttagcgttaggctctcggctatacgctagagacagacgtgaagaagtcctgcctctcaggccatgctgaggctctccccaagatctgggcagggctgcttcacagccatgccacccctctgcctcaaggcagctgtgaatcagtttttggagttcaaatcagatcgtgccacctgtgattccattgtcttgcaagtggcttccaagaggtagcccaagttcctcaaggtgacatttcaggtgtgttgcaacccagccctgctaagccctcccgcctggcccctcctgctccctggtcctcagtgtgccagcaacagccattagctgctgtagacagaaccggacacaagcatccatcctcctccttgaaattgcatgtgctgttcctcccatctagaatgccttttcctaccttcactgctcagcctgcaggatgcatcacagatgatgctgcctggtgaacccttgcctagcaacccgatccgtatctcaagtgaggtcaggtccagctctgggatctacaggacaactacaccaaaatctaagaccccttcatcccaggacccagggaatcacccccacccttcaggaccctgccagaccttcacccagcctgcctttcagggcactaagcctttccatgcccaggtcaatcacagtcgcacaaggaaagaacaaggaagtggtcagactcacagcatccttatcggcagaccatcctgcccactttacaaggaaggggactgaggctttcactttataaggtcactgggtgctatagtttggtttatgtgaccccctccagatctcaggttgaaatttgatctctgctgttagagatggagcctaatggaaggtgtttgggtcatgggggaggactcctcatgaatagatcaatgccctcccttgtgtgggacgagggtggaagtgagttctcactctattcgtttctgcaggagctggttgttgaaaagagcccggcacctccctccgtctcttgcctcctctcttgcatgtgacctctgcacacagcagctctcctttgctttcctccatgagtggaagcagcctgaggccctcaccagaagcagatgcaggcttctcgtacagcctgcagaaccatgagccaaataagcctctattcattgcaaattacccagacacaggtattcctttacagcaacacaaacagacgtagatgcccaacttgcaaatcagagcctggatttgaaccagatctttggttcctctggctcaaagtcatcctctttctactacattggtacaaaagtaattgcagtgtttgccactgaaagcaatgacaaaactgcaattactcaatgcatgcaggtcattagttccatttgcaagggccactccccgccaacactaccctccagctcatttaattcaaaataaacgtccagggcaggaaagtcattgaggcagcccatgcatcctcacctacttactcttgtcctgaacataacagaagagctcttttctgctcttcctagaggtttttgccagctcagtccctcgcggtgggcacttgcccgtcctgacaataacctgatgaccttcgctgctctgatgttcactctgacctgctgcctggacagcttttggaaatctccttctccagcagggcgtctgctcctgtggctctcaaggctccagccagtgtttccagggacatttgtctcaatgggaacctttgggcagcctagaattttgaactgttgagaagccagcggtctttctctctgctcttctgcctttttttttttaatggagtctcgctctgtcatccaggctggagtgcagtggtgtgatctcggctcactgcaacccaacctccatctccaggttcaagtgattctcccgcctcagcctcccaagtagctgggattacaggtgcccaccaccatgcccagctaattttgtattttttagtacagacagggtttcaccatgttggccaggcaggtcttgaactcctgacctcgggtgatctgtctgccttggcctcccaaggtgctgggactataggcatgagccaccacgcctggccccttctgccctctcgaaggaccatctcccttgctgacagggcatctgccaatcagcaatctttcacctctaggtcactctccaagtaagacagaccagggcgatgactggggagcacttcctaagtccttggcaccatcgttgagttggcggctggtgggggttttagaaaagaagaaaaattggcttcaaggaccacatcccactcaaactagcttaactccaaaggaagttctgagaggccacaggggactgtcctgggcccaggaggtgttcgaagagcagacttagaacatgagatggggactccctctctgtctctgattaccaggggtcttcccttgacgcctctacacatccgtttcattcttttgttgtggcgacacccacatgatgaccatggccccatggttgtctgccccacctcctagctcagcagtgcacctggtcaccccacagtcaatgaaatctctaggtctccttttcaaaaaaaatccaaagagagagattctgattggtccagttggagccgggtccagctcaggtccagtgagctgaggcgaggggtagggttgcaccatgcagagaggcgccccttggggctgtggtcagtttcattaataagggagtgtagctggggaggcaatgattggcaccactaatatgggtgggggatggggagtgcaccattgtttggtttattattaggttggggcacctgtagtcccagctacttgggaggcagaggcgggagaatcacttgaacctggagatggaggttgggttgcagtgagccgagatcacaccactgcactccagcctggatgacagagcgagactccattaaaaaaaaaaaaaaggcagaggagcagagagaaagaccgctggcttctcaactgttcaaaattctaggctgcccaaaggttcccattgagacaaatgtccctggaaacactggctggagccttgagagccacaggagcagatgccctgctggagaaggagatttccaaaagctgtccaggcagcaggtcagagtgaacatcagagcagcgaaggtcatcaggttattgtcaggacgggcaagtgcccaccgcgagggactgagctggcaaaaacctctaggaagagcagaaaagagctcttctgttatgttcaggacaagagtaagaaggtgaggatggatgggctgcttggagccaaaggtaagattctgaaagcatggtggtaggaagtgagcagaacgtccctgattctgctttgtttcagactcctctggcaagaaagaggatcacttaaaccacaaagagcagcccaagtactggcaaggcagagccaaagtccaaatggagccaaggttctgagccttctgaatgtgttccagcctcccaacatgaacaaacatggactgtggcattgggaccctccgtgaggatggatggatgcttcattgctgtgcagtggggactctggggaactaacggggaacccagcacttgaaagcacataatgacattccaactgcaaaaaaagaaagaaactagagtttgtgagctcaagggtagcaaacattccagctgaatttttttttttctttttgagacagggtttcgctccgtcacccaggctggagtgcagtggtgtgatcatagttcactacagccacgacctcctgagctcaagccatccttttgccttagcctccagagtagctaggaccacaggcacgcaccaccacacccagcttttttaaaatacattattttgtgtagaggtggagtttcactatgttgcccaggctggtctcaaactcctggactcaagtgatcctcctgcctcggcttcccaaagcactgggattccaggcatgaggcaccaggccagcccccaaattctcaagttaactacagtgggatgaaccttgagacctgaactgagcttttcccatgcccttccatgaatgtgtctttccccacatgtaactgttgctgtatgacagaatgacacactggtcagcagagaggcagctcaggccaccagaacaggacttctgagttacaagagtctgggcttttaagttcaaaagccacggttttcactgtatgtaatatatttagaagaagagatgaaagtccaggctgccacctctccccactctccccatatgccatacgaaagttcccctggcctgggggaccgaggaagggatgtcagagaatatgacagagacttcatgcatcaccaaaatttgttttctttccctcatgcatgccaccatgccaggctaattttttttattgttgttgttgttttaacttttagtagagacaagacctggctatgttgcctgggctggtctcgagctcctgggctcaaatgatcctcctgccttggcctcccaaagtgccgggattacaggcataagccatcgtgcctggctgggaaagactttttaaataggccagagaaaaaaacaaacaaccccatcaaaaagcgggcaaggatacgaacagacacttctcaaaagaagacatttatgcagccaaaaaacacatgaaaaaatgctcatcatcactggccatcagagaaatgcaaatcaaaaccacagtgagataccatctcacaccagttagaatggcaatcattaaaaagtcaggaaacaacaggttctggagaggatgtggagaaataggaacacttttacactgttggtgggactgtaaaccagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaactcaaatgtccaacaataatagactggattaagaaaatgtgacacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaacgagaacacatggacacaggaagaggaacatcacactctggggactgttgtggggtggggggagtggggagggatagcattaggagatatacctaatgctaaatgacgagttgatgggtgcagcacaccagcatggcacatgtatgcagatgtaactaacctgcacattgtgcgcatgtaccctaaaacttaaagtataataataataaaataaaataaaataaaataaaaataaaaaataaataggccaaagaaagcattaatcctaaagagaaggatggataaatttagctgctttaaaattaagtatttctttggatatttaccttaaaccatctataaaaattaactcaatatggatcagagacctaaacagaagagctaaaacaataaaactcttagtagaaaacaggaggaaaacttcatgacattggatttggcaacagttccttgggtataaaaccaaaagcacaggcatcaaaggaaaaaatagataaactgaacaacatcaaaattaaaacttctgcatcaaaggataatatcaagacagtgaaaaggcaacccatgcaaggagaaaaaatatctgcgaatcagagatatctgataaggtgttaatatccagaatatataaagactcctcctgtaacttaccaccaacaaaaaaacaaacactgtgattcaaaaatgggcaaaagactaagctatgaggttgcaaaggcataagaatgacacaatgggctgggcgcagtggttcatgcctgtaatcccaacactttaggagatcaaggcgggtggatcacctgagttcaggagttcaagaacagcctggccaacatggctaaaccccgtctctactaaaaatacaaaaaattagctcggcatggtggcaggtgcctataatcccagctactcaggaggctgaggcaggagaatcacttgaaccccgggaggcagaggttgccgtgagccaagattgtgccactgcactccagcctggggcatagagcatgttagtgtatcttcacaacacacaacagccaacagccaagggacccacctgtccctcaacagacaaatggataaaccaggtgtgttacatccatgcgatggcatattagccttaggaagaaatggaattctcacacgtgctgcaccagaaatgaaccttgaagacattatgtttcatgaaataaaccagacacgcaaatactggtgattccacttagatgaggtacccaaagtagtcaaattcatagagataggaagtagaatggtgattgccagaggctggaaggagaggcagatgggaagtgagtgcttaatgactacagagtttcagtttgggaagatgaaaaagttctggaggtaaatggtgatgatggttgcagagaatgtggatgtatttaatgccactgaactgtacacttaaaaatggttaaaatggtaaattttatgttatatattttaccataataaaaaaaattaaaacttcttcttttttttttttttttttttgagactgagtcttgctctattccccaggctagagtgcagtggcacaatctcggctcacggcaacctctgcctcccgggttcaagtgatactcccacctcagcctcccaagtagctgggactacaggtgctggccaccacatccagctaatttttatatttttggtagagatggagtttcaccatgttggccaggttggtctcaaactcctgacctcaggtgatccacttgccttggcctcccaaagtgctaggattatagacgtgagccaccgcacctggccaaaaatgagaacttcttaaaagacatctgagaaaaggcaagccacagagtgggaaaaggtatttgcaacatatacaagcaacaaagattatcgtgtgtaaaaaagactcctataaatcggtaagaaaaagacaatctaatagaaaccgtggcaaaagatgcaaacaggcacttcatgcaagagaagttccaaatagccataaacacaaaaagatgttcaacctcattagtaatcagggaaacgtaaattggaaatcacaatgtgataccatttctcacccaccagattggcaaaatttataaatctgatgaatgccaagtattgtcaaggatagagagatgggaattttcatagcccactagtgggggtgtaaactggtacacacactttgcaaaatgggatagaaaacttaataatgttgaagatacactaagtcaacccaggaattccacatctgggtagatgcgaaaccagtggttctcagactggagtatgcatgaaaatcacccacagggcttatggaacacgaattgcagggtccactgcttctagttcaggaggtccgtagtgggacttgagaatttgcagagtggttttgtttgtttgtttgtttgtttgtttttgagacagggtctcactctgtcacccaggctagagtgcactggcatgatcatagctcactacagcctcgaactcctggcctcaagtgatcctcctgtcttggcctcccaaagtgctgggattacaggcatgagtcactgcacccagccaaaatttgcatttctaacaagctcccaggtgatgctgattccaccagtttgagaatcacacttgaagaaccagtggcattgttcctaataaaaactgaaaatgacccaaatatccattaagaatagaatgaacaaatagaaggtggtgtagcaatacagcagaatattacataacaatgaaaagaaataaactacagttacatgatcaacataatgtcaagcagaagaaaccagacacaaaaaagtacactgatcacatttaggcaaaaaattcgaaaacaaataaatctatatacttggtaaaaccacaaggtgagatcagctaacattttctttttctttgtttcttttttttttttttttttttttttttgaggcagagtcttgctgtgtcacccagactgaagtggaatggtgcaatctcgactcactgcaacctctgcctccagggttcaagctattcttatgcctcagcctctcaagtagctggaactacaggtgtgcaccaccacacccagctaattttttgcatttttagtagagacagggttttgtcatgttggccaggatggtctcaaactcctggcctcaatcctccatccgtctttgcctcccaaagtgctaggattacaggtgtaagccaccatgcccagccagctaatattttctataaagggacagacagtaaatattttatgttgtgcaagacagatggtctcagccatagaccatacgtaaaggagtgggagttgctgtgttctgataaaactttatttacaaaaaaacacaacaggccatagtttggcaacccttgttagaaagtgaagcaaggcagtgatgaccctcccctggggaaagggatttggtagtggccaggaagggttacaggggcttctgggagtctgacaatgacccatttcttaaccttagctgtaataaagtttttgccttacaataatttgtcaggctatatatgtatatgttatgcaccttgctgcattgtactaatttcccaattttaaaaaggttttaaaaataaataaataaatcatgaatagatcaagaaaatgtagtctacccatacaatgcaatattattttgcaataaaaaggaaggaatgggccgggtgtggtggcttactcctgtaatcccagcactttgggaggccgaggcgggaagatcacctgaggtcaggagtttgagaccagcctggccaacacggcaaaaccctgtctctactaaaaacaaaaaaattagctgggtgtggtggcatgtacccataatcccagctactcgggaggctgaggcaggagaattgcttgaacccaggaggtggaggttgcagtgagccgagatcacgccactgcactccagcctgggtgacagagtgagactctgcctcaaaaaaaaaaaaaaaggaagacgtgaagtactgacacccaccacattatgaatgaaccttgcaaacattatgctaaagagaaagaagccagtcacaaaagtccacatattctatgccttcgtttttatgtgcctataattagcaaatctatagagatagaaagtagatcagggccaggtatggtggctcacacctgtaatcctagcactctaggagtcccaggcaagaggatcacttgagtccagaaattcaagaccgacctgggcaacacagtgagacctcatctctacaaaaaataaaacaaaattagacgggcatcgtggcgtgtacctgtagtctcagatactcgggaggctgagctgggaggagcacttgagcccaggaggtggaggctggagtgagttatgattgtgccactgcagtccagcctgggtgacagagggagaccctgtctcaaaaaaaaaaaaaaaaaaaatagatcagtgtttgcctccgtctcttggaggtgggaggattgaggggtaagtgctcaagtaaatggggttccttttcaggttgatgaaagtgctctaaaattgatagtgatgattgcacaactctgaatacactaaaaaccactgaattatacactttaaacaggcaaattgaatggaagtgaattacatctcaaaaaagctgctatcagaaatttctttaatgtaaaactaatgaataaaactgacaacctctgccctcaccgccagagatgggccagggagaggcatgtgtgacaagatcaaccagacagaaaccggctttggagaaatcactagcccctccccctgctccagaagcccccagtcccacatgggaccctttctctgcctttggcaaacgcgagcggaagatcggaagcccaggaggccagagattctgcagacaagcaggggccagggcatccccgccaagagacagaggactttttaaatccaaaatgaaatttcaagcagacgcctgagcaaagtaaaccccagccggttctgcggagccaattgccgggcagccaatgggagagggggctccagccctctgggaacagttcctctgaaaggacctctctcctgagtttccagttcctggtggcttcaaggcgtaggtaggggtctcaggggcatgggcctctctgctccccgtgcaggctgaaggtggcacatttggaggttctgtgttacatctcaggctttgcagcatctccagggagcctgacagatggctgcaaatgatgaggccacaggagccagcagatgggatgcctgatgagcagagggtaactcgggtcccctcagctgctgcctccctcctgctccacgcaggccctgacagctgtgagccaaggggcctccccgccaggtcagaacacacagcaaagcagaccaaagaaattcctgggcctgagcagtggaagaggaaccaggaggcaccaggcagggtgaaaaggcccatgaggtgtggctgaaatagcacaggactgacgggatacgtcactttgctgtgtgacctcaggcaagtggctcaacttctctgagtcagctgcccggccactctggtgtaaagcagagatcacagtacctaacccaaagagctgtcgaaagaactaaatgaggtcagtcgcggtggctcatgcctgtaatcccagcactttgggaggccaaggtgggcagatcacttgaggtcaggaattcgagaccagcctgggcaacatggcgaaaccctgcctctactaaaaatacaaaaattagccgggtgtggtggcgggcacctgtaatcccagctactcaggaggctgaggcaaaagaatcgcttgagcccaggagacagaggttgcagtgagccgaaactgtgccattgcactccagcctgggccacagagcaagactctgtctcaaaaaaaagaaagaaagaaagaaagaaagaaagaaagagagagagagagagagagagagagagagagagagagagagagagagagagaaagaaagaaagaaagaaagaaagaaaagaaagaaagaaagaaagaaagaaagaaagaaagaattaaatgaagcaaggggtatgagagtatcaggctgtgaatggaattctgtgcgttattctataaagcttagttgaatgttttagctgagtagaaataaacgcaaactgagttattccaagttagccttccagctggctgggccacactgaagagatgggggaaatccgacaggatattcaagctggagtttgagccagacgttgtgctaactcctcacatggatcatcccacttgattctcagaagaatcccacaaagtggacgctgttatccctattttacagatgaagacatgaagtcactaaaaggatcaacagcacgcctgaggccccaccactagagagccagagctggaatctgaacccagagcccggctctcaaagccctgcatctaaatccaagccctgctactgacctggagcaagttttgtttttgttttgttttgttttgagacagagtcttgctctgtcactcaggctggagtgcagtggtgcaatcacagctcactgcagtctcgacctccctggctcaagccatcctcctgcctcagcctcccgagtagctaggactacaggtatgtaccactacgcctggctaatgtttcttaacctctctgagcacagcttcctgatctgaaaaaaggagaagaaagaagaagaaggaggaggaggagagaaagaaagaaagaaaaagaaagaaagaaagaaagaaagaaagaaagaaagaaagaaagagaaggaaggaaggaaagaagaaggaagaaagggagggagaagagaaagaaaggaagaaagaaagaaagagaaagaaagaaggaaagaaagaaaaagaaagaaagaatgaaggaaagaaagaaagaaagaaagaaagaaagaaagaaagaaagaaagaaagaaagaaagaaaaagaaagaaagaaaaagaaaagttctctgtgggttgtgtgataacatgcatgaaagggatgagtatactcagtgagtgcttactgtatatgtcagggtcgggctaagggaagttgccccagagacaggaccctatttcttaaggaccggtatgcaggaggcatacttcatatgctcagtccatggcagccacaaagagttctatctctgggcctcaatttcctcatctgttaaatggagcaagtgggaccggctctcggagccctttgcactctgacattccatgcacaagggtcagactattttcctggaactagaagcacaagaagaagaaagcagaaggaggtgcctgaggctggagggcctcagagaatcacaagtgtcacccccatggtgtgacggccaaaggggaggaataaagattcctccccagccctacctggccgacacttacctcgccctttcctttcactggatttcactccttaccccccttgctggggcagtcttttctattttattagttcacctggggacaggaagtaaaatggcaaaggctaggactctgcagcccctacccaggttcagagccacctctgccacttaaaacgcacatgatcttggttgggaaagatgatgtaaactacctgggcctcagtttccccatccataacctagtgtaacagcagtacaacctcttcaagttgttggggaatcaagtgggcctggcatgttgctaaaacagaaataaggttttggtattcttattcttattcttattcttattactttgaggcagggtctcgctctgttgtccaggctggagtgcagtggcgtgatactggctcacttcaacctccacttcccaagttcaaatgattctcctgccttggcctcccaagtggctgggattacaggcacccaccaccacgcccagctaatttttgtatttttagtagagacgtgattccaccatgttggccaggctggtcttgaacttcttcttcttcttttttttttttttttttgagatggagtctcgctctgttgcccaggctggagtgcaatggctcaatcttggctcattgcaagcttcacctcccaggttcacgccattcgcctgtctcagcctcccgagtagctgggactacaggcgcccgccaccgcacccggctaattttttgtatttttagtagagacggggtttcatcgtgttagccaggatggtctcaatctcctgacctcgtgatccgcctgcctcggcctcccaaagtgctgggattacaggtgtgaaccaccgcacctgatctattattattattattattattattttgagaaaagatctcattctgttacccagactggaatgtggtggctcaatcatggctcactacagcctctacctcccaggctcaagtgatcctcccacctcagccttccgagtagctgggactacaggcacgtgccaccatgcgcagctaattttttatttttttagagacaggggtcttgttatgctgccaaggctggtctctaactccggggctcaagcaatcctcccaccttggcctcccaaagtgctggattacaggcatgagccaccgccactactctatcatcattattattattaatttgaaagcatcttgaaaaaataaactggcatactaaaactatgagttgacagatattactgctcaggatgagactaaaataattagactttttcagtgaatgaatgtgaacagaaatagtaaatgagcagtggtatgggaggcgggtatggcacacggccgaaattgggaaggcagcgtgaaatgaaaatgaacagcccttcgttgaaagattattaagaatttctcaagacagtaaccaagtgtggtggcgcaagcctatagtcccagctacttgggaggctgaggcgggaggattgcttgggcccagaagttcgaggttacagtgagctacgattgcaccaccgcactccagcctggacgatagagtgagaccccatctctaaaaaataaaaaggaaacatgacaggccggcgcagtggctcacgcctgtaatcccagcaatttgggaggccgaggcgggcggatcacgaggtcaggagatcgagaccatcctggctaacacgatgaaaccccgtctctactaaaaatacaaaaaattagctggttgcggtggtgggcgcctgtagtcccagctactcgggaggctgagacaggcaaatggcatgaacccgggaggcagagcttgcggtgagccgagattgcgccactgcattccagcctgggcgacagagtgagactccgtctcaaaacaaacaaacaaacaaacaaacaaaaaggaaacatgacaaaatagtgtcccagatttccagcataacacaggcagtgtggtttagcaatgaggtgcaagtatagacatgtatgatgatgttgtcttttttaaccctatctgtgaatccctgggcccctcatacaggatgttcactgcccaaccctacgccatcatagatcagtacaaattgtgagccttcgagttatattatcatttctcatagcaaagcatgctaagaccacagagccatttagaaatttaaattactgctgtttacccttaacagagtctatttgccatggagaaactgtttccaattacaaaacatgaaggctggtcaccgtttggggttaatatgatgctctgtggaagagtgagcaggcaagactgcccaaatacctaattacctggaaagataatcttgaataattggaattagagcaactaaagcaattattagatgttgtgatctccaggagcaatcttccaccaggcttagggatttaatcacctttaataagagcacataattagaggaatccagaaattcagaaaagaaagtggcagaaccagcacttcagaattaaggaggtgggagggccaggtgtgtttctcaagcaaatgcgtctcgagggatggctgagaaggaagggtgggtagcagggtaggcttgaaaacctcggaagcctagaggctgagcctgactctgacctaaacctgctgtgtgaccttgagcaaggcagttgacctctctgggctctcccttccttccacccttcagtcacttagctatgtccactgagcacctgccaggttcccagcactgagatactcagtgtcgccttttgcacaggctgttcattctactgggacttcctctgacacccctcatgcacgagaaggaattgcattctgtcttcgagatgcttccaacatggcgctcctccactcaatcttcctagactgccatcacaccgcagccctctgtctcccctcacggattgtgagtctggatcccctcatctgccttcccactagaagatgagctcttcaagaacagagcgaggttagggatggttctcctccctgccttatttcctgacacacaccctggcatcaagggatactgacgactggcccaaggcaagatggacgaaggttactgcagcccactcctgaaagcgaggttgcagtctgccctgcctccgagaattaactggcatcaggtgagccagcctctgctgtgagttgactgacaatggccaggcatcataggaagattctagagctccacgatggagcagggccattcagatggtggacagttcccaacctgggtcgcagggctgggagtattatctccatactatctgggaatggtaggtgagaaggagtaatggagtgtgaccagtatcctgcctttctgtgtcttgaaatgtctgtctctttgaaatggaaagaatcacagcttccatgtttctgggccctggaccaccaggaggtacccagtccctcgggagcatcgagtgagagtaattgatgcagtctggggatgaaggagggctttgtggaggcaggacctttgggttggctcatgaaggttgatggagggttccccagacagccaggggtgtaaagagcattgattaactctcaggcaaaaagatgctctagccacctggcgtattccggctgcagccagtaggttgacctgtttttagctcagatgtcagtttgggcagctgtggaagcagctgtggagaggggctcccctctctgctcagcatgctctgatctatgcacgtttcagttctatgacataaatcaataaaaagcactaaataaattaagtgagcagcagaattgtaaatcgatttcaggcggagaacagagaggttgagggaacgaacaagagactattataggaactgaagtgagaaatgactcacgcaagactcaagagtgtgaccatggagccaaccacattgttacacatccctgaaatattaaacaaatgaaacctacaagctttggagattgcttcacaaaaattgctggctggtggctgccagaaatcccagggcaccaagaaacaggagcagggagcagggatgacttaaaatacagttcaacccaggtgggtcagaggagatcacagcttcaggagtcagatccaggtttctaagcccaaatgggccacccactatctataacctggcccctattcattcactcattcacccattcatttattcaacaaacctttactaaattcttgctctgtacagccccgtcgggcacacaggcgccacaaagacaagatgcagtgcttgtgttgagggagtatccagcctgctggaggaggtcaccacaacacagcgggatcagtgctcagaggaccagtctctgtaagtaggttcctctgggggtttagggatagcttttcacaaaaggtcatttctaagctgggttttgaaggatgaatataagtttgcaaagcaaacgaggtggtaaaggcaagtcaggcagagggaacagcacatgcaaaggcacagaggcatgagaggtgatggatagtttgggggaaatggatgtgtgcagagcatcaggactggagcacaggattcacataagggactgtaggaggcagggattgaaaaggcagacaagaactagaccgtgctgggccataaatgccaggttaaaatgccctgtgtatgtttgagagccatgcaaaggttttcagcaggggcctgatgtaactggattttcattttagaaagataatttgaaattcagcataggaaacacttttctttcctttttagcaaagtatacaacacgcacacagaaaactgcatatatcctaagcatgcagcttggtgaacttcctttaaactgaacatatacacataattagcactcagatcaagaaacataatgctgccagctgccaagccctccgcaagttccctttcagttacaccttctctgcaagggcaaccgctgacccaacttctaacaatacagatagggcttctgcattttccggttttgcaggaatgcaatcatatggaatgtattcttttgaatgcagcttcttttacctaacatccatgttgtgagcagtcatatttgtttttttcttttctttttcttttagaaacagagtctcactatgtcatccagcctggattgcagcatgattacagctcactgcaacctctacctcctgggctcaagtgatcctcctgcctcaacctcacaagtagctgggagtacaggtgcgtgccaccacactgggctaatttataaatttttcatagagatggggtcttgctgttttgcccagcctggtctcaaatttctggcttcaagcgatcttcccaccttggcctcccaaagcactaggattacaggtatgagccaccatgcctggctgtacattgttcattttcgttgctctatagttttccattaggtgtgttgatgagcattgaggaatggattttaagcagcgcagactggagtctgggaggccaactgagagattattgtcatggcaggagagatgtgatgagaagcagaaaggggctgtggcagtggagatagagaagacgcaccaatgcaaaaggtatttaggagataggctgggtgcaatggctcatacttgtaatcccagcactttgggaggccaaggtgggcagatcacttgaggtcaggagttcaaaacaagcctggccaacatggtgaaacctcatctctactaaaaatacaaaaattagccaggcatggtggtgcatgcctgtaatgccagctgctcggaaggctgaggcaggagaattgctggtacccaggaggcagaggctgcagtgaacagagattgcaccaccgcactccagcctaggtgacagagcaagactccatctcaaaaaaacaaagaaacaaagatatttatgaaacaaaagaaactgaacttgtcaaataattgaatttggaaagagttgaggatgaccttctggttcctggctttggaatcagagcagataatggtgaagacaggacaatggacaaagaagggtcaagtgttttctattgtggaccagctgagtttgcagtccctgggggcactcaggaggaagtgtccaggaggcagttggaggtggaatctagagctcaggagagagacctgggtttacaaagtcaaacctgggattgaacatggggctgaaccaaaggccactgctctctttcaataccgccaatcattacagttaaggaataagaaagtcataaatcctcagaacaaagaggatgtgacaagagataacaatagaaaaaaaagatggcagcaacattttaaaagctagaaatttcatgaatagttggttaatgacttagcagataggagaaggctggaagttgactacccgcatggaggaagccacagaggaaacttcagaaaatccttcaaatagaggaaccaggcccagctgagctccatactgaaaaccaagaattaagtgaaagtctacatgtgtgccactgagatacctcccaggccccccatttgattcccagaatgctgatggctgagtttattaatacactggagatgggagagttcctcttgcgggaaactgatcagtgcaagagaaaaagcctcgtgacagtgcgtatgggttcatcagatgaactttttgttttgtttcattttgtttttgagacagggttttgccctgtcacccaggctggagtgtggtggtacgatcctagctcactgcagccttgaactccccagctcaagcaatcctcccatttcagccttctgagtagctaggactgcaggtacacaccaccatgtccagttaattttatttttaaatttttcatagaaacaggggtctcactatgttacctgggctggtctggaactcctggcctcaagcaatcctcctgcctcagcctcccaaagtgctgggatcacagatgtgagccatcatgcctggcccaaatgaactttttggatgaggagtttatagctcagatgattgggaagtccattggccaatattctccccatctccactgtatcttgagcttcaaaatagtaagttcgcacctcactgttaaacgtgaacatcagatgtttaaggaaaacaatataaaagacagttgaaattaaaataagataggcaaaagaacttggaagaaacagagacattaaagggtagagaagcaaacttaaaaaaattaatatcattggagaaatatgagaagatattgtgtccataaaacaaaagcaggagactattaaaaaaaagaacattcctataacaagaaaaagctcttaaaattaaaagtatgactgtagaaatgttaaaagtagactggctgattgaaatataaaaattgaataaatatctgaggaataaataaaaaggcaaataaaaatgaaaatggaagattaaaaaaaagtgagaacagaaaataagatattaaaagcttccagagaggggaaaaaatcagatcacacaaaagaatcagaataacattgaaattttcaacaacactggagtctggaagacaagggagcagccaatccttcccaaattttgtgggaaaattatttccaacctaaaattttatacccagcaaaacatctagtcaagtgtgacagacaaataaaaacaacatgagacataaagggtctcaaccatgctgtctttctcaggaagttactggaggatatttttccccaaaatgaggaagtaatccagaaagaagactacctgggatccaggaagcagtggagccaacatgagagaggggaggaaatttcaaaataatggtaaaaagggcttccagaataacagccctagataatcattgagtcaaaatggggctgcaggtcaaaagactccataagagaagaggaaggaaggaaggaaggaaggaaggaaggaaggaaggaaggaaagaaggaaggaaggaagggaggaaggaaggacaggagggagggagggagagaagaaggaaaggaggaagtgttattataattagccagttgtctttgaagacattgagagaacatttacacatttgccaataatttgcaaaaaggatgaacagttttcttttgaagctagaaagtttaatgatagttggttaatctagaaaatttaatgatagttggttaatctggaaggtttcatgactgttaatagttatatatttttaaccagaaagttggccaaagtctgtgcacataaaacagttcttcaatctcagaagaggaagcaataatagaccatttagcagcctgatgccaaccaggttatagataaatattcaaatatttaggtcactttgggagaaataaagatcctgacaatgaccagaggagaccttgacaagcaaattaatgagtctcacactcatgaccagaaatccagccaggctggctccagctgccacccatccttgagacctatggtcaggtccgggtgtggtcacttaaattattgatcagcaaacattcactccaaacaccccacccattcctccatgtgagcagtatacttcttgccccattgatgttggacttggccatgggactggctgtggccaatgggatgttggtggatatgatccaaacaaggtttaaaatgtgcttgtgcagttggctccccatcttgcatttctgtcattaccatgaaaaaacctccaccaagcacctactatcccctctacctgaacagacacaagtggggcagattgagcccagcctatatcctggaaccaagccttccgacatgagctaaactcaagaaaacccacagacatgtgaggaaaaaaaaaaaaactgtgtgaatgccactgagttgtgtgaatgccactgggttgtgtgatagctcgttacataacattattgttggtcttactggccaatgcaccaggttttaagattatcctgtgggtcacagttatttggtaggagactcttgccctagtgaataaatgactgaggttttgagagacaaaggaacccttgaggaggaagacagggaagtaggagaaacttttctctgcatgttcagtatcaagttcacaacatcaactgggtgcggtggctcatgcctgtaatcccagcacattggtaggccaaggcggttggatcacctgaggtcaggaggtcgagatcagcctggctaacatgacaaaacccagtctctactaaaaatacaaaatagctggatgtggtggcacacgcctgcagtcccagctactcgggaggctgagtcacgagaatcacttgaacccaggaggtggagtttgcagtaagccaagatcacactactgcactccagcctgggtgacagagcaagactccaccaaaaaataaaaaataaaaaagttcataacatggaggcattgctgttgatctgcgtttgtacatttcatcttaagttgctcaggcatctttgatcactttcttcttctctgcctggcacaatctactgtgcagacctttgttatactgcttatactgtcttgccagtggtactccagtgctgggctaggacttggagacccagaggtaaatgagaaattatgctacccatcgaaggtcttgggcttgtaagggacagagagatgtgcacaagtcactgttattcagctacaatacaatacagaacactcaagtgcagttcagctagacagcctggtttaaacacatgtcaatatacgtgatagtccatgttgcactgctataaatacctgaggctgcgtaatttacaaagaagaggtttatttggctcacaattctgcaggctgtataagcatggcgccagcatctgcttggcttctggtgaggcttcaggaagcttttactcatggtggaagatgtagaggaagcaggcatgtcacatggcaagagagagagtgagaaagagaggagaggaggtgctaggctcttttaaataacaagctccagtgtgaactaatacggtgagaattcacgcattaccaaggggacggcaccaagtcattcacgagggatccacctccatgactcaaacacttcccactgggccccacctccagcattgaaggtcacatttcaaaatgagatgtagaggggacacacattcaaactatatcagtcacaggccaggcacggtggctcactcctgtaatcccagcactttgggaggctgaggtgggcaggcccacctgaggtcaggagttcgagaccagcctgaccaaattggtgaaaccctgtctctactaaaaatacaaaaattagccagctatggtggtaggtgcctgtaatcccagctagtcggaaggctgaggtaggagaattgcttgaacctgggaggtggaggttgcagtgagccgagatcatgccactgcactccagcctgggcaacaagagacaagagtgagactccatctaaaaaaaaaaaaaaaagaaaagaaaactatatcagtcatcatgcgatagaatatcctacacctgtttcaagataaggacaagttctatgtactgacatgaatagcaaaccatgattttatatatcaaatatatgtatgtacatacgtgtgtgtatgtatacatttttttcaagaactgataaaccaaaccattcatattaaatacccaagggtgggtttataagagactttcatctgtaatttacgcacttggggctatcaaaacttctttttcttttttttgagacagagtcttgctctgttgcccaggctggagtgcagtggcatgatctcggctcactgtaacctccacctcccggttcaagccattctcctgcctcagcctcccaagtagctgggattacaggtgcatgccaccatgcccagttaatttttgtatatttagtagagacaggatttcaccatgttggccaggctggtctcaaattcctgacctcaggtgatctgcccgccttgtactcccaaagtgctgggattacaggcatgagccactgcacccggccacggttgttaaaatttctataacaagtgtgtataatcgtgatactgtgatataacaaaaaacatatatttggtctcatggttcctggcaaacagctgctaaaacccttgaaacctctggagtgatgagagtgtcttacgtgtgctaatgaactggctgttgattggggtttcctaggtagcttcaggataggggttcacttgaccaggtgcagtggctcatgcctgtaatcccaacactttgggaggccaacgtgggaggatcgtttgagtccaggagtttgagaccagcctgggcaacatgacgaaaccccatctctactaataatacaaaaaaaaaaaaaaattagccgggcatggtggcgtgcgcctgtaatcccagctactcgggaggctgaggcaggagaatcgcttgaacctgggaggcagaggttgcagtgagccaagatcacaccactgcactccagcctgggcaacagagtgaaactgtgtcaagaaaagaagagaagagaggagacgagacaagacgggaagggagggggagggaaggggaggggagggaaggggagggaagggaaggggaaagagagaaagggcagaagggcaaaagggaggacgggagaaaggaagaaagaaagaaaaaatgaccatttgggcaccaagcgtggggcatggtagtgcgcacctgtagtcccagctactcggagcctaaggcagaaggattgcttgagcccaagagttcaaggcggcagtgagctacgatcgcaccactgcactacagattgggcaacagagcaagaccccatctcaaaatataaaatacagatcattcaggtaccaagcaaatcagggagcaagaatgaaaggaggtaaccacttacaagattgtggcaggaatccggataaaaaatggttgtggcttaggctagcataaaacaaaaaagacatttcccatgtaaaacacaaaactagaatagtcaggcaaacgaagaaaaatgtgtgatgctatggtaagaaactgatgatggacaaatattttgccaggagggagagggtaggtgagcaggggacaagagggtattggagaaaatgggaatggggaagtggcatttgagaagggcctggaaatcttgaaatcatgcctgcggtttgccaggtgggaggagctggaggcaggaaggaaagcactcaccggacctcagctgataaagggagtacagatatcccccaggctcagaagccctaagcttttcagcaggagaaccagacatttaagagccagactgttcaggttcaaatcccagttcccccattttccagccgtgtggttgctctgtacctcagtttcctcacctgtaaaatggggattacaggagccaacgtgtgccaagttctcagcatagcacctggcacacagtaactaccgtatgaaagccagttagtgccagtgtcgcgattatcgtatgtggcagaccagaaagatgccaggagggatgtcccagagggagccagtgcgggagccataacatagggaaagagtattccttgggagaacacagctgagtgtggacatccaaccccgcacacttgttcccagtgcggctgggaacaagtccctcgtctctctgccctcagattcctctgtgaaatggagaagctgagtgtggtggggagaaaatggatgggtctgagggtgccacgttactgcgggtgtctactggaagggctgggcccgtatacatggggggaggccacacgggctgccttggaccaaaccctgccaacctcaagcgagagctacagtgtttgagagacagcgagtacgtgaaaatcattcagcacctcagtggcaaagccagcccactcagcctccttgtaaacatttttatatacacagccagaaggttctcggtgtggctgccaagccctaaaagtaaaatcacaaggccagtaaaacacaaagatacaacctctttggggttcttgtaaaagaagcaaaataaaggcctgataccttctggaggggcacaggccacccacctgccactgtacacagacacacacacacacacgtactcaaattcacacacgcactcacatgggcacacaacccgtatgtgctcaccctagaacacacctgtgcttatgcacacatggcacctgcacttacatgtgcacgcatgtgtacacgcctccatgcccacgttcacacatgctcacccagctcatccacaggcatgcatgcgtgcacacacatagcagcagccactcatgcacatgcacactcacccttacccgggacacacgcacacatgcatgtgcacatacacaggccctgctttctggaagccagatttggagcaaagttgacccaggagctccaaggccttgggaattatgggatgcacatcccagaggactgcacatcccagagggctgcacatcccagaaggctgcagacagtggagaggtgtgaagcgcaggcctggatttcacccagctctgcctctcatgaggtgtgagacctaagtgacttcatctctctaagccttggtttcttcatctgtcaggtgggagtgagaatgacagccccttcctcaaggggttgtggggaggtttctcagttgatgcttgcgacgtgcttggcactgtatccggcacatagtaactgttcaacaaatatcagccatgcagtggtcatattattgtgtttcccagtgatctcaatttggaagctgtggcttgagccgcccagccaaatgttttggagatggtcacatgtagcaattaaacagaacacagccatggggacatcaaagaaatggaggaggcggtcctgactgccaagaggctgctggggggtagggagtccttgtcgctttctgggaactgagggcccggtgggttccctgtctcttgcccctcaacttcaccagctgccacttgactggagcgctccaaaaagacagtgtctgcaaaacagaatgtcaccagcttccaggacacatggtgcccttctgcctcagtttcccctcccctgactcccaagcccagagccctctcttaatctccaggctatctgaagagacatgcatacctgtttcactcttggcagcctatctcctgggtggcagagggtaggcaggtggggaggcagccacactcccccgtgtccctgtggcaggctctcctcctgtgtccattctcttgttcttccataataacaaaactcctgactttcagctaggcacagcattgcccaggataaagaccacatttcccagcctcccttctagctgggtgtgaccatgtgactagttctggtcaaggagatatatgcaggtgttgtgggataacttctgggaaccttagagtttgcccttcctgcatcctgctgcctggaatgcagatgtaatagctggtgctctggcagccatcttagaccatgaagaaaaacacagtgggacaacagagagagtggcaggggccaggatcctgaggactttgtggagcagagccaccttagattgtctactttcaaacttttataaaggagataaatttctccattgaaattagttccttagggtcactattacttgcaactaaacctaatcctgactgctatcccctgactcaagctgtgccctgctcctgataatccagtcactgccttgcacacctctggacatctctgtgggctcagagcctctgctgtcgggctctgaacaccagtgagccctctctggatggtggcatccaatcagactggccctccccacacctgtgagatgacaaaggccaggcacctggcttccctcccccaaggtcaaatcctacagctggaggcaaaccccaacaccagtcttgcctgaaccaaacgtccacacccccatcatccctcccacagtcccagcatgcactggacagaatggaagggtgatgaccctcaggactactctgtcagacagggagggcagacagtccccatccaccagcctctcccactccactgagagctcaagaaactcagggctttgcaacagggtgtctggctcccagggccctgttgcccagggatgctgaagaagatgctatcacagggctttggggagccaccaaggtaggaaagatgtccccagagagagcagagctgccacagctcagctggggtcacactcacctttctccgatgccggggccaggtcaatgaagctgcgacatttttcacctttgaaaagaagagaagcgttttcagaatgtgagaggacacgtgggcttccgaggtttgcctgctcccatcccatgagccctggagcaagccagtgtctctgacccaagcccagtgacatctttctccaaccctggttcctagaagcccaacatcccaggagtgtggatggcgaaactgccaattctcccacctcctgaccccatccatcctggcccatcgcttccacctccacgatagcaaccttgtccctttccacagcctccccccagaatccacgctcctcctcactggcctccccaggcctccactctggcccctctccaattcattctccacgctgcagctggagggatcatttcaaaacacagctctgatcacatccaacacacgcacacacacagcttgctcctgtttgaaactctttgatgacttcccaaaggagaaagttcaaattcccatttgtggacccagaacaggccttgactggcctgtccacccactgccctctccctctgcccccgttcctggtacacccctgtgcagcctcccaccatggctttgcacatgctgttccccgcctggaacatgctcccgctgttgtaactctcacagcaccttggatttctatggggcatggccaccatcctgagtctgcctttgcatgtgtgagtctcaggtgcaagttagtggcactgagatgataagtcactgaaagagagtgtactgaccgccaagaactggaagggaggatttaaaagaaagaaaacaaaagtggtgtgctacagtggatggattttgaatgaattgctttatactttttttaatgttacattgtttcctcaaaggctagagggagggaaattcaacatacagatcatactttgggaggccgaggcgggcggatcatgaggtcaagagatggagaccatcctggcaaacatggtgaaaccccatctctactaaaaatacaaaaactagctgggcgtagtggcatgcacctgtagtcccagctactcgggaggctgaggcaggagaattgcttgaacctgggaggcagaggtgagccaagatcacaccactgcactccagcctgggcgacagagagggactctgtctcaaaaaaaaaaaaaaaatgtgcatatcagcatccacagccacattgaggcattggtgggccttcggccattttgccttgatgagccccttcctaaataaaaattaattaaataattaattgttgtatttatcaatcgtggatagcacaattgtatttatcaattgtggatagcagcactatccaagatttggaagcatcctaaccatcaacagatgaatggataaagaaaatgtgctacatatacacaatgaagtactcttcagccataaaaaagaatgagatgctgtcatttgcaaccacatggatggaatcggaagtcattatgttaagtgaaataagccaggcacagaaagacaaactttgcatgttcttacttatttgtgggatctaaaaaacaaataaattgaattcatggacatagagagtagaaggatggttaccagaggctgggaagggtagtaggggattgggcggggagcagtggggatgcttaacaggtacaaaaaatagttagaaagaatgaataagacctactatttgctagcacaacagggtgactgtagtcaataataacttaactgtatatttttaaatgacaaaaagagtataattgaattgtttgcctgtgtcaaaacatctcatgtaccccataaatatatacacctactatgtacccacaaaaattaaatattttaatttgttttattttatttgagacaaagtctcactctgtcgcccaggctggagtacagtggtgcaatctcggctcactgcaacctccacctcctgggttgaagcaattctcctgcctcagcctcccgagtagctggaattacaggcacccaccatcacgcccagccaatttttgtatttttagtaaagatgggatttctccatgttgtccaggctggtctcgaactcctgacctcaagtgatctgcctcagcctcccaaaatgctgggattacaggcatgagccactgcacccagccaaaaatttttaatttaaataaaatttaatttaattaaatttttaagtaattttaaaattatgttttacagtcacattggtatagagactaatatacaatattactattaagtattaaacattttcttcacctaaaagtttctttttcttcttctgaactttctacttcttccagaccctttcttacaaatagaagaagctcactccggactctgcttacacacacattaatgtctatttcccccagcaagctgcaagctctgtgaggacagggaccaagtcttcactgcatccccagctagtaaatggcacctccatccccagatgctcaggccaaaaccctgctgccatctttatctcattcgtggctctagcttcccaatgcgtctagcatccagccacttctcgccacctccgctggtccagccaccatcagttcccaccaggatcactgtagtagcctctgcactggtctctctctttctgccccatcctcacagtgaccagaagtatcctggtataacctaaaacagattatgtcccttctctgctcagaaccctcccagcattcccaactcaccccaagtcagagcctaagtcctcgctgtggcctgcaagaccctctgtgatctgtctctccatcacctccctgacctctttccctcctgtcttcccccttgctcactccactcctgtcattttggtctccttgccaatctttaaacgtgccgggcattctcctgcctcagggccttcgcactggctgcctctgctgcctgcagcactgttcactcgcatacctgagtagtttactcctcctctcccttgtcatttttctcaaatgttatcttcccaaggaggcctttccatttaatctatctaaaattccaaatgtccctcccctgacactctccatcttccttctggatggattcctaacagctacaacagaacctggtgtgtacagtgactgcttaataaatattttcccaccagcctgagcaagaaagcgagaccccatttctacaaaaaaatttaaaaattagccagctgtggtggcacggggctgtagtcccagctactggggaggctgaggcaggagtatcacttcagcccaggatgttgaggctgcagtaagctgtactccagcctgggcaacagagcaagaccccatctaggaaaaaggaaacaaacaaacaatattgaaggaatatatgaacaaatgagcaagagaatgaatacacgagcaaatgaatgaataaatgaatgaatgccactgaaaccttatgtctacaagaagcttcccctcttcagtctttcctcccaggcctccctgatgccacggacacagacctggccaccaaggatgcagcactgagcaaatcatggcccaacttctagacctttctaacaaagagagggggcgcacgctggacctatgctcacaaacacattttgtttgacccacacgggatcataaaaataggtaaattgctacctacaaattcagatttgtaattttctcttaaagaatcagaagatccagctgtgctgagcccacaatcccacacagcaacaatcacatggggccaggcagctgtgcctcctttagataaggcacctgaaagctctctggtttgccacagtccccaccgcccactactgctctgcccccagcttcacctaaaccactgagatggcccctgcgacactagactggataaactctagggtgagtttgcaacccctggcttcaggatgttactgctggtcccaacaaagagacagattgggtcaaaagggaccaatgtgggtagaagagtcaaaacgatctagaagctttcggcattctcaactaatttgtctgcttagagcttcctaagttctctgataaggtctcttgaagcccctttggcctcctgaacctcctgccagccccatatcaatgcaaaggcagagatggaggcagcggtgggagatgagtctgagaaggaaggaaggggtcagatcacaaagggtcttaaatgtcaagccaaggaggtgcttcctctcttatttatgtcactccttccaaagaatcacacggccacagatgggtgaaccctgctctgtggttccagcattctggcttcccctgcccccgccttgtgctccgtactgagatgcaggactcacaccttccattacagacaaagacgataaggcccagggcagctgagggaccatcctgggccacacagcacattagaggtgctgatattttagcccactgaaagagatgtttgctgacagccaagaactagaaggaaggattaaaattaaaaagtgttggtcaggcacggtggctcatgcctataatctcagcactttcggaggatcacttgagcccaggagttcgagaccagcctggccaacacggagaaaccccatctctgataaaaatacaaaaattcgctgggtgtgttggcatatgcctgtaatcccagctacttgggaggctgaggcaggagaatcgcttgaatatggtaggtggaggttgcagtgagcagagatcgcaccactgcagtccaacctaggtgacagggtgagactccatctcaaaaaaatataatataatataatataaagtgttgtgctggagtggatggattttgagtgaattgttttaaactttctgtactgttatattgctggaatggaggagatgtaatggccaaattcagaccaacacccgaggccacattaaaatgttggtgggccttgcacatttttgcctattaggggcccttcttaaacttcaaaacataataataagaattctattttacaaccacattggcaaaaagatgaatatattaagtattaagcattttttcacctaaaagtttatatcttcttctgattttaaaataaattaatttttttctttttttgtttatttgtttttatttttagagataaggtcttgccctgttgcccaggctggagtgcaatggctcaatcatagctcactgcagccttgaactcctgggttcaagtgatcctcctgcctcagcctcctgagtagctgagaccacaggcacataccaccacatctggctagttttttttattttttgtagagatgggatctcactctgtcacccaggctggtctcaaactcctgagctcacgcaattctcctgcatcaacctcccaaagtgctgggattagaagcgtgatctaccacgcccggccctaaaacattttcatgggcccgtagaattttcatggccctaaaacattttcacaggcccaagacctttatagaagtattctgggccctccgctctgtgcctcctgagcctaagaaagatgcccgccctcctgcagcaggctcccagctctcaccaccaactgggcacctcaataatatttaagatctatgtgctaggcattttcccttttctttaacaattttattgagatataattcccatgctatacaattcatacatttaaagtatgcaatttggctgggcatggctgctcacacctgtaatcccaacattttgggaggccaaggcaggcggatcacttgagatcaggagttcgagacaagcctggccaacatggtgaaatcccttctctactaaaaatacaaaaattagctgggcatagtggcacctgcctgtaatcccagctactcaggaggctgaggcaggaggaccacttgaacccaggaggcggaggttgcaatgagctgagatcgccccactgcacttcagcctgggcgacagagtgagactcagtctcaaaataaataaataatataaataaataaataaaataaagtgtacaattcaatggtttttagtatactgttagcatattcaccaggctgtgtgaccatcaccacaatcaattttaaaacgttttcatcacactgaaaagaaagctgtacctattagcagtcactcatttcctgcaacccttccagccctaggaaagagctcatctattttctgtctctatagattcacctagtctggtcatttcatgtaaatggaatcttacaatattgtatgattcatatagatggaattatagaatacactcaatatgatcagacaagacatgaaatgccatttcatataaatggaattatataatcatacaatacaatcatataataatgttttgtgactaccttctttcacttagaataatgtgtttaaggaccaaccatctttgtagcctatgttatttatatcacagaataatattacatgatgtggatataccaccttttatttatccattcatcagataatagatacttgaatttgtttccacattttggttatttatgaacgttcatgtacaagtttttgtgtggacaagtttttgtttctcttgggtatatacccaggaatagaattgctgagtcatatgtaactctatatttaacattttgagaaattgcgacacttttttccaaagcagatgcatcattctatgttcccatcagcaacatatgaggattccaatttctccatgtcttcagcaacacttgctattgttcgtctttttttattataagcatccttgccagtgccatgcggtatctcactgtggttttaatttgcattttcttaatgactaatgatgttgagcatcttttcatgggcttattgcccatttctatatcttctttggagaaatatcttctcagaccctttgcccactttttaattgtgtcatttgtccttttattatgggtgattagttctttatatattctgcatacaagtcccttatcagttatctgatttgtaaatattttctctcattgtgtggcttgtctttccactttcttgatgacatcctttgaagcagaaaagtttttaattttaatgatgcccaatttgtctatttttcttttgttgcttgtgcttttgttgtcatatcttctttgttattaatttaaaaatagaggctgggtatggtggctcacgcctgtaatcccaacactttgggaggccgaggcaggtggatcacttaaggtcaggagttcaagacaagcctggccaacatggtgaaatcccatctctactaaaaatacaaaaagtagccaggcatggtggtgcacccctgtaatcccagctacttgggaggctgaggcaggagaatcgcttgaacccaggaggcagaggttgcagtgagccaagaccacgccattgcactccagcctgggcaacagagtgagactccatctaaaaaaagaaaaatagagatggggtctcactatgttgcccaggctagtcttgaactcttgggctcaagtgatcctcctgcctcagcctcccaaagtgctgggattacaggcataagccactacacctagactagtgttatacctaagaagggtgtgcctagcccaagatcatgaagagttactcctattctttcccctaagacttttgtaattttaactcttctatttatgtctcttatccatttagagatgatttatgtgtatggtgtataaaaggggtccagctttattcttttgcatgtggatatccggttgtctcagaagcatttgttgaaaaactattctttctccactgaattgtcttggcacacttgccaaaaattaattgactataagtaaaagcgtttattttatactctcagttctattccattaatttatatgtctctccttatactacactatcttgattactgtagctttgaagttttgaaattggaaaatgtgggttcttcaactttggccttcattttaaagatcattttgtctattctgggtctcttgcattttcatatgaattttaggatcaatgtgtgaatttctttaaaaaagcaagttggaattttgaaagggattgcactgaatctgtaatgggaccaatttgggaagtattgccgtcttaaaatattaaaacttcaaatccatgaacatgggatgtttttccatttacttagatctattcaaatttcttttaacaatgttttgtagttttcagaatataggtttcatgcttattttgttaaatttattcctaagtattttataatttttgatgctattatgaatggaattgttttctaaatttcattttggattgttcattgccagtgtatagaaatataattaaattttgtatattgatcttgtaaactgcaatcttgctgaactcatttattagttctaacagttttagtggattcttagaacttgctatatacagactcatatcatctgcaaatagagatagttttacttcttcatttccaatcttgatctcttttatttctttttcttgcctaattgctttggctaaaatgtccaatataatattaaatagaagtggtaagagtggacatcctcatcttgttcctgatcttggaggggatgcattcatttttgtaccataaaatttgttgttagctgtggggtttttttaatatatgccctctgtcaggttggggaagttcccttctattcctactttgttgagcagttttatcatgaaaggatatttgccgtctctttagtcccacaacaaacttcaatgagaatctccactttcaagacaagcaaagtgagggtctgaactttcggtgacttgcctaagaccacacagccagtaagaaatggagcaagactcaacccaggtctgcagactccacaccacatcctaaaatcttcccagctctctgctcccattgctatgtcagaatttcctaccagaaccagatgttcccaccatggacagctgggggtgtcctgaaagaaatctcctaggaatatacctccatagagacagggaaaatccaagaggggccaaaataaatggctctcacacttccatttctgctacatggacaaggctaaacagaagatgtttaagcagaggtgatcaaacttagcccacactgcccaggcaggtcaacgctgaggtttaaggaaaagtcatagagatgacatgaggaacacaggatacttcaatggccagaagtctaacagctgaaattcaaacacagaagagatgtttttcctccaaatccttagtctctgtgataaagattatctaaggattaatgagctaggtattaaatggcaccatattggcttgccgcttttagaagtgacccataaaatatcaaaatcaatggcaattaagtttatatgtttagttaagggatttattttgggcattaaaccttaagacaggtgcacttgtctctcaatcacacttcagactggggcttgacaattagatcacagagctgtggcatgttactgccacctgatggcagcatacctttggtgaaccatggaacttgaaagctgagaagaatcctattaggtcaatcaatttacgtgattcttaaccccggaaatgtgaatcccaggccccacccacaacgattctgatttcattggtcagggtggagcccatatatcttagcgttttaaaagctcccaggtgattccaatgtacactcagggtgagaatcacagcctattaaaaatatccttccaacattagaaaaacaacagagagtcattttagtgatggctcatgtgatggcaccggccgatccttcagggaagggcatttatggggcagaatagttcagtggtcaggggtctgacttctggaatcagcagagctgagtgcaaatgctggctctgtcacttcctgccatgtgagtcctcccatctttctgtgcctttatttccttgttggcgaaatgggcacagcacctgtaggggtcttgtgaagactcaacatgggcaaagagcttagatgcaatgcctggaaaaaagtaagtgcttagggccaggtgcggtggctcatgcctgtaatcccagcactttgggaagctgaggcaggcagatcacctgaggtcaggatttcaagaccagcctgtccagcatggtgaaaccccgtctctactgaaaatacaaaaattacccgggcgtggttgtgcacacctgtaatcccagctactcaggaggcaggagaatcacttgaaccccggaggtggaggttgcagtgagctgagattttgacactgcactccagcctgggcaataaagaccccatcacaaaaaaaaaaaaaaaaaaaaaaaaaaaaagagtgtgtgcttaggagatggctttcgttgtcatcactgtcacctacatgcgggtcagaggaaacatgagacacggtcttctgcagcctaattgggggaaacaagagtgacatgcaggtaccatcacagactagcacatggccagggggtcacgcactggttcagtgcagggattctagagccaggcctgcctgggtgcagcctggctccatcactcactgcacgtgtaacatcaatatgaaccttttggtgcctcagtttccctacctataaaaacatgaagatcaccaacgctggtgtttctacagtgcatattatagggtaggtcggcagggcttgttgtcaaccaccagggggtacagctgggacaactcagtgggcggcagtccaggttgcctgaggctgctgcagacatgctctgggctccttcgtgggccccagcctgggtcctggccctgcgccttccattgtctcctccatgcccatcaatgttgcctgggaacggcctcatttttgccccttgaagatgccctttctcccattaccccctccccatctgattccctttgagctgctaagatagcaaaggtgaatggagctggcatctcctgccctaggaaggagactccttaaaggccccttgtattcccagaggcccactggagggtgatgtcttcctgcttcagggaggggacagcagagggaattcatgcagaaagaaaggggggccatcagattccaagaggagaagatgtttggggatccacagcaccctaaaagatgtcagggccttcaaagaaaaacgtcacgggaaagctggactttggggtcataggttattagctcagccaaaatcttgcacccagtgagggtcccatggtgcccatgaggccagaaaaccaccagctgtggggagaggaagggtaggggaagaccagagcgttctctcaaatggcctgaaaacttcatacgacccaggggctgaaaggaaatctcaaaaactggagattgaatttcttgctattctggggagtggaagctcagagttctatcctactgggtctacaggaataaatgactagggcattccttggctagaagaagtgagagtgcctgttcatacccaccatagccttaaagagaaatgccatgtgtgactgccctcaccatcacacaccattgcatcttgcttgcaggccaggggcacacagacaggacttaaatctcagcctcaactcaaggtcaccaactcaagccttctcaatgaccagcaatgactgaggcgagcctgtggggactgggtgaccgtgagagggtgtgccctgtctagatggggatgaactgacatgctggtcatctggacagtcagggtctctgcaggaaacagatggtacctccgaggggctcactgaagaccgacgagtgaagaaattatgtataggggtgtggacagggttgaggggctggtaaccaagggaaacccaggtctgaaggggcaggggagggaaaggagcctggaagaggtgaagccatagaggaggagctgccatcaggagctgaattcacacttaacaagcctcagaatcagaacttaagcatctctgggccgggacttgagaatcggtctttccaacatgttcccagaggatgctgatgctgccggcctgggaaccacactttgagagccactccttagagaaatgtagtcactgtcaaaaccgcaacagggagagaacaagatgagccagaaaggaatgccctgatctttctctccttctgccctcttgattccctgtaggtgcctcctgttggccaaaaccaatgggcacagagtccaggcagttcccagggcaccgagaagggcagggaatggacatggaggggtggatggagaacagctggcacaccgccctacttaaggtggtccccacccctcctcaccgcatcatgcttattcctgcacctgcgttgcttttcttccatagtgagaccaccatcacgctctgaaattgtcctgtgtatggatttgtcaacttgtttagtacacgtgtcctctacaggacgtgcaggggacttttcctctgctttcggatctatttacgtgtagtcctgtgtgcactgtgggcttaaccactttctagactaggctggaggctgcgtaccctgaaatcctgagaattcatattctatctctctatcttaggcatcaaaatcacaacatcaagtagtgatatctgaaggtgtctgaattaatctcaatccccaaaagtacacttctcttctcttaagttcccaatgtcaacgttttatattcacacagttgtatcccatcaacatttattgagcacctactatgtgccagtcctggttttaggtgctggagacacagcagcgaaccacacagacaaaatccctgccctcacggaacttccattctcatgttaaagtgtacatatcagtaattctttggaatcctctctccaaaaaatgatgtttcctggctcttctaaataacacccagacaggccaggcgtggtggctcacgcctgtaatctcagcacttttggaggctgaggtgggcagatcacctgaggtcaggcgttcgagaccagcctggccaatgtggtgaaaccctgtctctacataaaatacaaaaattagccaggcccagtggtgcacgcctgtaatcccggctactcaggaggctgaggcaggagaatcgcttgaacccaggaggtggaggttgcagtgagccaagattgagccattgcactccagcctgggcaataagagcaaaactccatctcaataataataataataatgcccagacaatgtctctgcaacacggaggccacatgttttcagcaacaaatagaaacttcgtgaccatgtatgtcttgttcgctgttgtgtcctcaaagcctggagcagtgatcagtgctgcagacatgattgtggaatgaagcaattaatagtacttcataaatcgtctttctcaagaatctcacaagagcggggacctactctgcagaatccagaatgtatggccacagtgagacagaaattgaatcttgggagcaatctaagacagaagagacaaacagaaagggatatctacactagccaagaaagagctgagggctccaacagcagacattgggcagccacattgagccttacacctgccacgaggcagcagacttaagatcgggaggtcaccttagccatcacgtctgcattctcagccttttcccatggctgggtctctgttcttgctactgccttaatctcaacatctctctctctgtttctctaagtctgaaccatccccagccttcaagatccagctcaaatgtccaccccactctcccgtcatgaagcctgtcttgttcaccaaccactcgctccatccagaagcaacatttctccactctaaatttcccaagggttttattgcaatatcactcatcgtattgtcacgtgctaccctgagcgtggcttggcccctctgctaagcccctttggaaggcagatcccaccccaggctcgagtttgtcatgttgccttagagccaggatcccacaacccggaagagagtccagaacaagccccacgcaaaggacttggcgttcatcacagcaatggcacgaagtctgaatccattcccattttacagatgagaaaactaaggctcacagaggcagagtgacctacccaaggtgacacagccactatgtggcagaatcaggatctggacttaagtccttatctgtccaaggctctgttatcatgcaggggactgacttggtcagaaacggaacaagacaggacaggcgcggtagctcattcgtgtaatcccagcactttgggaggccaaggcaggtggatcacttgaggtcaggagtttgagaccaacatggtcaaaccctgtctctactaaaaatacaaaaaatagctgggcgtggcagtgtgcacctgtagtcgaggctgaggcacaagaatcgctgaaacctgggaggcggaggttgcagtgagccaagatcgtgccactgcactccagcctgggctacggagtgacaccctgcctcaaaaaaaaaaaaaaaaaaaaaaaaaaagggcaaggacacattccagaaggcattctatggccagaccaggtatctctaaaatctttttttaaacattttatttattatgggaaatttccatcttttgcaaaagtagagagactagtacaaaaagccccatgtccccatcaccagcttcaatacctgtcaactcaaggccagtcttgtcacctctacaccccactgtccccaccaccatgagattattttgaaacaaattccagaattggacctagatatgtttttcaggggtgtgtccaccgttcagaaaagacaaatggaaggtcatttcttcctagaccttgtggcatcaccttatggggcagctggattttgcagcatgagaatcaaacagaaaattcaggaggccctgacctcccctcaccgctagcccctctgagttactgtctccaggggctctggctgagcgaggatggatgggggcatcactcagaaattgccctcagtgcagcagcttgagcttgtcagcaggcacatcgagactgccatgaaacggagagcctggcacgggccctcagcagaaatgagtcttccaggaatccaccacagatagaactggccgggtcacagctgcctcactctggctcaccactcaggcctgattccaggaattccacccccagatctcctcctgtaggtctggtttaattgagaaagaagctcctgtgtgaaggcagcaaggagagccatggggtgcaccagggtcaccaggaagccggacagggtgtgctccctggttaaaagctgggctctggcttcccgcagacctgaattcaaatccccactgtgccagctgggcgcagtggctcacgcctgtaatcccagcactttgggaagccaaggtgggcggatcacgaggtcaggagttcgagaccagcctggccaacatagcaaaaccccatctccactaaaaatacaaaaattagccaggcgtggtggcacacacctgtaatcccagctactcaggaagctgaggcagaagaattgcttgaacctgggaggcggaggttgcagtgagcagagatctcgccactgcactccagcctgggtgacagagcaagactccatctcaaaaaaaaaaaaaaaaaatcaaatccccactgtgccacctgctagctgtgggactgggagtaaataatggtttttttttttaaatatatatatttgtttggttgggttcttttttgtagttgtttgctattaaggttgaccattccaatcttctggggttgctgggaaggctaaataaggtcattggcataaaacaagacatcttcagttaggatttaattcagacaacatctgcaaaggaatcagctccatgttttgacacccacaccctcaatgtcattcatcacaggtctggaggcgccagcacaaggaggtgtctaggctcagaagccacaggacgtgagttcaaatccatcctctgcctcctcatagccaagtgatctcagggagtggcttcacctctctaagccctttccttgcttgccagacggaaatcagagcgccttccatccaggcttgcaaaaaggattcaaacaagccaggcatggtggctcatgcttgtagtcccagctactacagaggctgagacaggagactcacttgagcccagactagacaacatagcaagaatccatttttaaaaaagaaaaaaaggtcggacatgatagctcacgcctgtaatcccagcactttggaaggccgagacgggtggatcacctgaggtcaggagtttgagaccagcctggccaacataatgaaaccccatctctactaaaaatacaaaaattagcctggcgtggtggcaagtgcctgtagtcccagctactcgggaggctgaggcaggagaatcgcttgaacctgggaggtggaggttgcactgagccaccaagatcatgcccttgcactccagcctgggcgacagagtgagaatccatcaaaaaaaaaaaaaaagaaagaaggaaggaaggaagaaagaaaggaaggaagaaagggagatgggcaggagggaggggaaagaaagaaagaaagaaagagagagagagagagagaaagaaagaaggaaggaaggaaggaaggaaggaaggaaggaaggaaggaaagaaaaagaaagaaagaaaggaaagaaagaaagaaagaaggaaagaaagaaagaaaaagaaagaaaggaaagaaagaaagaaagaaaagaaagaaagagagagagagagagaaaggaaggaaggaaaagagaaagaaagaaaggaaagaaagaaacgaaggaaggaaggaaaagagagagagaattgaaatgggagaaagtgtgtgaaaatggctgccctgtgcttggctccataaataagagctttttaaaaattctttccctggatcctaagttagagacacatgtcactcctcccaaggagagcccgggcgtcttcccaagccagaagcaggaggctgtaattctgcaacttcagcctgagcaggtggggggaacctggcagggccacaggcaaaatcaaggggggtggccagaggcagatgcccaatgctggcagaaggtgtgcagagcattgagggtctgccaagttacccttggcatggacattgggcgcccaggtcctggttggcagcagagatgtgggcaacgagacagggggaaggggtcactaaggagcccagcatccttggctgaatccccagatcctgggtctgaagatcgtgacttaattccataccccaccagatggtgttgctgaggcttccatggagtcaggaggtggggagaggcggggaaggcagggtcaacagagagaggcagtagcaacagtttcacaaagtcaaccagccaataacacgtgctgacatgctttatgcgcctaccaacgtgtgttctaagtgctttacatgcatcaattgctaatctgcacgacagcctatgaggcagctcctatgaccacacccattttacagatgaagaaactgaggctggctgggcacggtggctcaggcctgtaatctcagcactctgggaggctgaggtgagcagatcatttgagcccagcagttcgagaccagcctggccaacatggtgaaaccctgactctactaaaaatacaaaattagccaggcacgatggcacatgcctgtaattccagctactctggaggctgaggcagaagaaccgcttgaacctgggaggcagaggttgcagtgagctgagatcacgcactgcactctagcctgggcaatagagtgagatgtcgtctcaaaaaccaaaaaccaaaaaacaaaaaaaaaaaaaaaagaaagaaagaaaaaaagaaactgaggcagagggagattgagtgaatcacttgtctaactttacacagctagtggtggagccaggattccaatcaagacagcttggcacagagcctttgatttggtcattcctctgtactacatcttagcagagcaggcaggtcctagtaaaattcattcctcctaaggaaagtcccacacaccctccagagaccccacacgtggcaggagaacctagcagccttccagacgtgcccagcgaagtggactcaaatctggctggttcaaagtttgaccctggttccgagacccagattccacaagcagcaaagctttttggcaggtgcatggtaaattttcttcatagttgagtgctttcaacttgctgggcgggcagagaagaatcagtcctggtccccagcaaatgaggccaatggggaatgattttaactggttggcaagggcaagagttcatacacctttgctggccagattcaaggaattcagctgggggaaaaaaatgccaacagatcttgtgtgaagcttctcctctcactatctgggctggcggcagagccttggcaagcacttccttggattctccggaggcctctgccagttcaactgacggggcagcagatggcacacacttctctgctgatgatattttgatttatttatctcttacagatggtaccatgccttgatttctggcaggagtccaaaatgcaggtcaactttctggggataatcgtttctacaaatggatgaaatactgaagactaaaaccccgcttggcatcatgactgctacaccgtggcctccagacatacgttgcttgggcatttggggcattttgtataaatcaagggaagaattttgttctcaagaatgttaaagctgaagaagctaaatgcttatctaaaattagaattatagtgattaaatgtaagagatttaaacttacagagtcctgaattcaagtctcagctctgccacatacaagctctgtgacccaggggtcagactctctgggtcttagtttccacatctgtaaaatggttataattgtcacctctaccacatcaggtatggcagaaacagctagctatctaccaaaagaagtgatcttctgtagtatggagttattgctaagaagtagctgccctggccaggcaccatggctcatgcctgtaatcccagcacgctgggaggctgaggagggaggatcacttgaggccaggaatttgagacaagtctgggcaacacagcaagagcttgtctctataaaaaacaaaaaatgagccaatgtggtgacacgcacctgtagccctagcaactcaaaaagctgtggtgggaggattacttgagcccaggagttcaaggctgcagtgagctatgattgtgccattgcactcagcccagccaggtacaatatttcccagcatcccccgcatcccagtggggtcatgtgagcagtgggtcacgtgactagttcctgccaatatgatgtgtgtgtgcgtgaagtgaggcaattcctggggagggcttttatgaaatgggtgtactctctctttcctcttccacctagatgcaaagggctctaaggctccatgaaatggaacaatttggaagttgcatagtcccctgggttagtctattttgcgttgctataaaggaatacctcagactgggtaatttatagagtatgaggtttatttggctcgtggctctgcaggccatataagcatggtatcagcatctgctctgcttctggtcaggcctcaggaagcttttactcatgttggaaggtgaagggggagtaggcgtatcacatggtgagagcaggagcaagagagaggagaggaccttccagtttctttaacaaccagatcttgcatgaactcattgtcgtgggcagggcaccaagtcattcataagggatccacgcccatgacccaaacacctcctaccagtccccacctccaacatgggggatcacatttcaacatgagatttgtaggggacaaattaccaaaccatatcatcccaaaacactatgtagagtagaactgccatccaccaggaccacctgtgctgacatgttacatgagcaggaaacaaacttctattgctagctgggcacagtggctcacacctgtaatcccagcactttgggaggacaaggcaggaggatcacttgagtccaggagtttcagaccagctgggacaacatgttgaaaccctgtttctactgaaaatacaaaaattagctgggcatggcggtgcatgcctgtagtcccagctactcaggagactaaggaaggaggatcacttgagcccaggagtttgaggctgcagtgagcccggatcatgtcactgcactccagcctgggtgacagagcaagactctgtctcaaaaaaataataataaaaataaaaattaataaaagaaaataaacttctactgttactccattgacatttcagggcttatttgttacagcagctagtgctgccctacacatagggtagctggagataaatgaggtaatacatgtgaggcacgtggtgcaggacaaggactcagtttcagggaagcttgataaattaaagaattgtgatttttgtaatgtcatcccatatgtttggtttggtttaaagcaaggcaaatattttccccttatctcagtcttatttctgccctttttctaaatatagagatggggtctcactatgttgcccaggctggtctcaaactcctaggctcaagcaatcctccctcctcagttaccctatctcattctccaagagcatgctttgaaagagaaatcaaaatggggggcagggatactggggagtttttttggaggcattctatggctgacactgtgagattgtggcccatgattatctgcatctcagcttgcaggaaaacagcctgttgcatggcaagagtgacaccatcttgaagtgaaattgccatgatgaacaatgtttgactcccgcagcaaggtctttaaacgacacctgtggcataaataacccctgatagagaaacaatgcccatagcatagataaccccttgtcaagatgcttatccaacatcctcagtggtcatgagttttgcaagaaagtctgaggtgtgaccagctacgcatggtttttatcctaaaagtttgctagagaaaggatattttttggaggtcggtgcgggaatccactgttgcatggccgcaagacaccacttctgtttgtaagcccttattaatgtttctctctgagaaacgggatttgtcagcctctttctttggcatctcagctcccttggaccttggaggtgggtttgcataggcctgctcactgcagaacatgtagcaatccagccaggagccgagagaccaagaaatgggcagagggaatgaagcatccatgggggacatcgcagggtagccagccacttctatgtggagtggtgtggctcatcttttggacacttttggcccatggcatgagtacaaggatgccccagaaatgtcaggatcactgcttctgtgggctgcccattgggtgacggaagcccagctagcaacagaagcaaaagtaaaatggcttgaggaggaattataattagaaagaagttttttttagagctctacagtcagaagtcagcttaattagaagctaatattcaggttataattttttttctagataggggaaggcctttatcctgtttctggcattttttttcagtcgactgaaacacctttttaaaaattacatttgatccctctgtttggtgtcttttctgttggtataatttttatttttttcctttcttttttttctttttttggagacagcatcttgctctgtcactcaggcttgagtgcagtggcacaatcatggcttactgcagcctcgacctcccaggatcaaagtatcctactgcttcagcctctggagtagctgggattacaggcgcgagccaccacgcccagctaatttttgtattttttgtagagatggggttttgccatgttgctcaggctggtctcgagctcctggcctcaagcagtcttcccgccccagcctcccaaagtgctggaattacagggatgagccctcatgcctggtcttgttggcatgatttttgctcttgctcttccatttccttccacttctgctcctcctgccttttgctatctttgaagccaaatgaatcaatctagaggagacttcctgtgcccctgagaccctgatagagtctggatgtttgtcccctctaaatctcatgttgaaatgtgacctccactgttgaaggtggggattgatggcaggtgtttgggtcatgggggcagattcctcatgaatggtttgctgccgtcctcatggtaatgagggagttcttggtctgttagttcactcgagagctggttgtttaaaaagagcctgcacctcctcctctctttctctagctctctctctcaccatgggacacactgccttccccttcaccatccgccatgattggaaacttcctgcagtctcagcagaagcagaagctaacacgatgctttccgctcagcctgcagaaccatgagccaaataaacctttcttctctataaattacccagtctcggccgggcacggtggctcatgcctgtaatctcagcactttgggaggccgaggtgggcagatcacctgaggtcgggagttcaagaccagcctgaccaacatggagaaactccatctctactaaaaaaaaaaatacaaagttagccaggcagaatcccagctacctgggaggctgaggcaggagaatcgcttgaactcaggaggcagaatttgcggtgagccaagatcgcaccattgcactccagcctgggcaacaagagtgaaactctgtctcaaaaaaaacattacccagtctcagttatttcattataacaacacagactaacacgactccttgaggaacacaggaaaaggtgccactcaccccctttttggggtcttctgccttccttgtggggttccaagagtcatgagaaggtttctctgtggtctaaaactctgctctcttttgcattgctttctcccatctttgaggcttttgggagtaccagggattacttagtactatgacagaatatgacctttgcgtgtgccatggctgacaagtcactgatgagggctgccattttgagggtggctgacagtgtttacaacgagagttattgccgcagggaggctactcctttctttgcatgtttagataagaaaagtgtgatctggccaggcgcaatggctcatgcctataatttcagcattttgggaggccaaggcaggcagatctcttgaggccaggagtttgagaccagcctggacaatatggggaaaccccatctctactgaaaatacaaaaattagctggacgtggtggtgtgcacctgtaatcccagctacttgggaggctgaggcaggagaatgagaatcacttaaactcgggaggtggaggctgcagtgagctgagatcacaccattgcactccagcctgagcgaccgagcgagactccgcctcaaaaaaaaaaaaaaaaagatagaaaagtgtgatttggatacctagaggctatggaaacacttgcgacaaagggataagactcctgcaggggatgggctgatcacaaagtgacttactggtgcggggttacccaccagcattggggagaatgtccttgcagtgaggtacactgtcctttgcactgtccgtggtgcttctttcttttgggggacccaggatccagtgtaaaagtgggaccttgatttggggagacctaagtgttctgccttccagctggacctgcttttcacatctgtaagtattaggccctggaaattgcaattccttcgttggtcctatttgttaatgggctccgccctgaactcagtggtccagttggtagatggagactaaattagaagctaaccatctaaaatgaaattggtctcagttcaggcacagtggctcacgcctgtaatcccagcactttgggaggccaaggcgggcagatcacctgaggtcaggagttcgagacccacctggccaacatggtgaaaccccgtctctactaaaaatacaaaaattagctgggcaaggtggcaggtgcctgtaatcccagctactcagcaggctgaggcagaagaattgcttgaacccgggaggcagaggttgcagtgacccaagatcgcaccactgcactccagcctgggcgacaagagtgaactccgtctcaaaaaaaaaaaaaaaaagtttttaaattgttcataaaataaaatagaaatgtcttcagaattatcagtattaaatataatgcagatattttcgcctgggtctatggtcagatgggtttaggctatctctgttggatgttttaaggtcataaaactgttgcttctgtctgtgaatttaagtcttggagccattcgattctagactctaagcaaatggccatggtgaggctgagggacatgtgtggaggtctccctgcccctgctgtgccccctggctgtgctgggaagggtcagacattatcttcacagctctgtcctctgccttgagctttatagttggtgtgttaactcgggacccagacaagccctgcctttcatagccatccctgggtgccacgtgggtacttgggacccagagtgactggggaagacgttagaaaggatacttgtgggctggtcgtggtggctcacgcctgtaatcccagcactttgggaggccgaggcgggcggatcacgaggtcaggaaatcgagaccatcttggccaacatggtgaaaccccgtctctactaaaatacaaaaaactagccgagcgtggtggcgcatgcctgtagtcccagctactcgggaggctgaggcaggggaatcacttgaacccaggaggcagaggttgcagtgagccgaaatcgtgccactgcactccagcctggcaacagagcaagactccgtctcaaaaaaaaaaaaaaaaaaaaaaccggaaaagataatcgtgtcatagtttcaaattcctttcagtaatttcaaatcttaaagtcatgtcatgttaaataaagtaacagatcatcataaaatgtctgagtcatttctaggtaagatactggaatattaacttttaaacacaagtttaagtttatatactttaagtatatctgttaataaacaaaaaattaaggaaacatctttctgaaaaattatgaaataattttcatccacaaatactgatataagacagtacaaaattacttacttcctgggtttttcactggaaattaagcttactaggagttgaaattatggtaatttaaactactagatataagagaaacaattctatatacagagtgtataaagaaagcaaaatgtattttaggttaagaaatgttattaaaaagacatgaggttgtggtttttgctgaaggaaaagtaattttttctagtttagaggttatttaaaggttgattcaaaatgaaggagaaatggtatagataaaaataaatgaatctaaaagttgaggtaagaaaaaagtagaaaaaagtcttataagcagttataaaggatttgtgggaatcttatctgtgtggtccaaagctgactgaaattggatggatttgtttatagggttttattaaaattagcttttgtattgataatacactaatataaaagtaaattttcattttctcctttaaacaagaatttatgtcatattaataagagagaaaattattttgtttaccttttcagtcaactgcaattaagaaaaaaaaaaaaaggagagggctgggcctggtggctcacgtctgtaatcccagcactttgggaggccgaggtgggcggatcacgaggtcaggagatcaagaccatcctggctaacatggtgaaaccccgtctctactaaaaatacaaaagttagccagccatggtggtgcatgcctgtaatccctgctcctcgggaggctgaggcaggagaattgcttgaacccgggaggcggatgttgcagtgagccgagattgtgctgctgcactccagcctaggtgacagagcaagactctgtctcaaaaaaaaaaaaaaagaaaagaaaaaaagaaaaagaaagaaaaaaaggagagaaggagagacagtttcacgctgtctttattagggctttggattttttggaaaactcagtctcctctctatcaaagagtaaaggtttttgctttttgccatctttgagttatcactttggctaaatgactattattttgcagtcatccaggatcctattttgataaagtgttttaaagctttcttactttgatatcaagtgttttaacctttgatatttgacatacttcccaaaagcaaatttcaaattctaaacttaagtcttcttgacccaaactaacttagacataacaaataggcccctgaaaggccaagagagatatactaggcttatttgttatgttaaaattatacggaccaggagcggtggttcacacctgtaatcccagcactttgggaggccaaggcaggtggatcacctgaggtcaggagttcgagaccagcctgcccaacatggtgaaaccctgcctctgctaaaaatacaaaaattagccaggcatggtggcaaatgcttgtagtcccagctacttgggaggctgaggcacgagaatcacttgaacccaggatgcagaggttgcagtgtgctgagatcacaccactgtactccagcctgggcaacagagtgagactcagtctaaaaaaaaaaaacaacaaacaattatatgggaaacgttgtcaaataagaaatggtgtttaactttctttgagttgtatttgtataaatgtgttattaatatgtgtcccaaaattggaggaaattcctaaatgtctgatatgtcttggtatatgcagttaattgctttattctgattctttttcctaaaagctttttgcaaaccctaaagtgtggtgtcttcgaggaaattcatggaaaggaccctgacaagtcatcttgaataacaggtttctgataactttggagatgataccattaggctagtagaaacgtccagggctcttaattagctgatgtgtttatgaggattgctaacccaacatcaagcagaacaagaattactcacatgggtctgaaataataaaggactgaaatcatttttatgactttttgtttgaaccattgttgtttctttttatgttttgtttttcagagtcaaagaaatttttttctttcttttgagctatttatatctacagcaattgggcaaagtatacacttgtgagcaaaatggagacatttacatttccctctaatttctccataatttggaaactattcatgaatattcttattttattataatatagttattaacatacattcactaagaatacgttttcttttgccactggacacattggaaatacttattatgccaaggttttgactagaatggtgtatttttagatatgaccattctgctttgaggaattgaggttgacttaatagagccaataaaaggtcctctggaaagactggcctagttccttgtcttatggttcccttgcaagattcctgacctgtgataaataaagaatgacactttctagcaggtccaggaacctcaagatattttgggacctcaagaagaaaagaattcacccaattcatacaggtagtttaggcacattttgatgacgaatctgtgacttggcttcctaaatccagacctttaaaagtctaattcaagtctttgctattgtgaatagtgctgcaataaacatatgtgtgcatgtgtctttatagcagcatgttttgcaatcctttgggtatatacccagtaatgggatggctgggtcaaatggtatgtaacaaacctgcacgttgtgcacatgtaccctaaaacttaaagtataatttaaaaaaaaaagtctaattcaaaattccttatgtaagttccagcaaagccaacttaaaaagagtctatgtggtcaatcgctagtcttgctccaccttatgcaaataatcgggccaagtacagtaaggctaaaatttattttgcaaataaactgggtcttactgtgatttttctttggtagaaaaggggaattggagacagaaaaactatctttcagaagaaaactataacacacctgttattagattccagccttgacagttgtttctgagcttttattatttgcctacaatttggactgaatgctgaattatttcctggctacaacaagtctctaaaggagaactgggttttaattttcttcgtgatgtttttagtttgctccctgatagaataggttctctgttttttgtttttgtttttttttcattctggcatacaaattctctttttgattgtagtatttgtgtgcattatatttctttttttgtttgttttttttttgagatggagtctcactctattgcccaggctggagtgcagtggtgcaatctcggctcactgcaaccgctgccccccagttcaagtgattctcctgcctcagcctcccgagtagctgggattacaggcatgcaccaccacgcctggctaacttttgtatttttagtagacacgaggtttcgccatgttggtcaggttggtctcaaactcctgacctcaggtgatccacccgcctcagcctcccaaagtgctgggattacaggcatgagccaccgtgcctggcccatatttctactattcaaattattaatgctatgtatctctcattgttttacttattctgagaaaaccaaaatcgtggtattccaaagactagagattattcaacaaaggctgtgaatctccctcctttggaatcctactgggcccaatctatttcccattgccaatgcactgctgataaatctataccataccaagcgtcttctctccagacccagggactacctcaggagaggtgggtgagtgagattgtcagggcaggtttccaggggtggagcgtaagaaaacagcctgttgcatggcaagagcgacgccatctggaagtgaaacctccatgataactgatgtttgactcctgcagcaaggtctttaagcaatgcctgtggcatagatgaccctcgtcaagatgcttatctaacctccctagtgatgatgagttttgcaagaaagcctgaggtgtgaccagctatgcatgttttaccctaaaggcttgctagataaaggatattttcggttgggcccagtggctcacgcctgtaatccaagcactttgggaggccgaagcgggtggatcacctgaggacagtttgagaccaccctggccagcatggtgaaacctcgtctctactaaaaatacaaaaaactagccaggtgtggtggcgtgtgtctgtaatcccagttactagggaggctgaggcaggagaatcacttgaacctgggaggccaaggttacagtgagctgagattgtgtcactgcaccccagcctgggcaacaagagtgaaactccatctcaaaaaaaaaaaaaggaatattttctggagggtgggtgtggggagctactgtctctcagccaccagacataccacttctgttactaagttcctattaaatttctttttcaaagaagccagatttgtgagcctcattcttgggcctctcggctccctcagcctttggggataggtttgcatagatctgctcattgcagaacacgcttcctcttctgtcctcccttgacatacaattatccagctctgctagagatggaagcaggaatttagggatcacagagtccaccaccctcagtttccagatacagaaaccatggcccagggagggccttgggtgacttgagatctcatcatgagtcagatattaagctgaagttaggacccacatcctccaccttataactagaagaaggtatgagggaatgaggtccctacagtccctgcctacagaaaataataacagctaatgtttattgagaacgtactatgtgccaggtgctactgaaatgtccatatgtctaattctcataataactatatgaaagaggtactgttattatgcccatttttgaatggagaaacagaagtacagtgaggtttagtacctgagtcaggattccggcccaagcactctaactccagagtttccacttgctttttgttgttgttgttgagacagagtcttgctctgtcacccaggctggagtgcagtggtgcaatcttggctcactgcaacctccacctcccgggctcaagcaattctcatgcctcagcctcccaagtagacaggactacaggcatgcaccaccatgcccagctaattttttgtatttttagtagagacagagtttcaccatgttgcccaggctggcctcgaactcctgagctcaggtaatctgccaaagtgctgggattacaggcaagagccaccgcacctggcctagagtccccactttcaatcatatttggaggaatgtaacttgtaggaaggattttatctgttctattgcactccagacagtaaaaccaggctcaacaggcccaaggagagggactctgcccaatataatcaaagaatggcccagcctcgaaaaaagcccctgtgccatggcattaaactttccagtggtgtaagtgagagaggagaaaggaagaagctggtcaggcaggcagttagggtgggtccttagttgaattctttcaagcaaaagaacagcttgcaggcacagataaggaaacttgcacatgggggcttgcctaagacatgcccacagccgcacagataagaaaggctacacagatgacttgcccatacatgtccgcaatggaaaattctgtcccctgacacatgtgcagaaaggggaacaaagcaatatgcagtaactcaagctaagggctcacatgtgcactaagaggacagggcgaagctaccagaaattcatgccttatgcaaatgagacacccaggcctcatccatttcttataaaaggctttgcattcaaccgtaaaaacagcaaccctcttccaggcccccactgcacaggagagctttcttcttttgcttgttaaacttttgcgcaacctcatcctttgtgtccatgctccttaattttcttagtcgtgagacaaaaaactccaggtgataccacaggagaggctgctacaacggctacattctggtgcattggcgagactgtaacataaggataggagaaaggcttgaaccaccaaggggagatgttgccaagatattcaagcagctcatggaggatggggctgggccagtgttttctcaggtcccttgggggggttcagaatggtggggggatgtggcattaaactacactgaattgtgtcatagggaacaattctccctctaattcctttccaacccttcagatgacttccaaaagaaaacgtcagttttctgcaagcctgtctttaacattgctctaactcttgctgataatacttcctaatacttcctgtttcaaaaagaaagaaagaccacaatatccagctagagtttgatggcattatttttcttttatgctcacatgtgcacacatgcacacacacacgtgcacatacatatttcttctattttggtgagttttactggctttccgctcccaattttgatctaaagttccccttttacattcatttttgtaagaagactgtgagtcaataaaaaaaatcatagtagaagatgaatatgtggctagaaataaattaataaaggtgatatgaaaatagccaaagtctggaaacactgagataaaataattctctgcttctaggcccactccaggctgagaggtcacagggccacgacattgcacataacggagcaccattcacattgtggtttacaggaacaacattccctgaatcgtgcagtgcacagcctgtgcagctgtacacagctgccatggatatttttagagttacaaatatcccaaacatacgagggaagagagagaatcttctggctggctgccctgaaattggcagccaaagtttccccctccaaattgtgttattttctgttcatgatcttcctacagcatccccaagttcaggggaccaccacgcatcccaagcagcactgggtctcaacccaacctcgagaagaatgggagaaacagtcccagggctctcctcaggggagactcacgaacataatcccagcaaggctgcaaaaagatgaactgcacgttcaagtgtaaaggcagcaggcagacattctcagacacgaacgcccttggagaatatagtatccatgagccattcttgaaaaagctagctgacattgaaatacagctcaccaaggaagaataaaataagcccaagaatggagaaatcataataaaaccccacggtgggtaaagaatctatgtaaacgcataaccaaaatgaaacaactggagatattgtagttggaacacctcgatgctgtaaaaatcatataagcaccaaaaatcaggaagtcaggggcaggaagaactgtggtcaccacgtatttcttagaagaaacctaatatcagaaagatcttgtttaaagaccacagggacacacttctatcccctttccctgcaaaaccacaaagataattgtctcccccaaggttaaaagggccaggcagaagagaatggagagtggaattcaggcctgacacgtgaacacaaagtgggcctcacttgtcatgagggacacgagtcccagtggctcttgaactcctggcctcaagcaattctcccacctcagcctcccaagtagctgggattacaggcgtgtaccaccgcacctggctccagtaggctctcaacccagggccattgaagaaggacctctcaggtcttaggaagttcctgtactgattaaaacacacacacacacacacacacacacacacacacagccaggcacagtggctcacacctgtaatcctagcactgtgggaggccaagatgggaggattgcttgagcccaggagtttgagaccagcctcggcaacatagtgagaccccatatctaaaaataaataaaaacacacacaagaaaatcaacttactctcacccataccaacccagtcctaaacagcgccctctctctctctctgtcactcacactcatttctctctaggtccattgcctcagcctctcctctggactccttgcttccacaccatcagccacaggaatacttgtagaacccatatctgaattctgctcaggaacctccaattgcctttagctctcaccagaatggtgccctcaaacacttctggaaaatgtggactcctaaagatgcatattctctgtaacccaacaattccatttcttggaactcatcttacacgtgtgcaaaattacacaaggtcaagatcattcattgcaaccttattttaatggcaaaggactggaaataacctacatttccattaattaaataagaaacatacattcaacttatggaaggatcatgcccattaaaatgaacaaggctactctctctctcagaatataattattaattaatattcacacagaatattagtagtacatggaaaagtggggacctcactgaagtttgagacccactgctcatccagaataagtctacagaactctgcctggcccttttgtctagtgtggtctcttgacattctccatcagacgctctattcattttccattgctgctgtaacaaattaacacaaacaaaacataatggctaaaacaatacaaaatctttaccttataaatctttttcctttttcttttttatttttagacagtgtcttactctgtgcagtggctcaatctcgactcactgcagcctctgcctcccaggctcaatcaattctcctgcctcagcctcctgagtagctggaattacaggcatgtgccaccacgccaggccaatttttgtattttttagtacagacagggtttcgccatgttggccaggctggtctcgaacttctgacttcaggtgatccacccacctcggcctcccaaagtgctgggattccaggcatgagccaccgcgcctggccttatcttacaattctataggtcaggagtccaccatggttctcactaggctaaaatcaaggtgtaggcccagccacatcccctagaggaggctccagggaagatatcatgtccttgcctcttctaccttctcctggatgcccacatgccttgactcgtggttcccaatattcgaaaccagccatgtcaaatctcccttctttcacagacacacctctccctctgcctacagctgggaagtgttctccacttttttttttttttttttttttttttttgagacagagtcttgctctgtcacccaggctggagtgcagtggtgcaacctcggctcactgcaacctctgctccctggattcaagcaattctcctgcctcagcctcccaagtagctgggattacatgtgcccaccatcatggttctccacttttaaggactcatggaatgaggtcaggcccatttggatactccaggataacctcccatatcaaaatccttaatgtaatcacatctgagaaagtccatttgcaccacgtaagctaacacagtcacgggttgggttacaaagtttgtgatgtggacatctttgcttgttttctattgttgattttattaatttttattgttattatttatatttttttatttcagtgctttaggggtacaagtggtttttggttacatggatgaattgtgtagcagtgaagcctcagattttagtgcccccattacccaagcagtgtccatcatacccaatatgtagtttttcatccctcactccctcccaccctctccactttttttttttttttttttttgagatagagtctcactctgctacccaggctggagtgcagcggcacgatcttggctcactgtaacctccacctcccagcttcaagcaattctcctgactcggcctcccaaatagctgagattacaggcatgcgccaccactcccagctttttgtatttttagtagagatggggcttcaccatgttggcctggctggtcttgaactcctgacttcaggtaatccacccacctcggccacccaaaatgctgggattacaggtgtgagccaccacgcctggcccctccccacttctgagtcttccatgtccaccgtaccactctatgtgcctttgcatacccataatttagctcccatttataagtaagaacatacagagtctggttttctattccagagttacttcacttagaataatggaaaaatatgggatgcttcatgaatgtgtgtgttatccttgcacagaggccgtgctaatcttctctgtatcattccaagtttagtgtgtgtgctgccagagcaagcactgatgtggacatctttggagtgggtgacattattctacctagcacagataccctatatccccagctaccaaagcatttgtcacatctcatcaaacacaagacctcaccaggcgcgggagctcccgcctgtaatgccagcattttgggaggtcgaggcaggaggattgcttgaggccaggagctcaagggcagcctgggcaacacagtaagaccccttctctacaaaaatttaaaaattagctgggcatggtggcatgaacctctagtcccagctacccgggaggctgaagcaggaggatcatttgagcccagttcaaggttgcagtgagctgtgatcgcgccactgccctccagcctgagcaacagagtgaaaccttgtttttaaaaaataaatcaataaataattaaaaaaaaaaacaacccaaggcttcatgactctgaaccagtccctccacctgaaatgctttctcatctgcccaaatgctactcagacattcaaggctgaactcaaaagccccttcctccatgaagccctctctgatttcccccaaacagagttaatgacacagccagcactttaaaaaagtccctctatatgacacgtgtcacttggcatttgaattatatgtttacttgtacatctctcagtagcctgcaagcaatttaagagtgaaaacggacatattcaaccacacgtccccaccattcatcacaatgcctggagcataatagggtttaatatttaataatcaatgattgggtcaggcgcagtggctcacacgtgtaatcccagaactttgggaggccaaggcgggcagatcacttgagggcaggagttcaaaaccagcctggccaacatggtgaaaccccatctttactaaaaatacaaaaattagttgtgtgtggtggtgcatgcctgtaatgccagctactcaggaggctgaggcaccagaatcacttgaacctgggaggcttcaagggttgcagtgagctgcaacaacaataataataatcactgatggaaagaatgaccaaattctttctattttaccatggagtgcactatttaatacataatccaaaatacgattttatgcatctgttgttattccacatccctggcccatcatgggaactctataaatatttgctgcataaataaattaatactcatacctaatatttattgaacattttctatatgccggcacttagctaagctcttataagctctgcctccctaacttaattcttcacaatacctctcaagggagtactactgtatttgtttgggtagttaatactagctgctgttacaaacacctcaaaatcttaaaggttctttcttagctgcttctcctgaatgactcatatccatgcagtgaatcagggatccaggctccttttatggtgtagctgcaccacagatgagggagagaaagtagagggaggacacacagtatatttgtccacctcagcccaccacttccactcatatcccattggccagactagtcacatggccattccaagtgcaaaggacgctgggaaatgcagagaaactcaaggctactgataagcatagagtcacagctgcaatcatcatcttcctcatcatacagtggaagaaacagaggttcagaggaatggagacacggctcaagtccttttagctactgtgtgtaagagacgagttcaacctcagatctgtctgcagcatagaaccagcccttaaccattacttgctcacatgtgacattctgtgcgctcaaaagttaggccacagcggggcgcagtggctcacgcctataatcccagcactttgggaggccaaggtgggaggatcgcttgagcccagggttctgagatcagcctgggcaacatagtgagacctcgtctctaccaaataatgctaaagataataaaagtaaaaataaaaagttaggccacctcagagagtgaagcctaggaccttgctgcatggcgagaaggactccaccctgggatgggacatttcctctggacgatcccccagcagataatccacgaagagctaatcaggagttggctgggtcttgcattttactatctatttgcttagtcctgccagaatccatttatttataagcatctaaatgatgacatgaggcagatgttacgtgctgattttcccctccagactggtgcaagaggggaaatgaaatctatttttttaaatgagcaccagatgaagcttgaacaaaaccaatacctcttgccggacaagcagctctctaagcttcccacagacactctcagagtgtcatttctggggtttatttggtagttgtttactgtctgggaagaaatactgctccttcctggatacatctctcctctcctcctcctacaaccttcccccaacagtgttagccctttgaccttgtagtttaaaattgtaataaaaaatttccccttgacccgccattgctttgccaggaaccaatccagagtcaacgccctctttccaaaccccaccattctccttgcctgttcctcatcttctagcgtcagcatctccacactgagacaattgcaattacaagtcaattctcaattattcagggctgattattcagggagtggattgctcaggctttctgcttccccctccctctgtgggcttcgttctactcattagcagctccaccagcagacaaaaaaggaaaagaaaagtttgctgaactcccatccctcaaaaccactggctggttagccatttctgtttggccagggaggcgactgggatcctggactttatctgtccatgctgctttcttccccaattcacatagatagtgcagaattgccatcatttttccaggaaagggaggagaggtacagccaacgccagcctgggtctttcaaccccagggctgctcccaccagcctgtgacgtctgtgtgcttgacaacagcgtgtgcccacgtggaagtgtatgcgtgagtatgcacaagacacacagtgttgtcagctacagcgtacagcttgatggcaggggctgtctctttacagcatgaaatatgtcaagggaccattgtgtgatggcacatctaataaatacaatgaattttcaaaaacaaatcagagagaggcagacgaaaggcaattcacccacacgtgaaatcgtctcctccaccagcttacccaaaacagggcttgtttttagaccagaggccctctcccaggtcaaagcctctgatcttgggggatgtgaatcatagtcccttactgaagggctgtaggacaaatggggttcctcctggaaagatcattttgtggccctctagagaaagaacagacactggcccagtggatagagtatgtatcagcccagaagggggcccaaggttggcccaggcagaactgagtcacctctgctacgatcaccactccgtgcagcctggcagcctggtctccacccgctgcttggcaaccttcaaattatcatctacaagggcagagcagcctatgtataggcaagaatggggttcctgtgtgggaagaacgagatgggcttttaactctcttccagcaaacctggccaaactcctggcagtctaactctgggccatcttgcctcatttttgcattcaatcaacaaatactcattaagcacctactacgcgccaggctgtgttggaagcactgaggattcagtggtgcgcaagatgtgatgttttcattccagcaggagaaacagatgtaaacaagtcaacaaataaataaacaacagatggtgatatgtgccctgaataaaataaaacaggatgctgtgatggaataacagggtgagcgaggcttctctgatgggctgaccagggccttttctacaagagagaacacttccagctcaaacctgatgacgacaagctggccatgtaaagatccagggggtggccacacactgtggctcacgcctataatctcagcactatgggagaccaacacgagaggaccacttgagcccaggagttcaagactagcctgggcaacgtggcaagatcccatctctacaaaaatgttaaaaattagccaagcatgatgacatatgcctgtagtcccagctactcaggaggctaaggcagggggatggcttgagcccaggaggtgggggctggagtgagctgtatttgcagtgtaccactgcactctagcctgtgacagagcaagatcatgtctcaaaacaaattaaaaagaaaaaaagaggccaggcgcggtggctcacgcctgtaatcccagcattttgggaggccgaggcgggaggaccagaaggtcaggagatcaagaccatcctggctaacacggtgaaaccccgtctctactaaaaatacaaaaaaaaaaaaattagccaggagtggtggcgggcgcctgtagtcccagctactcgggaggctgaggcaggagaatggcatgaacctgggaggcggagcttgcagtgagcccagatgcaccactgcactccagcctgggtgacagagcgagactccgtctcagaaaaaaaagaaagaaagaaagaaaaacaaaaaaagatccagggggagagcatcccaggcaaaaggcacagcaagtccaaaagccctggggcaggaatgaacttggagtgctggagaaacagcaaagaggctgttgtgagcgagtcctgggacaatgggagaggccagggccagattgctcagcctcgtgctggggcagccttaaggagaaatgctgcagctctgggaagccactgagggcaccaagcagacgagcactgtgatctgatttgcattcttaaaagcgctatctggaggctgagcggctgcaaaagacagaacccactcacaggagcttgagaatggatgcttgttaacacagaaggatacacgggcatctcgctgaacccagcagcagggactgcaggggacgggagccatgggagctgggcaacctctctctggctgtctcagcccctctctgctcctctgaacacatgcctgcctccctcaaacattccaccccttgtccctgtgaccagccctacagaagccaacccacctcccagagtcctccaaactcccaggacagaggagccaattggcccagctcaggtcacatgtccagctctagtggccaatcagcatggccgggtaaatcatggccttgcaggaaaacgtggttgccagcatggccgtgactgatgttggggaagctcccagaggagaagaactgggccggccaggtctctccaaagtgtccgttccccagtgtttcccagaattccccctggcagccttccctgatttcctccatcctgtctccatctcaatccccacccccaacccaaccaggggccagggctggccagaccacagggttcctcggaccttagggagttgggagtttcccactcagggcaacatggaccccagaagcaggggcaacaaagggaaaaagtcaaacccagaaagatggaggctgggatttggagggcaggaagactgctctgaaaagcttgaagccaggaaccaggagcagaaaaagaagagtcagtgtggcaggatgacacgggcggcacagctgctggtgcccactgtgagtgtcacgcaccagccaggcctgctggggctgctgggctgacggccactcagcccgaggcgcctgtgtgcacagcagggtggagggggcaggagagagcccacagggtggtgagtgggggctgagtttggctcctcctgcagctcagaggcctccgctctcagagagggtagctctctgcccactctcctcagtgctggctgctcccttgccgccaaggccccaagaacagccggtgtgggcatccagggatgctggcatctgggccttggtctatccacagtttaattgcaaaggggtgtcctgggaggaacagtggctggagggggatgagggagctgagaggaaggaggtgagggacttcctgtctcaataggagctgagggccagaaggagagaaggacggaaatccagagagccagaagcagtgggagagagaaggggagagtgagtgaggaaaaaaaaaaaaaaaggaggccgggcagggtagcttacacttataatcctagggctttgggaggccaaggcaggagggttgcttgaggtcatgagtttgagaccagccagggcaacagaatagaatgagaccccatctctacaaaaaacaaaaatttaccaagcaaagtggtgcgtgcctgtaatcccaactactcagtaggctggggcaggaagtttgcttaaacccaggaggtggaagccgcagtgagctatgattgcgcccctgctctccaacctgggcaacagagcaagaccctgtctcaaaataaataaacaaataaaagatagagaaaaaaaaatcagaacagagtaaatcagagacaaagagaccaaaatggagagagttggagacagacgtgacaacaaaaacagccagagagccaaagactgacgactgcctgggctcgaacccagctgccacaactaatgacaagttacacttattagtctgctaggactgccataaaaagcaccacaaataggtggcctgaacaccagacagttcctatctcacagctctgaaggctggagggccaaaattaagaggttggtagggctgattccttctgagggctgtgggggaaggatctgtttccggcctctctccttttttttgagatggagttttgctcttgttgcccaggctggagtgcaatggtgcgatctcagctcaccgcaacctccacctcctgggttcaagcgattctcctgcctcagcctcccaagtagctgggattacaggcatgcaccaccatgcccagctaattctgtatttttagtagagacaggggtttcaccatgttggtcagcttggtctcgaattcctgacctcaagtgatctgccctcctccgcctcccaaagtggtgggattacagcccagcctgtctccctgacttgtagatgccaccttcccatccacatggcattctccctgtaagggtttgtatttctgcatttccccattttaggaggacatactccatattggattagggctcacccaaagggcttcattttaacttgatttatgtctataaaaacgttcgctccaaataaggtcacattctgaggtactgggggttaggagttcaacgtatgaatggtggggggggaggggcataattcaacctgtcacatcccttaacctctctgtgcctcagtttcctctgtgcctcagtttcctattcctaaaataggcataataatagtaccttcctcagaggtgattctgaggagccaggcatagagaccggcagaataaaggcttaataagtattaattacattgtcattgttttgttattattgggtgcatttcggcagaataacagccccctaaaacgtccacgctttaatctttggaagctgtaaatatgttactttacaaaacagaagggactttgcaggtgtaattaaggttgtagcccctgaaatggggagatgatccgttatccaagttgacccaatgtcatcatgagcccataatagcagagaaccttccccagctgcaggaagagagggagaagccaggtgagaaaaattcagcccgctgttgctggctctgaagatggagaagacggggtggggggtccccagccaaggaacagggtgacctctagaagccaagaacagcccttcgtttgcagccagcaagaaagcagggacctctgtcctaccatctgtaggaactgaattctgccaacaatcagaataagcaaaaaatgcattcacccctagagcctccggaacaaggcacagcctgccaacaccttgattgtattttatttatttatttatttatttatttatttaagacagagtctcgctctgtcacccaggctagagtgcagaggtgtgatctcggctcactgcaacctctgcctcccgggttcaagggattcttgtgcctcagcctcccgagtgactgtgactacaggcacacaccaccatgcctggctaatttttgtatttttagtagagatggggtttcaccatgttggccaggctggtcttgaactccttgcctcaagtgatctgcccacctcggcctcccaaagtgctgggattacaggcatgagccaccgcgcctgccccatgtcaccttgattttaggtgggtgagactgtcctggattccggcctgcagaactgtaagataatacatgtatgctgttttaagccactaagtttgtggggtcatttattacagcacccacagaaaactaatacattctgaaaatgccaggcaaatgggagtgggtgatctggtcaaccaagccctccggtgggagaccaggtggacaccagtgcaccctaggggtagtgagccaccctagcaaccatggagaggccggcccacctggaggacccctcgggaacaggagtgggacccacacactggcctttgcagctggcacagcatctaaaagcagacaaaaaaagccaggggttatctgcgcctggtcagggagacactgagagcccccagggagataagggagccccaggctccacccataggcccctccaccactccagaggggaccctgactgtcagagactgagtaatgcccccaccacgaagtccacgtcctaatcctcggaatctgtgatatcttactttacctggcaaaagggactctgctgggtgatgaagataaggatcgagagctggggagattagccaggattatccaggtgggtccgaagtaatcaccagggtccatataagagagaagccagagaatcaaaaaaagatgatatgatggtacaaaaccaaaggttagagtgacgggctttgaagatgcaggagataccagacaaggagtataaccggcatctagagactggaaaaggcaaggaaacctcctccctgaagcccccaggagtgcagccctgtggatgccttcattttagactcctgtcctccagaactgtgggagaataaatgtgcatgtgtgtgtggttggttggttggttggttggttggttggttggttggtggttggttggttttgagacaggatcttgctctgtcacccaggctggagtgcagcggtgccatcacaggtcactgccacctcaatcccccaggctcaggtgatcctgccacctcaacctcctgagtatctgggaccacaggtgtgcaccaccacacccagctaatttttttaaattatctgtagagatgggggtcctcctatgttgcccaggctggtctcaaactcctgggctcaagtgatccacccacttcagcctcccaaagtgctgggatgacaggcttgagccaccatgcccagcctaaatttgtgttgttttaagccactgagtttgtggtaatctgaggaccctggtgtatggcagatgcaattgacagcaataacaacttaagcataccctgtatggcagacacacctgacttaagaaatgaggattgccagaccaagggtgttaagtgaaagtactatagaaactgcacgcattttacgagccgttgttcttctgtccagcccatcgccactggagcaccctgtaggtaagttcccccaaataaactgtatggtttttgtttgtttttgtttttttagagattgagtctcttgtcacccaggctggagtgcagtggcatgatctccgctcactgcaacctccgccttctgggttcaagtgattctcctgcctcagcctcccgagtagctgggactacaggtgtgcaccaccacacacggctaatttttgtatttttggtagagacagggtttcaccatgttggccaggctggtctcgaattcctgacctcaggtgatccacccgcctcggcctcccaaagtgttgggattacaggcataagccaccacgcctggcaaaactctatgtttagtttgctggctccaggtctcttccttggcctcttgaaccttgtgccatccctcctgaagttaagaggggtccagcatgacacctggccaaggctgcctccatcatcagccactgctgccccttgtccagaccattgcagcagcctcctcatggcctccctgcctcccctctcactcccttccatctgttccaacccaggcaccagggaggtcttctagaaaagtacgtcagattgcatcacctcccttcctgcccaccaaggacttctcatcacacttagaatgaaaccgaagtcctcacggtggccggcagggccctagcccagtggctcttggccctcactgcacatttgagttacctgaggggcttttagaaagaagcaatgtccagaaagtggggtgcagttgtcagaacttttttgtttgtttgttttgagacagagtctcgatttgtcacccaggctggagtacagtggcgggatttcggaccactgcaacctctgcctcccaggttaaagcaattctcctgcctcagcctccagagtagctgggattacagttacccgccaccacgcctggctaatttttgtatttttagtagagacagggtttcgtcatgttggccagtctggtcttgaaatcctgacctcaagtgatccgcccgccttggcctcccgaagtactgggattacaggagtaagccacggtgcttggccacatcagtactgttttaactgcccagttctgagcgcaggtgccccatatgagatgcctgttctcctccctgctctttccccgaccttctccctcaatcattgtgctccagaccctgtggcttcctcgcagctccctgcacacaccaaacactgtccaggctcagacattgcacctgcttgctctgtcaccccagatacctttggagcttgtgccctcaaagtggccttcctgaccccccattataaaatagcacccctgccccccctgcatgcccttaccccagaccctgatggatttgtctcagtgacactcagcctgcctgtgggaacacatgcatttgtgtgtgtgctcacctgattcctcactggaccatcagttccacgagggcagagtccctgtatcactcaccactgattaccgagtatctggtgcctagcacagggcgcgggctcattacctatttggtgaatgagtaaatgcgtgctgtgtcattacccccgtctctggccctaccaggcaaggctcaccatggaagcaaactcaggaccaaactccagcaaacaggcttccatgaggcagggatgcagtggaaacggcactggccttgggtcggcaagcctagaacggagtcccacagtgggtgaccctgagggagtcactgcctctctctgagtctcagtttcctcatctgtaaaatggggattatgacttaactgcttcagcccacttcacagctgttagccacataacaagtgaagaaactgtcttatcttagctgctggcaccagaattcctcttgaggacagaaatgactttgtggagaaaaatgttttgacaagagcttcagtgcagaaggcaagtgccccaatgtcctcatgcacacacacacacccgcaaaacacacacacacgcttgcaaggttgtatatcggcgccaacaggaaaggcttcaggggagagggaagcggctttgcacgcgtgaggaagagacaccgggaactccttgggaaatcaggtagaaggaagaggggccaggaggatgccagatgcaccgtgtcacctgcactgtgcaatggaacctcccacggatcttcagtaaagtcagcaaaatcctcagacgctctttgagagggatttgtctctatggaaacccaagaaggggcagcatcttatcttgacactaccccattcaggagggagtcaaccaccagaaacccagaccccaaatgcagaggcaggttagggttagcggaaggcttggaccctagagacagcatgcactgtggggggattttgctaaaaggtacctagtccccaagggggacacagaggccccctctgattgctgcaggtcagaaagaaaatattggattggactaatacgggagagctatttgcagaccaaaaaagtgctgttcaatctggaggtgccaccgtgccaaggccatttccagcctgcagggaccttcaatctccatgagacctgcacccactggaagcaaacttctttgctccccagctccagtaaactcattcacatctgcctctgacaggagaagccatccatccctcctcctgcctgatggagtctccgtgatggaagccaggggtcaggaataatggataaagatggcaccaaacatccctccaccggaaatcattccttggcaactggtgcccagcaggagtggggagcgtgtcatctagaactcccacaggacggtgattgcaaaattcaaatgcagccgcccgcaactgcctctgacaggaagtttgatcagcatcctgagttacatgatgtctcccctgtgccagcctcagccttttctagggtggtcaagcaggcctgggagcctgagggtagagctgaggaggggctctgatgggtcgtcggggctctgccgggcaggctgcactccttggatgcccctaagagctcccaggagaatgaaaggcagccctgtacacacgcccagatggctgtttagaaaagaacctcaccctgatttccaacaaggtttcccctggagagtctacgagttttagaggcagaggcagttgttggaactgtgttcaccaggatgaaggaagaaaggaagggatgttctcagcaaagagcctgggcctggcctggtccttgccagtcctgcctcatgacagccgccactgcccgagagagcctcccagcccagccgcctgcagggcatcctccgccctgggttgggggctgtgagctcacatgctttggggactacagggtcatgaaactgagcaaaggggctggtgtaagaggattgagcaatggacacactgcctcggcggtcagggacaaaagggagtgtgaggaccgtgatgaactggagcacatgggcccatccgaaagaggcagacatggtccagatcgagtcagtcgtggccatgtgtggcccagtcctgctagatccttcctgtcgtccaagagaagtcagaaccctggtttttgggtggaatcacctgatgtttcaagtttgaagtgagagagactgctctttggccccaatgtccatctgcctcctccttctgtgccttcacggccatcgaggaccatgtggaccagggcagtgccttgggatggtagagcaactgtctagagggattctgggcccctgaagtagagctgagatgcctgattcgttcagactttcatgtgacagaggacagaaagcttctatttcgcttaagccgctataattttgggtatttggctcagcagttggacttaactcctaactaatgcagtttgccacggattccattttcagattcccagtgagcacagccaactctgccagccagcagccgtcagcttgcaaccctgacctagggtgacattctaaacagaacccaccagatcatgtcactcccctgcttacgaactctgagagttcccctcagctcaactaagtccaaactccctgacacccccaagcaggagcttcacaaccagctctgctctggtctcagatttcatactcccacgcagtcgctacagctgctccaaatgccccacggtttctgagcccccaaggtcactgcttcctccaggcagccacccctcccctaggctgagtcagtcacgcccccctctgccctcccaccaccccttaaacacagcctattaataccctgttatggcacacatcatgtggtattctaattgcattagcctgtgaaagcagcagctctggaggcagcccaaaatcccaatgctgaaactcacttgctgtgtgatcttaggccagtcactcaacctctctgagcctccattttctcatccgtggtgaaccggtgacaatattgattaaatatttaacatgtgtagacagaatgtctattgggccaggcagtctgctaggcactgaacacacaaaactgtacctgtcatcatagagcttacaaacttagagtgcagattgacctgaaatgaaattttatacaaaaaaaaaagatacttctggctgggcatggtggctcatgcctgtaatcccagtgctttgggaagccaagatagaaggatcactcaaggccaagagttccaggccagcctcagctacacagcaagaccgtgtctctatgaaaaaatttttaaaataaattaaaattatcgagggtggcagcatgcatctgtagtcccagctactcgggaagctgaggtgggaggatcacttgagcccaagagttcaaggctgcagtgagttatgatcatgccactgtactccagcctgggcaacagagcaagaactctcaaaaaaaaaaaaaaaagttacttcaatgcaatttataaaacttacaagtgcccaggtgcagtggctcacacctgtaatcccatcactttgggaggccgaggcgggtggatcacctgaggtcaggagttcgagaccagcctgaccaatatggtgaaaccctctctctactaaatacaaaaaattagccgtgcatggtggcatatgcctgtaatcccagttacttgggaggccgaggcaagagaatcgcttgaacccaggaggtggaggttgcagtgagctttcaccattgcactccagcctgggccacaagagcaaaactctgactcaaaaaaaaaaaaaacttacaagggagaaatataatacacatgtggataatggagagagccaacctagtctgggagaggtaacatttatggagagttatacagtaggagccagctaggcaagtgaggagagctggcgagcagagggaggtgggcgtcaggaggaagagatggcatgtgcccctgccacaggaagagaatctccttttccagaaacccaaagagatcatgactataatgtttgggggtggagcaactatgctttgggtcttcagggcccagaacagtgcttggcagggaaatgttactagaccctgttgcccaccactctctgatttggtgactgtacgtccacacatgggcttggcattttccaagcactgaccacgtgccaggtgccacacaggacatgaaggaagatgcgaagatggaccagccctggatcctgctctctcagcatttcatctcccacagcatggggaccccaagcgccacgttaaggcatcaaggtttgtataatagcaaacactagcgattgtacaccaaagctggtttctcttcttccatggcattgcagacacccaggcctcccagacaggaggcatggccatgcaaagctcttgccaatggcttgtgaatggacagtccgtgtcagggtgaagacatcaggcatctcctgccttcctatgtggctcacttcagccacactgacaacgaccagggtgccctagggcatacagagcaatgacttggaaggagcctggctcctggaatgactggcaggggcagagctgccccaccaaccaggactacgacctaagagagaaacagctgccctgttcttcaagcctccatattgcaggatctctttgttacagcagcatagccttaccctgactcatctagagcctgagaaagggacagggacctaggagtttggaggaggaagtggccattttgtgctgcaagaatcaaggaagacttcctggaggaagatgacatttgcactaagctgaaaggaagtatgtattctgaataaataaaggtgtatccatgggaggacatactaataaacagttattgaagagcacgaggcagatccacacgtgcagacacgggaacatgcctcagttatgttgtcatggggagaaagcagagagtagaactgtacctctctgcttccatctctttacataggtatgcggttgataatagagaaaacaactggaaaaatacagactaaactgaagagtggggataagcacacggaaaggggagtcattttcttaattttcatttttttaagagacagggtctcgctctgtcacccacgctggagtgcagtagggcaatcaaagctctctgtaacctccaactcctgggatccaacaatcctctcatctcagcctcccaagtagctgggactacaggcacgctattttttttttttttttttttttttggtagggacggggtctcactatgttgtctaggctggtcttgaactcctaggctcaggcaatcctcccacctcagccttccaaagtgctgggattacaggcattaaccaccgtgccagcctcatttgtcccactgggctgttatatcttttggcaatgaatacctatttggtataataaacctttcttgcatttctaaagcaagtgagaaatatgcttgtcttgtcctctcgggaaaggagctgctctcagtactaacctggcccctgccctgccccagccaggttgtgagctttgagaggaggcactggtgtaactactagtccttgcagtcccatgtggctgggacagagtccactgttgaagcttttgaaatcaatttccagttggttacatctgagctcagtggtttcccagagacaaaagtcttaaaggcagagagtgccttctttgcctgggcaaggaaccaggaaatttgacctccttgggccaaaacatggctaaacaatgagggtctgggcaacaccatatctaatgtgggatggggctgggcacagcggctcacgcctgtgatcccagcactttgggaggctgaggcagaaggatcgcttgacgccaggagtttgggaccagcctgggcaacatagcaagacccctgtctacaaaaaaatttttttaattagccagctgtgtcggtgcatggctgtagtcccagctactcaaaaggctgaggtggaaggatcacttcagcccaggaattcaaggctgcagccagcagagatcacaccactgaactctggcctggatgacagagcaagaccctgtctcaaaaaataaaggaccatggatttggtccctgggctgtagcttgccaaaccccattgtagaacatcagtgctgaaagactcttagaggacacagtctatcctgctataaggcaggctcctttgacccaggttacctcattcatgattagtatgtaagggaaggatgttgaaataatgaggaaagtgtgtccatacaagattttctccagcacattaatatttttaagtagtcaggaacaagtacaattaaagaaatatccttatcaggacttgaaaaactgaagaaaaaagctggagtctacagaagtgcctctggtaccagcttggttccagtggtggccggatttgtggtttcaagaacctctctgctgccactgggctgtataatctggggatatggcaaattgagatgaagaagctacaaagtccttcccacctctgctgaaacaataggccagtggcaaaggctacactttcaatcacagttttttgtttttgtttttttgagatggagtcttgctctgtcacccaggctggagtgtagtggcacagcctcggctcactgcagcctccacctccaggctcaagtgatttttacgtctcagcctccccagtagctgggattataggtgcatgccaccatgcccggctaatttttgtatttttagtagagatgggtttcgccatgttgaccaggctggtcttgaactcctgacctcaggtgatctgcccacctcagcctcctaaagtgctggaattacaagcatgagccacactgcacctggaaccaatcatagttttaatgtggataaaaatgatcgtgattagaagcaaatgtcctcctggacctacatctctgaggaggaagcagatgctgagggttgaaggctgaaacgtttgattgtgtggctgggtacaaatgccctcaaggatttacccgtgctcagattttattaagattgttattgattttgttagctagtttggagcttagtgcaatcttccctaggttcggggtcatctaccccaactctatttttctcataagcctctttcttattagcccacgactttacagatcatgaggttttataggaatgcatgtatggaatgttagcaataatgtctggaacctttctcaaccccaccaaaacactatgcagatgagaactgctactaaaagtagctgctgacatttattgagaacttactgcatgtcggcattgtgctaaatgacttattcaccccctctctgcacaattatctactggtgtcatccccattttaatagaaggggagattgacgctcagagaggttaaatgatctgtccaaggtccatcatcagagccctgagagtcctctcacctccttccaaatccgcttgcctcccccacaatgtccacagcatgctcatctccctgcaatgtgcaactctgagaatcctagatcttgcctccgcctttagggttgattatacaaaacgcagaggcagagagaaccaagggagagagattggatgctgaccttcaggaaaagttcccactgtcttgtgaatcaaatcaggtgcagttctgatgtctgagaatatcaaattggtttttttctccttattggaaactccaaaatcagttgaacccaaagataaagaccaggactgagataatggccttatttcaggaccccagcatcattctggggtgactgtttgaagaagtatggatgctgatatgtaatgacacacagggaaaggcatcttcaaaggtcagaggtcaacttggcagggacagagggacattcggaacagaacatacccaggaccaaatgtcagcgaggacgtgggcaacacggacattcagtcactactgtgtgaggataagtaggtgcaaccacttgggaaaacttcttggcgttatctaatgaaagtaatacgtctttccctgtgatccagcaactccattcaaaggaatccgtgccagagcaactcttccctgtggcaccctgagccatggacaagaatgtttagagcagacgggttggtgatggcaaaagaatgagagacatctcaactgtctgtcaaccgcagaagaaatacacaacctgcaagagagccttataacaaaaactacgcagccgtggaaataacagatgcagtcctgcacacatcaacatgcacaaactcaaaaacataccgtacaacacagagggcaaaagaagcaacttacaaaacaatgcgtagagtctgcatgtatttagatgaaattcaaggacaggcaaaattaaacatcatattgtttaggattatgtgggtgttaaaactatcaggaatggcagaaagtgactcatgcaaaattaaggatactggttaactttggggagggacgggatgtgatggggaggggcacacaaggaatgtctaagacttggtaatgttctaatccttaggtggtgagtacatgggtattttattattcttcttagactatacagatatgttttaaacattcttttttataagtgatatatttcacttttttaatttagagatttaaaaaatagaaaatagccccagaaatatgatagagccagcacaacaaaattcaagcctttatcggtatttaaggagcacccaattttccactccataccatcagagaacatgttgttcaaacactgcctgtaacattagtaatgcaacttttggctgtaataaaaacctaacagtggcttaaataataaaggcattcagttctgtctcataacaagaagactggaagtaggtagctaaagattgatccagttgctcaacaacattaggaatctaagtctgcaattctctgagacttctcctagaggcacaagatggctgcggtagctccagacatcacatccttacccaaccacttccaaatgcaggaaataaggggcattcaggatggtgagaaagacttcactcatatgcccccacatccttccatcaggaggaaaaatacatccccaaaagcccccagcagagtcctgcttacattgcattggccagaactgggtcactaaaccactgcttagcttcaagggaggctaggaaagtagcttcccttttcagtctccttgtcaggtagacaaggaagaataacaagaaagaagagggaacggccattgtgcaggaaaccacaatgccaccttccccccacccccaggcaagttagatgcatcagtcccactgttgatgtcctgagatcagtcaaataacccagaccccacctcacctggaaaccggagcccataacatgccgcccccacatgaagtgctgagacatgtctgttttctccatagaggcttgagggatgctctgaattgcctttgatccccaagcccagctgcgacctgcacagagtgaaacacttcatgatgccaatcagtggacaattctcagatgaaggaagtcagcaaatgctccccactgccatgatctgctcgggtggaactctggtgtgaaatgggcccttcatgctaaagggagaagctggtcgaggtgtccatgagccactgtacaccctgtgtcagaggcgtttgaaccacagcaacttcatcttgaataaggcctgggtaaaataaggctgagacctactgggctgcattcccaggaagttaggcattctaagtcacaggatgagatgggagcacaagatatcagcacaagatacaggtcacaaagaccctgctgataaaacagcatgaagtgaagaagtcagccaaatcccaccaaaaccaagatggccacgaaagtgacctctggtcatcctcactgctcattatatgctaattataatgcattagcatgctaagagacactcccaccagcgccatgacggttcaaagatgccatggcaatgcccggaagtgaccctatatggtctaaaaggaggaggaaccctcagtttcaggaattgcccacacttttcccagaaaactcttgaataagttttcacgagtagccattggagtactcattctttgacacctatggagtcaccattcttttattcctttaccttcttaataaacttactttcactttctatggcttcacctcaaattctgtcttgcacaagatccaagaaccctctcttggggtctggatcaggacacctttctggtagcacctggatgcaaattacaggacagctcaagcatcaatcgtccaaagggtcactgtaattgtggaccacagcagcaaagcactcagagaagggagcagaaatttaggccacgctagaccacagtcttgcagacaatgacttgctggcacttctaacagtggccccagagacagagcatgtgcactcctgtttgccacagcccctaccactccctattatttctccatcaccaaggtcaggggtcagctgctgctctatcatcatgctcacctggttcttcatacccttggccacttcccaaacttgggtcacctgtctcgccttgtaggcactagagtttcagatccttggactaaagcactgaagatggtcaagtttcctgttctgtgtttgaaagtagcaagtccactctctcatcaatgccttcgttcgcgcagagacattgatgtggcgagtgattgaagtcaaagactcaatgcctgttcccaaagagatcaaaatcggccctactgtcttgctgggcattggcgactcagtccacccagtgaagcagacatgcaaaatggctatgcagggtgccgtctttgtgcggtggctcaaacagttctggcggctactccaaagcgctgctattcatgatcattgttataaggggtgtcattccagggaatctgagaaccaatctacatttgcaaaattaagcagtaaagtaatacccagaagaatgcatgaaggggatgtgtctggcagcatttctgaaacaataacgataactagtgctcgtctgaagtttacaatatgccaaccattgttctaagtacctttccatggattgattcacttaatcctcacaaaaactctataaagtgggtactcttgtccttatgtcagagggggtgttgcagccagccactgtgacccctggtgagcttcatctcctggtctgcctgcccttttgccgtcctctgtcacattgaatcagggatgacttgtgtgaccaacaactgcagaagtggcagtgtgtgattccaaggctaggtcacaaaaggcattgcaacttcttgctagggcttttggattgctgaatctgggggaagccagctgccatgttgtgaggacgctcaagcagccccgtggcaaggttcatggggaaaggagctaactagccagccccaaccaggcagccatgtacgtgaggccccttgggaggattctccagtgccagtcaaaagtctcagatgactgcagcttcaactcacacctactgcagcctcctgagagacccccaacccagaactgcccaccaaactactcccaaattcctgatctacagaaacagtgaaaaataatcagcaattattgctgttttaagccactacatttggggatgatttgttaggtggtgtattagtcctttctcacatggctataaagagataccggagactgggtaatttataaaggaaagaggtttaatcagttcatggttctgcgggctatgcaggaagcatgagggggcatctgcttggcttctggggaggcctcagaaaacttacaatcatggtggaaggcagaaggggtgcaagtacacagacttatcaggtggcaagtgataactaatccagatggtaaaactcagggttggggagacagaagttaaatcatttgcccaaggtcacaccactgctaagcagtggagccaggatttgaacacagactgtccaatccagagcagctgaccactccactatagtgctcctatggctacttccaaaagacatttggttcgtgttcacctgtattcatctccctctaactgagtgcctactctgggctccaggttttacctacgttaatgcattccgtcttcccaggaactccagcaaataggtcttattttttccattttattctttctcttaaaatttaatcagttaaataatgcatcaatacatttctcctttagaaaaattcagatagtagataagacccctaaatctctttagaactcttctgtccctacctctgggctcctctcccaaactgacctcatcactttggtgggtacctttctaacccttttttttcctaatcatttacattcatattcatgtccccaaaaatactacatagcagagcaatgactggcattggtctcacaaaataatgttgagcaagatgccaggatatagcccagctggggttggcacctctccccatgggcctcgacacggggctacttgagcatcctcacagcatggtgcctgacttccctagagccagcaatccaaaagactcagccagaagttgcaatgccttttgtgacctagcctgggaagtcacagcaacagaatacactgtgattccgttaatgtgaatacaaaaccaaataggcaaaattatactatataatatgtttagggttgtaggcttaggtggcaaaattataaagtgagtcaaggaattgaccgtcgtaataacaccaggatagtggatacgactcagggtaaagatgggggtaggaggtactggtaggaccatgaggggagttgctgggtggtggcaatattttatttttgacctcagaggtgattacatgaggttcaatcagggataaatcattaaatcgtaaatcatctttttttaatgcacttttctgcatacatgtttttgttttttaggagacaaggtctcactctgtcacccaggctggagtacagtggcgtgatcacagctcactgaagcctcaacctcctaggctcaagtggtcctcccaagtagccaggactacaggtacaagccaccacaaccagctaatttttttttttttttgagacagtctcactctgttgcccaggctggagtgcaatgctgtgatctcggctcactgcaggctccgccttctgggttcaagcaattctcgtgactcagcctcccaagctgggaatacaggcgtgcaccaccacgcccagctaatttttgtatttttctttttttgttttttgttttgttttgttttgtttgaaacgaagtgtcactctgttgcccaagctggagtgcagtggtgcaatctcggctcactgcaacctccaactcccaggttcaagcgattctcctgcctcagcctcccaagtagctgggactacaggcatgcgccactgtgcctggctaatttttgtatgtttttttagtagagacggggtttcactatattggccaggctggtcttgaactcctgacctcatgatccgcctgcctcagcctcccaaagtgctgggattacagatgtgagccactgcacccagccaacaaccagttaatttttttgtttgttttttaatatatatagagagatgaggtctcactatgttgcctaggctgatctcaaactcctggcatcaagcgatcctcccacttcagcctcccaaaatgcggggattgtatgtataagccaccacagctggccagtatacataattcataattttaaaaggtttttgtttaagaaaatacaaaatattgttctgtttttgttttatacttatcattctatctttctctcttctatctttctaagcactgcttttttcacttgccaataagtctaatccatttgtctcctatagattttatcatttcatcctttttagtggctgcagcacattctatagaatgaatattccacaattcatttagccgtccccctattaatgaacattttgtttgttctcatttttctctattttgaatgagactgcaatgaacattcttgtgcacatgcgttcatcttgtgcacatacaaacccagttgaaattgctggggcaaggggtatgaacatttatggttctgatacacagtgacaaattgttgtccattgtggtcgggccagttcctgtcccaccagcattgtgtgaagattcccacatccctacatccttaccaacttgtctattgtcaaagtgttcctctttctttgccatcttggggaaggaaaacaatgcatcattattgtccatttcacaggtgaagaaactgaggctcagtgagcttaagcaatttgcctaagatcacatagcaagaaagtggcatggtgattcacatctgtaatcccagcactttgggagaccaaggtgggaggatcgcttgagccaaggagttcaagaccagcttgggcaacatggcaagaccccacctctacaaaacaaaaaacaaaaaaattagccaggtgtgggggtgcttgcctgtagtcccagctactcaggaggctgaggtaggaggatcgcttgagccaaggagttggagggtgcagtgagccgtgatcacaccactgcactctagcctggatgacagaatgagaccctgtctcaaaaaataaagaaaagaaaaaaagaaaaacagtggcagcaagaggacttgaattctgaacttctgcctccaaacccaagatcttgccaagatacgaggttttgctccttaaccaccacgtgctcctgagatgggccataaataaccccttcaatggggctgagggcaactcgatgcccccagggttcacaaccaggtgagacacatggagcccagctctggggctggcagagattccgggaggcaagtagcccaccacctccatggaaatcatcagggaggaaattagctcgaaatggaatcgacaaggtgctgccgccaactccgattgtaaattagataaacttgcatctgacatgatgcgtttagagcagggccactgccgggttctcagctgctcccaagcaacgagccactgggagtgaaaaataaaacaatctaggaagctacaaaatacaataatgaaagataacaggccccggaacagcgggagagaattgctgggaaattagctaaggagcaaagggtggccttcgctgttgagggcaagagagggtgaaatacagcagcaagggcagaagtcgccctcagagatgtccagtatgaagtgctcctcccacacttgccagccaggtgaccttaaacaagtttctgaagctctcagagattctgttttcttgactgtaaaataggagtccaaacagaacacacctcatagtgctattgtgaggattaaatgagatattgactagaaaggcccagggctgccaatgacagctgttcaggttgtgcgtgaaggagggcacttagctgaggctgagcagggctgcatcgagcccatcctccatgcccagaggggaaggctttcttacatttaccaaagttccctgtgtgctgcagcagccctcaaagtgcccagcacataataggtgctcaataaatgggagtgttaccatcacagctgtctgatttatttcccacccgggggctcaggccatgctgactgctgctgtgataggagctcctgtgcagaaccaagagaaagccccactccaaggttctgaaagccaaccttgcaggactgggagggatgcatcatggctcagcagtagcctgcatgagaaaggctggggctctgggaagagcagatgaaccaagggttgccatgtcctgcacctgcccaggagatgtgcactgcgagccatgtcaccaggagagtgggtgcaggaaagggagatgagggagccactgggcctggccagcagctagggccaggaggctcggggagccttaaatctccccagatggcaactctgggcaggggccatgccacctcatctaaggaagagcagacataagggggacatgcaccccacctccaaaaggttgtgctcgaaccctacatccagttttcgtgcctttccttgtgctgttctttctgcctaaaatgctcactgctggatcaatttcaccatcctcccaagcccggctcaaccctccctggctccgcaggcccccaacgctgctgggcccaggctagaagggctgactgtatcttaatcatctctgtcacccctgcctgccccagcagcaagacataattggctttcaatgtatgtcagataaattcacgaataaatgagcaagagagagccgggcctttgcctgggaccctgtgaaagagcggggaccccatcccctgcctgttcttttataattgggactggcaaggtctgaagtcagaacagtgtgttgggacagaagagggctgacagttgggcgtgatgctcctgtcatcctgatggccccagggactgcaacagaagtgaaatgtgacccagagcccaggcagagaaatgccacagcaggcacaggctagaggataatgggcttggggaagacagctccttgctaccaggagaatctccagaatcctttggccttgccagacaacctgcatggctaggattgcacttctagcccagggtcatttttaaagaaattcgtctgatcaacacgtggctctgggtccaaggctggccgatattcaggaagccaaacgcccagctagtcctcggcccgggtttgccagagccctgggcctgccgtgacttcattacctgctcacccatgtctctccccacagactgggggcaccttgagggcaggagctgggtctcgcaagatcttgcaggtccagcacccggtatatcacgggagctcagtcactgtgtgtgactgaatgaacagcagcaagcttaagaggaaccaggagaggagccccttgagaaatgtcacaagttcttctactccagcctgagtttgctcttcactggagtctgattctgctgcggatctgccacacatcagcgagggacctcagctgaagcccaaggtggactagagcaggaagcaggatgggactcgggaagaggatcagggtgtgcacgagtcggctttcgctgccagaacagagtcctaacctctcagtggccctccataccaggcatttacttctcattcttgtcgcatgagggaagcaggctggacgcagctcagctgggctctgctgggcttggccggtcttggttacactgggccccgtcccttcgcattctgggaccaggcagaaggaacagccactgtctgaggcatcccatcctcgtgacagggcagagcctcgctgtgctcagatactgcgtgtgtcccatctgctcacagtcaataatcaaagcaaggcacacgaccaaattcaaagtcatcaagagtggggccaggcattgtggctcatgcctgtaatcccaacactttgggaggctgaggtggatggatcacttgaggccaggagttcgagaccagcctggcgaacatggtgaaactccatctctactaaaaatacaaaaattagccgggcatggtggtgcacacatgtaattccagctattcgggaggctgaggcagaagaattgcttgaacccgggagatggaggttgcagtgagtcgaaatagcaccactgcactcagaagtgggacagtacacgccccttcagggacacacagcagtggtggaggggggaattaataattataaacaaagaataccatctatcacagtatgtcatttttcactctccatcctcttctctcccctattctggaaacatatgccatgtgctctgggcaggcctaaccatcccaccaatgaagcaggcacatgatctaagccagccaatcagagtactccattcacacgctgcaggccatggtgattggttcaggaatagacatgtgatataaatcaggccaatgagagccttccctgagccttttctccagagttatgggaaagcagctctcttccctctagggttgcaaggcaggtggggtttcagtgcagggcttatgaggggccacgttaatttccatagtgagcagcaccatacaatctggtagtgaagatagaaatgttctgcaccatccaatgcagtggccactagtcacatgttaaatgtgactggtacaaatgaggaactgaattttaaattttaaatggaatagagtctaaggaatcaaagagcatttggtgatatttttgggcacctgtgttcaggtgaaactgacaccacctagactttgtagttcacaggagtagataattttcttagacttgcttaaactagtagggtttccatcattagaagtaagagtcttggccaggcaccgtggctcaagtctgaatcccagcactttgggaggacaaggtgggagcatcacttgagcccaggagttcaagaccagcctgagcaacataatgagaccctgtctctacaaaaataacaaaaattgccaggcatagtcccagctacttggggggctaaggtggaaggatttcttgagtctggaggtcaaggctgcagtgagctgtgattgcgccactgcactccagcctcagcaacagagctgacacctaaggcctcagcagcagcatcacctctatttatttaaccaaactatgtgccaggcatttggctggtcacgtacatgtgtcatttcgtgagtctttcctaagcctatcacaagcccaagagtcagactgccctgggcccaaatcccaccttcacctacaattggctgtgggactttgggcaagctactgaacttcaagatgcctcaatttccttatctagccagtgtagttgatgggccatgaaggccaagggagttattacatgagaagtgcctagacccgtgccaggcaggtagaaaataatccctcatgttgactatttttattattttcatcccgatcttgaagatgaataaaccaagccttgaggaggtcaagtcacttgcaaattgacaaaagtaagacttgacaaagccgggattggaacctaggcctacgattcccgagtgtaaactgtttaccactgcctcattctgcttgtggcttttaaactctgtccacagtaacaatataacaataagaataatattaataagacttagcactcattgcatggccaacagtttaaatcctgggcagttctgcttcagagtcccagcttttaactctcagagaaaggaaattattccttatttaatgttcctcctgtccttccattaataccaaggagaaagtctcagcttggtgctgatatgttgttaatgcctctatagcacttgctaatctctcttttgaacaaagagagagccagcctcaggctcggggcagatcatactatctagaggagacataatatgccccttccttaagcctccaggcttaggcaggaactgcctctcttcacagtgctgtggtccccggcagccagaaaggcagtggctagagatgaggaggcctgggcttcagggagctctcagacgctgcagcagtgaccaatagccagctaggctctcccagcccaggtttgttttggagggtgatgcatggcagggcaccaggcgacccacatcagctgatgaacagatcctcaacctacggaaagcaccttgcctaacacgggatcaggagctgtatctgaggcctgtttctgagtaccttctccactgtggtcaaggtaagggtccttgagctgttccctgccttctctgggcctcagtttcctcatctgagaaacagagataagaatacctacccccaaagaagggtcctaagaaacaaatgagaaagtgctgtgtaaagaactgaatgaatgtgaactgttgccattttcattatgtgagtagaagtgcgttatttataagtggaatcagcagcatcaagtaaactgctgacaccagactgagatgggatcgtttgtatcattctgaattatctttgtttttgtgtctgtctgtctcactatgttttgctctccagggcagggatcttctagtccatctggcatagcaaaggcatcagcaatatttgttagatggatggattatgaatgatggaaaaatggatggctgaatgtgtagatatatgggtgcatgaagggatggatggatggatggatggatggatggatgcatgggtggatggatggatgcatgggtggatggatggatgcacaggtggatgaatggatgggtgggtggatcatgggtagatagatggatggactgtagatgaatgaatggatgagtggtcatggacagatggaagaatgatggattcatgggtgatggatgtataatggatgaattaaagatggatggatgatggatgagcaatgaaatccaaatgcagcttaggatgcaactcttgctgagtcaggattttactctggtactggatatcaactacacaacactctcaaactacaaggatagcgtgtgtgtgtgtgtgcatgcacgcacatgtgggccgtgtgtgttcacgcacgcacatgtgggcagtgtgtacagacatgacaggcatgccagctcgtgggatgaaacatcacagatggagggagctccaacaaccctgaaggaagaggaagaatgaattttccaggagggccagagaagggcctcttcagaagggaactgcttgtaaaaggcacagaggcatgaagaagctttttgaagaaagatagagaggatgttctgtggttctgcctgccagcatccctcctccccttgtctagtagcagaactttgattctccttcggggaaccagcagctcagtccgtgagtctctgttgaggctaactccaaccccaactccagaggtgagcggctgacccaagcctagcctatcagagcaccacattcctcacacctcagtggcaagcttagggatggacccaagcccaacaaatgagagccctctggggacttttactggtgccaaactgggtggatataaacctggagctgctggggccactacatgaagaggactgccagagagtgaaaccaacaaaggatgcagacctctgagaaatagaaagggaaaaaaagaggagacagacagaaggacaatgggaagttgagagagatactgaaaccagttgatgttatatgagcacctggatccagctgagactgaagccccgctacctttttcttcacataagccagtaaaaatttgtctttttgcttgtgctggtttgagctggattttgtcacttgcagccaaataaatttcccaattcatttttgaatcccaatgcccagaccaggaactcgggaccatagggataggatgggataggatgggatgggttaggatggaatgggatgggatgggatgggatgggatgggatgggatgggatgagataagttgtattgggatgggttgagatggggtggaatgggatgggattggatagactgggatgggatgggatgggatgggttgggataggatgggttgggacaggatggaacaggttgggatgggatgggatgagttgtattgagatgggttaagatgggatgggatgggttgggatgggttgcgatggaatgggataagatgggatgggagggatgggattggatgggatggtatgggatgaatggggtggaatgggatgggatggattggtatgggctgagttgggatgggatgggttggaataagatgaattgagataggttgggatgggataggatggaatgggatgggatgggttgagatgggaatgggatgggatggtttgggatgaaatgatggggtgggatgagatggaataggatgggatgggatgggatggggtgggataagatggaatgggatgggatgggatggggtgggataagatggaatgggatgggatgagatggaatgggatgggatgggatgagatgggatgggattggatgagatgggatggggtgggatgagatgggatgggatgggatgagatgggataggttgggatgggatgatgggatgggttggcatgggatgatgggatgggatgggaatggaatggaatgggattcagcctggctcataatgataaccacacccatgccatgctgagactaggaacattattatttgcactcacctattaactttcccaaagcagggtgtccaagagcttgaggctccctgaggttatgaatggatgcacccatttgttcattaatgagaggcttgaacacaaaggtggcctagaattttctgcctactttaagttctcagattctctgtggcaagctgagagacaggctcagttctgaccccagcacacggataaccctccataaacatctgttagctacattagttaatgccgccttatataaaagttaacataaatacaagattcactttctgaatgtgcgtagagctgtttctgacagacgaacctccatgccaggggcctgagagcagccactccacagagatcacgcatttcctaattccttgccttgatggcggaggggaaaaacacatgccctggggctccaacaaggaattataaccccactggaaaggaaaataatctggaagtggagaaaattagggcttataatgaaaaagcaaccagaattcattacagcaagatcacaggggaactgtatctcttgggtattcaggagacacggaagagaagagacagctccggctcttttactggaaggttcctctccagtgagcacctctgactttcagggcagaaatagctggagatgcacgaacatgatgggaaacccagaaaggctctttttcttaattttggtatccgtcagacttggattctcaccttagattaggtaaagccactgaaacaagtaagaaagcctctaggatccaaatacaagcagctgcacaatttctttccattcactacaggccatgtttgcttttgaaaattagaaaattacaaaacgaataacaaacacgaatgacaacatgcagagctggcgtagtgagagtgagacaaatagattcatacgttgatgtatgcacgacgcgctcttccaggcgtctcagcccatcctggggctggcggcttctccgttgatgtctccagcctgatcacacttctgggctctgagatgtattttgttctctccctgtctacttgacattgcctctgggctgtcacacagacagaacaaacataacccggccaggtctgaatttaagatcgcttccttcccactaaataaacaaacaaaaacctcttcccacctcagtcttctctatctcagtaatgggcacaaccatctcttcaggccaaaaatctaggagttgtccaaaatgcctcttcccctctcactccacatccaatttgtcagcagatcctattggctcttccttcaaacaatatcctgagtccatccagttctctccatcttcccacaaggccgaggcaccatcatctcacctggccccccacctgttaacccttcaatatctgcctgccttcatccattactccccagtcctcaatcagaatgcacttttgttaaatgtaagccacgtcctgtcaccttcctgcttaaacgccctcaaaggcaccccagtgtatttagaataaagtccaaattttatactgcagccaatgaggttctgcacaccagggtccctctctagcaatctgacctctctccttctacaatggccccatcagcctccatggagtacttcaaatctgcccactgcatcctaccccagggcctttgcacctgccaatccttcttgctggaccacttcttccctctcttaccgtcctctaggtaactcaagtgtcacctccttggagaagccttctccgacctcactatctgaaggagatcagctccccatctacaaccgccagagtagaacagtggatagagtgtgatgtgatgccatttattttttaaaaatgaaatattaacagatgaattctttaaaatgccaccagcggttgcccctgggagggaagtgggtgactgggaatgagattttttgtactgcctttgaattttaaaccaaggttcatgttattattccaaagaacataattaaatcaaataaaaaagaaaaaagtaaggtaggaaggggaggaggaaaggaggggaaagggagaaagagagaaaggaaaggagaaaagaaagagagaaaaaatactcttggggaattctcctaaagaggtcatgcaacaaataaattgttctgttcaagaaaataatcattgtgtattaaactgtaaggaaacaaaaaattaaaataaaataaatgtccaacaacccaagaattactcaggaaatagtgctctgtggttaagatgcagtagtatgaagccattaatattgatcattattatgactatggaaattcagagaaatgtttatggggataattaatgaaaaacagactacaaaagagtatattaagaagagaaaatcgcacagtggaaagcggaaaattgttgaagagagaagttccctagctcccatcccctcttcaagggagtccacagcgcacacacacataaatgttggcaatatctcagcccatcttagagatcagagaccagactgaggctcacagggttcccatgcaggacttgagacttgggactcatcccatcccatcccaacctattccatcctgtcccaacccatcctatcccaacccatcccaacacatcccatcccatcccatcccagcctatcccatcccatcccgttccaccccatctcaacccatcccaatgcaactcatctcatcccatcccaacccatcccatcccatcccatcccatcccatcccatcccatcccatcccatcccatcccatcccattccatcccaacccatcccatcctatcccatcctatccctatggtcccgagttcctggtctgggcattgggattcaaaaatgaattgggaaatctatttggctgcaagcgacaaaatccagctcaaaccagcacaagcaaaaagacaaatttctactggcttatgtgaagaaaaaggtagcggggcttcagtctcagctggatccaggtgctcatataacatcaactggtttcagtatctctctcaacttcccattgttcttctatctgtctcctctttttttccctttctatttctcagaggtctgcatcctttgttggacttgtcatcccatggggtgacaacacaggcaggggagaggccaaggttaggactcagggagcgcagagctgatctggtttctcagcctccacactgtggacattcagggctggatcatttcctagttgtaggagagccatcctgtgcactgtgggatatttagcggcatccagggcctctacccattggctgcctataacgcccccactccagtcatgacaaacaaaaatgtctccagatattgacaaatgtccctggggtggaggtgcaggggaattgcccccagttgagaacccctatactagcaaattacttctctgactgccagcttgtccatctgtacaatggagagaggagtgcctagcacacagacaacatctctacccaccccatgtactcactaattgcagctgtgttttattattattgttatttatagacagtgtcttactctgtctcccaggctggagtgcagtggcatgatcatttaacctcaaactcctgggctcaagcaatcctcccacctcagcctcttgagtaactgggactatggccacgcaccagcaaacccagctaatgctgtttttgtttttgtttttgtttttgttttagcggatggggtctcactatgttgctcaggctggtctcaagcaatcctcccacctcagcctcccaaagtgctgggattccaggtgtgagccaccacgcctatcctcagctgtattttttaaagtatttgtactttaaatggcttttagagtgccttttaaattaaaataaaataggtgaggatctttctttcatgggaatccccactgctagcttttcagtagcatgacttagtgacaattactatttaccatctactcatctccctcacatagacccaactgattttatagcacacatgtaccccatcacaagagcaggcagtgggggctgtaccgggaccatgtttaattaataaaatatcgggaagcactttgctactgtaagtactccatcatgataatagccccgacctccacacaagggtctttgtagcttaacagcagctcaagtcataaattgctttcaagtcttactcaaagttttccagaggctgcaaatgacaacttaagaatcagagatttcctcatacaacccctcattgcccagatggaaagtctgagctcctaccaccccagggagagtgacccatctgacgttccacagctcataaaggacaaagcggggatgacagtggttctcccagcttacggggccacttcactgcttccagaccccagtccctcaggaaaacatcattaatccatgtgggattcatttggatcagcaaactgggcccttctgaccgaaagctgagcctttgagtgggcccctttatttagaattagcccaagagtgaggcaggagtgggtggtttaggaggggaaaaaacagcttgaaaaaagttattcttcccccacatccacccacacgcaaactccccaaatcatccgtgggatgacaaggcctgggattacatcatctctcaagtgggcaacacgtacaaaatggtttaaagattctctgtcacccagagtagactcgcctggctccccaccacgtggtcacgcaggaaggcaccgcttatataaccctgtgtcaggaaactcactaccacctcccgaagctgcctgaggcccccagtgcttgccagtcccctaaaggccacaggttcctcactgcaagttcctacgactccctctgtcagagctttctcatgccctggtatgtgcccacccagcaccaagggccgactgaaagttaatgatgccttcaaccagtggtagatgggagttagtggagaaagactccagttcccccctggtctgggggacaactcaggcacgctcctcacgtctcccagggccctccactgggattccaagttgccccaggacactgcttcggctgcctctcctttcccatcactctgtcccccccttcaccaggacttcctggaatcccttcccaaatcaactgctcaaatgcaaattctcaaatcctagttttagggtcgtcttctgggagacccagccaggtagcagccaagcagccagttctgctttgagctgagcttgtttctataagggcctctccatcactgtctctctctgatggtgactctggggtcacgtaggagaaatcaggacgcttttccctacagacgtcctgatgcatttcaacacagctcccagatgtccccaggctactcccactcccagtctcctctttccttaagcatttctttaaaatgcttctttctgtagccggaaactacgtttcccacatgtgtgacagtcacatgcctggtttgtactccccagaagagtgtgcacttcacagggacaactttatctttggttgttgttgttgttgttgttttggttttggggtttttttgagacagagtcttgccctgttccccaggctggagtgcagtggtgtgatctcggctcactgcaacctccgcctcccaggttcaagccattcttgtgcctgggcctctgaatagctgggattacaggcatgtgccgccatgcctggctaatttttctatttttagcagagatggggtttcaccatgtgggccaggctggttttgaactcctggcctcaagtgatccacccgcctcggccccccaaagtgctgggatcacaggcgtgagccaccacgcccagccttgcaaatttatctttgtatctttcttaattcttagaaccacaagccattagtggatgaagaaaacacagcctcagtttcctcgtggagaaacttcttcccctccagaagacccactccagttcatcaatgtccctcttaatggaagccacccagaatcaaacacaaatgcttcaggtggtcccctactagggcagagaagagacagaccatcacctccctcatgctatatataatatttctattgatgtaactctaggtcatgctctggtttggggaaaccacttttcactgttgatacaaaataacaataacaacaatagcagcagcaacaatgtaataataataatataaaaacccacatgtatctttactatgagccaatccttattcttctatcaaattgcaatggaccaaagtcccatggagtctctcacatgttgctggactcacccattagatcctgtttgttccctctttggacctgagtatcacgaggtacatttttccatctaatatttcccctcttgggatgcagccacctccagcctctccccacctctctgaaccctaagccctcccatgactgcctggtatctacacgttggatccaagggccccaatccctcctgtaggtcatggattaaatgtaatctcatcagcaccaagaagagctactcaccatgggcttcagatctctctgccgtaggtacaattattatcccaccttacagatgaggagctaaggcacggagcagttaaacaatttgcagttccacatccagagaattcctcactgctgataaattttgttttgttgttgtgttttgttttagagacaggatcttgctctgttgcccaggatggtctgtaactcctgggctcaagtgatcctcccacctcagcctcccaagtagctggaaccacatgcatacactactacatccagcctagaatttgatccccccccaaataaccctgctggggaaaaagtattttaagttcattttacagattaagaaactgaggctcccagaggctatgtgacattccaggatcatgctcaggaagcggaagaggcaggatctgaacccacaaccccagagtccagcggccttgaggctgcccctctggagggtctcccctgaatcctccctcctttccaggtgagaaggagctggggtggagggaagtggggacgtgcatgtgcagtgtgtacatatgcacaggagtgtggaattggtactacgggcggtggggggagtctgtctccatggttaccctgagcccgaacaaaacatcacacacagattaccgtaacctcaagcatcgccatccgtcctcctggcgatacccagagagagcagactgcagggccttccaacctgcccgcccgcttctgagagcctgcctttttcattatgccatgattaaacctggcacgttataccagctaaatgttttctaattatttacagattcaccttcatggcatcccttgagataatgatcccgctgcacatttctgtaacattctgcccaccttcaaaaactcaaattgagttatcgagattatctcattgatcctcccacttaaggctctatcagatccacagagagcaattcaggttgttttcatttacatatagggatactgaggcacagatgtgcaaaggttgctgtctaggatttgactgcaaattggtgtgggggctgcagagatcatcctgggatctttttctaaccttagaaaagagagaataagtgggtttcatctaaatgccaatcctagttattgataatggctcctggtcacctgtgttaggaaggattctgagggagcatctgagatttgtagaaaaaacaatgtgatcagttaaggatgtcgaccatggggaaggaagggggcagtgctggcacccatgctgtgtattttccattccaccctatgacgtgggaaatgcccctatgaaggtttcatgttagttcccaaccaggagcaattttgcctcccaagagatatttggcaatggctggagagattcatgggtgccactggcatctagttggtaggagccatggagacttctaaaaactctacgatgcacaggattggccccccacccccacagcaaagaatgatctggtaccaaatgttaacagggccaaagttgagaatccctcagcagaacacatccacacatactcattcacacacacactcacaggcatgcacacatatgtgcacacacgcgcacacatgcacatacccacacttgcacacacacacacaagcagacatgtacgtgcgtgcacacacatgcacactcacacgcacatgcacacacgtatgcacacatgcacgcgcactacacatgcctgtgcacacacatgcacatccccacacatgcacacacactcacacatacacattcacatacacacacagatagatacacatgcacacatacgcacacaggcacatgcacacgcacacatataaacacacacacacaacagtttgggcttctttccttggtcaacagcagatcagaagtcaacatgagtatttataccttcatatgtccaaaaacaaaattcctgattttctccctcaacctgtccccgcgcccctccctcgtttttctccatctcagtaaatggcatcacccaccagcttctggagccaaaaccctaagggagacccctgactcctctccttcccctgctggcctcatcatagtcctgtcctttcttcctgcaaaacaatggctgagcccgtcacccttctccacacccatcaccatggccctagctgccatcgtctccttcatggaccgctgcagtcgcctcctaactggactccagccattcacgcctcccttcaggtccctctcccacccgagggccttttcacttgcgattgcctccgtctgaggctctttctccagatctccacagggaggctcctttttgacattccattctcaagagaaatgtcacctccccagaggcctccctcttctcaatcactctccatcccatcacttctcttttctttcactgtaattctcatgctctaaaaccatcttatttgcttatctgttgcctcaccacatactcccccagaattaattacgaattcggaagagtagagaccccatcttgttcaccactgtattctcaacatcaataataataataatagaaaaaaatggtgcctggcatacagtatgcactcaaaaaaagtctaataaatgaacgaatgaatgaaatgtcaaggacggatgcccttccagcaacctaagaagagacccgcaggacatgaagatgctctcagagcccccaggcctgagagccttccctccactgggctctggcccctctgggcttgcaggcaggtgggggaacttgcaggtggctctggagccccacatgcccgccccaggcagggtagtgctgactggccgccagggcatctcctagaatcagttcaggttcagccagacactccttttccatccagtatccccatcccagaccatctctctgcgttccgagggccttattcagaccccacagcagcaaatgtgtgctgtgcactgagcctgtgccaagtgctagggtgaggactgcacctccgtgtcctctcaatctcacatcaacccctaagatgtttggtttttatgtccatttcattgatgggtaaaatgaagcactgttagattgaaccattttcttaaggtcacacggaggtagcaatggaagaattcctcgcaggacaaagacccagtgtatcctctttgatccctgatagctatcaggataaagatactgtatcagagtctgggtgtgctggctcacacctgtaatcctagcactttgggaggctgaggtaggtggatccctggtgctcaggagtttgagaccagcctgggcaacagagtgaaaccccttctctacaaaaaatacaaacattagctgggtgtgttggtgcatgcctgtagtccccagctacttgaagggctgaggaaggaggattgcttgagcccaggagatcaaggttgcagtgagctgcgatcacaccactgcactccagcctgggtgacaaagtgagaccctctctcaaaaagaaaaaaaaaagatactatatccggatggagtgcctgatataattctaatgtacatccagagcttagtagtagtcgtggaatgaatgagggaatgaatgagtaaatgaatgaataagtggaccacaactctactcacaactttttgatagtaagtcagtgaagaggtctaccacactcttccctcttatttatccaaacctaacagatctccccaggcctggcatttactcaaaaatagagcaggtgggttacctgaatcgtctcacttttcacaaggttgctgttagattcttcctctcatagcaccagcgtcactgctggttggcatttacgtcactagactctttgcaactcaagatgcaaagcacattcacttaccctctcagcctcgtgccctcgctgggcatcgcagatgttgaatggctggaagtttctgagagaatcgctccaggatcgctcatccccctggcttccatccactcaacatcttgagctgcaaagtaaaactgggcaaagacgtggagaaacgtgggaatagtgcatggagggaattgtggttttacattcgccatttctgttatgaaaggaactacaagcatccttcaaataacatgcaggtcttgcttttctttccatgatcacatcaccaggaggtgagagggagatcctatctccagctagtaaagtcataaaatgggctgggcgcagtggttcgtgcctgtaatcctagcactttgggaggccaatgcaggtggatcacttgaggtcaggagttcaagaccaccctagccaacatggtgaaaccctgtctctactaaaagtacaaaaattagtcgggcgtggtggtgcacgcctataatcccagctactcaggaggctgagaaagaagaattgcttgaacccggggggcggaggttgcagtgaactgagatcactccactgcactccagcctgggcaacagagcgaaactccatctcaaaaaaaaaaaaaaaaagtcataaaatgtaagtaaatcccaacaacagagaaatccatttagtaatgttcatgctaaccagcagtaccattggagatatgtcaggaagattccattgcaaccaggtgaaaggcgagaagtatcaaagagaacccactcactctatttatgagcaaagggtaggcctaaagagatctttccatacagaaaagaaagggggaaatcattgcaaataagacactggggacaattctaccacctgaaaaagaggaaggatatactcaaggtagacaataaaagcaggtccttgagacgtgcttgttagaggaaacacacaatcattcacgaaagcatgtgtttgcgtccctaagaaaatataaactctatcacgaagacttggcagatcggaagatcagacaacagatttagccaaggagagctgccaggaaggcaggctaggtgaagtggaagccaaatggggaaagcacgggctgaaaaggagctaaaaatgcaaacgcagagcgaaaatacacatttgaagccacaaggagcagactcaatcctacggaaaattgaatcaacaatgtagagtgttagtggcaccgagctccagaaagttaattccctgccaaagacgaggtattttgatatgagtcatggacataattaggtacaacactaggggcagagagaatgtttctttcttttctgtgtcttttctgagatggaactggaactagggcctagagccttctctggctttggtgaaagtgcctcctttgccatcctttagaagacgaaacagaagccaggctggaacccagagggtggaaagcaaggacgagatctctcaggccaggcaaaggcatcctcaaagctggtctagcagagctttgatcacgagcatagaaaactataaaggatttgaggctcggagtcctctctcaaacattcagaggtaccaacagctggaggacgaactttctaaactattttggaatacaaaagaaggagtcaaaaggaacattaaaattatgacagagaaaacgagagacatagaggtcagaggacagaaagcaattccataaataagtggtgtccctgaagatgggtagcctgcatggatagcctggatggatggtatgaaatagtaggaactggaataggagaaaagtacacttaaaatgtaaaagtgtacccagaacactgacaacatcaaatgctggcaagcatgtggagcaacaggagctcccactcagtgccggaggaatgaaaaatggtacagccactttgaaagacggtttgggccgggtgtggtggcacacgcctgtaatcccagcactttgggaggccaaaacaggaggattgcctgagcccaggagttcgagaccagcctgggcaacatggtgagaccccatctctgtaaaaaatacataaattagcagggcatggtggcacatgcctgtagtcccagctactcaggaggctgagatgggaggatcgcttgagcccaggaagtcaaggctgcagtgagccatgattgtgccattgcactccagcctgggcaagagagtaagatcctgtctgaaaaaaacaaacaaaaaaaaactgtattaaataacaaaaatgatgataatacaatcaagtcttcctaagctgacctcaacagataccaggccaattaaaaacccaacatttttgggaggtcgaggcaggtggactgcctgagctcaggagttccagaccagcctggacaatatggtacaaccccatctctactaaagtcacacaaattagccaggcatggtggcacacgcctgtaatcccagcactttgggaggccaaagcaggaggatgggaaagagagaaagagagaaagaaggaaagaaggaaagaaggaaggaagacattttggcagcttcttacaaaactaaatatacccttaccaaactatccaaaaattgtgttccttggtagttagttggcgttaaaaacttacacccaaataaaaagctgcacatacatgtttatagcagcttgattcataattgccaaaacttggaagcaaccaagatgctcttgagtaggtgagtagataaactacagcacacccagacgatggcatgtattatcagcactacaaagaaacaagctatcaagccatgaaaagacatgcaggcaacgaatgcttttttttttttttttttgaggcagagtctccctctgtcactcaggctgaagtgcagtggcacgatctcggtttactgcaacctccgcctctgaggttcaagtgattctcctgcctcagcctcccaagtagccaggattagaggcgtgtgccaccatgcctggctaattttttgtatttttagtagggatggggttttgccatgttggccaggctggtcttgaactcctgacctcaggtgatctgcctgcctcagcctcccaaagtgccaggattacaggcgtgagctaccgcgtccggccatgaatgcacattgctaaatgaaaaagctagtctgaaaaggctacatcctgtgtgattccaactctatgacagtttttggaaaaggcaaaaccatagagacagtaaaaggatcaatggttgccaggagtttgggggaaagaaaggacaaaaaggcagagcatcggggattttttgggggtagtgaaacgactctgtctgatactacaatggtgggtccatgtcattacacatttgtccaagcccacagaaagtgcaacgctatgagtgaaccctaatgtaaaccgtggactttgggtgatagtgacatgccagtgaaggcccatcagttgttaccaatgtaccactctggtgggagatgttgataatgggagaggctatgcatatgtgaagaaaggggggatatgggatgtgtcgatactccatgctcaattttgctgtgaaactaaaactgctttaaaaaagtgtattggccagaagcggtggctcacgcctgtaattccagcactgtgggaggccaaggcaggaagatcacttgaggccaggagttcaagaccagcctggcaacatggtgaaaccctgtctctacaaaaaatacaaaaattagctgggcatggtggtgcgcttctgtagtctcagctacttggggggctgtggcaggagaattacttgagcctaggagccagagaagttgcagtgagccgagaccacaccattgcaccccagcctgagcaacaagaacgaaactccatctcaaataataataatacaatcaagtcttcctaagctgacctcaacaagtaccaggccaattaaaaacccaacagttttgggaagttgaggcaggtggattgcctgagctcaggagtttgagaccagcctgggcaacatggtgaaactccacctctactcaaaacacaaaaattagacaggcatggtggcaggtgcctgtaatcccagttactcaggagtctgaagcaggagaatcatttgaacccgagaggcagaggttgcagtgagctgagatcacaccattgcactccagcctgggtgacagagcaagactctttctccagaaaaataaaaattaaataaaaattaaagacccaacatttatatattccatcatgaaattctctattttgaagatgaatgggaaaaatcatgtaggatttcaggaaaaatattaataatgttgtccataaaggaacaaaaattggggctgacctcagacatcacttcctcatcaccagatgccaaaaaacatggacagctgccctcaggatattgaggggaaaggtttaaacctgtggagtctgtgcccagccacgaggccatacacatccgcaggccgttagctattgctaggaaaacaagcactggggagtgtgccacatgcattgaggaggaagtccactcttttttttttttttttttttttttttttctgagacggagtctagttctgtcacccaggctggagtgcagtagtgtgatctcagctcactgcaagctccgcctcccgggttcaagcgattctcctgcctcagcctcccgaatagctcggacgacaggcgcccgccaccatgcctggctaattttttgtatttttagtagagacgggggtttcaccgtgttagccaggatggtctcgatctcctgacctcatgatccgcctgccttggcctcccaaagtgctgggattacaggcttgagccaccaagcccggcccgaaatccagtcttcgtggccgtctctgcttccactcccgcatcaccgctccctggctcccaggctcactgcactctggcgcatcagccttgtccctgttcctcaaagtcgccctgctctatccctgcacaaagcctgcgcaaagcctttgcacgtgccatgtcctctgcctggacacggtttcctctgatcacctgtggccgacttcctctcagtcttcaagtctcactcagatgccacctgctcagagagggaaaagtttgcttctttgtgtatcatgcacacgcatgcacacacatgcacatgagcacaaacacacaactggaagttccatgaggacaggaacctagtcatcctcttcactgaatccagcttccatcatgggacccagcacgtggacagtgaccagcccatagaccatcatatcttgcgttcaaagccaaccagcacccatatgaataaaaacggggaaagtttacgaaagggacttgcaattagccatgaaaccagttaagcatggaattaagttgcaacgattatgacacgtatgaataaaaaacagaattcaagagcaactaattttctcatcctaccaggaaatatgcaatatatgctgttttgttcttcataattataacaaaaatggaagtccaagtattaaaaacagaattaatatcagtatgcatgctttttaaaacattagtaaagaaaaaaagaagcaaaacctaatctatatagtaaaagattaaaaaaaaactaaaaattgggaacattcaacaaaaagaaagaagtgaaagaagtgaggccaagtgtatttgttatagaaataaatagtatttgtttaagactctcggattgtaccaaaaaataagtaaataaagctaactctatgttcttaccagatattcacctaacaaaaagacatggagaagttaaaataaaaagtctagtaagagatatatcaagggaatacaaacgaaagaaagcagggatagcaatattaaaatatgaaaaaaataggatgcaaagtaaaaagcattcactgggggaaaatagccattttatcttgacaaaagataaaatccacaattccgcaatgaaaatataactgtcaagaatcttcttgtgatgaacaacatagactcaaacttttttatgaaaacaaaaactatcagaaattcaagtaaaaatgggaagaatcctattgaagagaaagagattaacctacctcatccagcttttggcagataaagggagtaaagataaataaatgacaatttagaggctgggtgcagtggttcacgcttgtaatcctagcactttgggaggctgaggcaggaagattgcttgaggccaatagtttgagaccagcctgggcaacatagtaacacctcatctttacaaaaaaaaaaaaaaaaaattttaattagccaggcatggtggcatgcacctttagtcccactactcaggaggctgagatggaaggatcacttgaacccaggaagttgaagctgcagtgagccatgatgttgtcactgcactccagcctggacgacagagcaagactctgcctcaaaaatatatatataacaatataaagcccttaaataatactatctataaaactgctttaaactgcacacagggaatgtacctgctttttcaaataaaacatttacgaaaaaaaaatataaggcagaaattgcataggctactttctctatcattcattaaattataaattaatgacaaaaaattaagcaaataagacaaggcactgggatttttttaatagacagagtctcactatgttgcccagtctggtctctaactcctggtttcaagtgatcttcccacctcagcctcccaaagtgctgggattacaggcataagccactgcacctggcctatactgggaaatttttaacgttctactaaattattcttggatcaatgaagtaacaaaatcaaaatttctgaagttttagaaacaaaattgtcattgcataatttttagaaaatcatctgaaagaaagcaccacattttaaagcactgcactcataggatatggctaaagtggtgctcagaggcaaactcatagcattaaatgcattcataattttttaactatgaaaaaacaaagttttcaatgtaaaaacttgcaaacattaacaaacctcagaaaagtcagactaaagaaaactaggatgtatcagaaaattaaaaaaacagaatcaataaatacaagagtaatgaggcttttttaaaaaagatggaggagggggcaataaaacagctaagctggcaagacctgggctggagaaaaaaagggagaagggtagaacaaatcaggcctggggcctgaggatgcgcagtctcagtacagatcctgtgtaaaggtttcaagcctgtcggctctctctggaggtctggaaagcaatttttacagggcccatatcaccactggtagacttgagcaagacaaagccattagaaagagaagaaaaaccacaacatacacaggagcaggaatgagaaaaggaaactcatcaaagagaggctttttctttaaatccttttaaattccttttaaaattccttttaattccttttaaaaggaatactatgctaaatagctaaaatactatgctaaattttatgcaaatacatttgcaactcttgatgaagaaattattttctgagaaaagacaactcactaaaaattgacttaagaagtagaaaactggactgtgtggtagctcatgcctgtaagcccaacactttgggaggccaaggcaggaggatcacttgagccccgaagttcaagaccagcctgagcaacatagcaagaccccacctctaaaaaaaaaaaaaaattaaaaattaggtgggcatggtgacacatgcctgtagtcccagctactcggaaggctgagatgggaggatcacctaagcctgaaaggtcaagacttcagtgagctgtgattgcaccactgcactccagcctgggcaacacagtgagaccctgtctcaaaaaaaaaaaaaaagaagaagaagtggaagactaaagtgatcaatcagcaaggactaacttattctgcttagaatcctcccctgtactcccccaagaactccatggctgccctcttacagtcgttcaggactcagttcagatgtcaccttgtcaaagaagtctccccaacaccgtatgcaaaactccacctgcaagagctacctcatgactctgtttcatggaattcaagcactacatctctatatgaaattattgatttatctacggtttaacttactcattttctctctctccactggaaggaagctccttgagggcaggaaccttatatatgaagttcacctagtaaacctggtgcctagaagaagacctgggacagaataggtgtttaatagatgtgatgaatgaatgaatgaatgaatgaataccaaaggagacaagacaatttccaaaaactccttccaaatgacctcttattacaaaggagagcaaatcttttttttttttaagagtcaaggtcttactctgccacccagcctggagtgcagtggtgcaatcacaattcactgcagccaagaaactcctgggctcaagggatcctcccatctcagcctcctcagtagctaggactacaggtgcacaccaccacgtctggctaatgttttttgtagagatggggtcttgctatgttggtcttgaactcctcacctcaagcaatcctcctgtctcagcctccagaagggctgggattggaggcgtgagccactgcacccaggtaggaggacagatccttaaagaagggctggaattggaggcatgagccactgcacccagctaggaggacagatctttaaagatagaaataggtatcttggaaaatacttcaagggttggaacaactcggccagcaggtaagggtttggtgccttttggaaagatgaccttgggtctcaaaattctactccatcaccgttagagaaaaaatgtaaagcaggcttcaaaagtcacaaagaggttatggcttatgctgtcaagagcctattagccttcaccaactcagaggagcccaactgcttcctgatcccctgagttccaggggtcatttctgatctgcaactggtgacatataagccaccatcaccaatgtatctgttctcattgtctgtcccctccagaatgcaagctccataagacaaggactgtccgctttgtcccccactgaatccacaagtaagggcttaataaatttaggttacatgcgcaaatgaagaaaccacctcctgtcgtctgtcttcctcctttggaatggaagctccatgaaactaaaaccctcattcgtcttgtttcctgctacagtcccctgcacctagacaaagcctagcacatagtaggtgttcatgaaaatgaatgaaagaagggatgagaatttgtagactctccttctgagtcaacccaagtgttcattacctaccagtcccaggaaatttggcttttggttggagtgggcattttttgaataacagctattctgaccaacagggcataagtcagaaaactgaaggtcaaggtctagcagaaccttaagggatagacaaagatcagcaactagaaagcagggctccaggttctggtgccagttctgccggtgactaggggatggtttggaaaagggtctctccctgcagagacttgcatttccttgttcataaaacaaagtgttgattttcagacagtgatttgcaaaagcgtgggttgcacatcactgaggcattgaggtagatcgagcaattggcagcatgtcaggtagggggaagtgttacgaaaaaaaaaaaaaaacaagctgcgtagtggaataaggtggggaggtgactgcgactttaaatagggtggccaaggaagacctcattcacaaggaacgtttgagggaagtgatggtgtggaaatctggagaaagagtttcaggctaagggagctgcacgtgcaaaggccctggggcaggagcatgcctggaggtgtgtgtgcaagaggacagtggggctgcagcatagacaacgaggaagagcatcatgggagatggggcagagagtaacggggcaggtgatggcaggtcttgtagctaccaggaggacattggctttaccaggaatgacatgggagccattggagggtctgagcagagggactccagcagtatgcagtaggattgctcagcacggtgggggataaacagaagcaggatgaccagtgagtgggatgctggagtcatccaggccagagacggtgcaggctcagaccaggggggcggaggagacggggagaaatggtgagactctggatgtgtttgggaaaagagtcagcaggatttgccaatagattaaatgagctgtgtgaggatgagtgtgtgtttgtgtctgtggggagagagagaaaggagtcaaagatgactccaaggtcttttgcctgagaaattggaaagatggagctgtcttttgttgagatggggctaagagaggggcaggagtggggtgtggaggagtcatctgtgccaccaatgttcaacctgttatcagtgttccctggtttctactttcttttttttattattattaaaaaatatttttttagagattgggtctcgctatgttgcccaggctggtctcaaactcctggcctcaacaaatcctcccacctcagcctcccaaagtgcttggattacagatgtgtgccaccctgctggccccaggtctctgctctctaagcacatagtaggactgaaattctccagtccttgaaaaggtagacatggccatgtgatttgctttgaccaatgagatgcaagcaggatggtccgtgccacttctaggcaaggactcataccctttcctgccttgacagccatggaaaatcagagatggagcatcctttatccaggtccccagtgaggtcaccatgaagtagagccccccactgacctgctatggacatgtcacgggagtaagaagtcaactagggttgtctgcaacctcccacatctgcagattgctgcagatagctgcaacagcatagcccaggctgccctggctgaggagggcagaaaacagatgattaggtagggacatgttaatctgagatgcctgtgagatccccatgtggagagatccaccaagcggagacagtgactcgtgtccaagtcttctgcctctccgccccgcccaactgtgttctggagagggttttcctcctctatgccccttccaggaccacccagaaagtctccctcaaggtggggcccgggccaagtggagctgcctgggacaaggctggcagaggggggcagagagtgtggccagtggtgtccaaggggctggaggagtggggctttcagcctcccatgccctcttccagaaaaggatcccctgtagagaaaccagggtggagagaggcccagagagaagggggtggcatgcagacatagacaaaggggagcagaagccccacaaatgtgtccagaggggacagaggcaatcaagttgacttagggagaagctgcttcccacatgccacgtttgcttagagtgtgaatgactaataaaaatagcactgttttcctaagatgtttgtattcttctagtcacactttacagaagacttctttttgttgttattattagcgtattattattattatttgggcaacatgaagaggggtcagtgatgaaacgaagcccccatcctccaaacactgcacccacccactgctgccaactgggaggacagagggggactggagggcagagtcagatgagggagggtctggtcttcttcatccgtctggatggggcgcagccactcccccggggctgaggcctcaaggagtcacttcccctgtaggggcctcctggaaaagagcaaggcgaggcgggaagggccacgtgtgctgctaccgcctcccctgggctatttcgggctcccctcgctcgcctctctcctctccagcttctcgggcaccctcctccctgtgtgtgagtgcacgtgcacatgtgtgtgtctgtgcatgcatgcgtgtgtgcacacacgtgtgtctctttctctgcccacatatttctccctttctccatctctgtctgtttctgtctcattgctgctctctgcatctctgtccgggtgtgcacccaatgcggtgcacgtgcctcgatctccctttgcgtcttctcatctctctctgggtctctgtgtctctgtctctctcctcgctcgctccctctgtatgtgtctgcctttctctctgttggtcactccttctgtggtcccctcggtccccctcgcagcctccctctgcatccttctcagattctgtgtgtgccacccgccctgcgtctgtcactccccactcctcacaatgtctgtgtctcctgccctcctcctcccctcctcccccgtggctatctctgatgcacactctgggaggccaggacatgggacaaggctgccacggccactgtcctcgccaagctccagcccaaatacccaccccagctctgcttccagaagcaccgaccctcctctacctccatcacctcccatccccagtccccaccatcggggaagaaggacggcccctgagaagggaccctgccccctccaggcaagcttggggccaagtcctcttccatatctcacccacatcacccacactttgggaggctgaggcagatggatcacctgaggtcaggaattggagaccagcctggccaacatggtgaaactccgtctctactaaaaatacaaaaattagcccagtgtagtggcagccacctgtaatcccagctactcaggaggctgaggcaggagaatcgcttaaacccaggagacggaggttacagtaagccaagattgcaccactgcactccagcctcggcaacacattgagactccatctcaaaaaataataataataaaataaaataataaaatattattattacaaatatttttacataaaaagaaaaacaactgggggctgggaactcaatcctgtcaagagcaaaactctggcctagaagttgcaaattgacgggacaagggtctacccacccctcgaaagtgttttattttggcctgcagatcagatgtctttaaaaaaaaatggatttgctgccaaatgtgaacaatcaacagatgtcatataaaaactgggagttttgaacaaaaatggaccactaggcactccacgagccaccccctcctgcagtgagaaagcttctggaactacacagcggttgcccagcccccgcaggccccctactccttcctcacgtcactctcgtaggtttccaggctggcctctgtgggattttagttggtggctctggacccgagggaaggtccagcctccaggagcccagtggccctggctctggcctctgaggggtggtgatttcacctttgctgcagcattattctatttttatttttatttatttttgagacagggtctccctctgttgcccgggctggagcacagtgacacgatgacagctcactgcagcctcaaactcctgggctcaagcgatcctcccacctcagcctcctgagtagctgggacttacaggcacacaccaccacacttatctaatttttaatttttttgtagagatgggggtcttgctatgttgcccaggcttgtcttgaattccccaagggatcccaaagtgctgggattacaggcgtgagccattgtgccgagctagcattgttctaataaactcccccttttattattttttttaatttttttttttaagacggagtcttgctctgtcccccaggctagagtgcagtggcacgatctcagctcactgcaacctctgccttccgggttcaagcaattctcctgcctcagcctcccaagtagctgggactacagctgcctgccaccacccggctaatttttatatttttagtagagatgggatttcgccatgttggccaggctggtcttgaactccagacctcaggtgatccgcccacctcggcctcccaaagtgctgggattacaggcatgagccaccacgcccggcccattccccttttattcttatctggggtcgagtttgtttccatcacttgagaccaaaagagcttaacctgcaccgtcctgaaggcagcagaggcccgaggttgcagcatcctcacaagacagctctgagtctggcaccccagaatttaaacacgggggagtgacgtgagctccccacaggatcccactaaacacctctccttggaaataaaccaagagagggagcagggaagaaagaagaacatctgacaagtccacgggaatgacaggcacggagtagagagccccggcctctcgctgcccacagaagccctgagaagtccccagagccccagtacattccacaagtgttccctgagtccctcctgaaaacttagtccctgctgtaaagacacatgcacaggcgtgtttattgcagcactactcacaatagcaaagacttggaaccaactcaaatgtccaacaatgatagattgaattaagaaaatgtggcacatatacgccatggaatactatgcagccataaaaaaatgatgagttcatgtcttttgtagggacatggatgaagctggaaaccatcattctcagcaaactatcgcaaggacaaaaaaccaaacaccacatgttctcacttataggtgggaattgaacaatgagaacacatggacacaggaaggggaacatcacaccggggcctgctgttgggtggggggaggggggagggatagcattaggagatatgcctaaggtaaatgacgagttaatgggtgcagcacaccaatatggcacatgtatacatatgtaacaaacctgcacattgtgcacatgtaccctagaacttaaagtataataaaaaatatatattaaaaaaaaaaatcttggtccctgtcacacggtgctgcctccgagagcctggatgagctgccatgctgagtcctacggcattgaagtgtcagctcatctaggctctgggggcagcacgatgtgaccgggacaaggcttgtcctcagggagccagcgtcccagcagggagatggatgatagagagaagacagtgtgatacgcagtgggtatgacctcgatcagagcagtggggacatcaggggtgcaggggagtgccggcgggcagcaaggcggctaatttcagtggggtggtccaggaaggcctcacaaactggaggacatttgagcagagacttgtacggggttgtcttatggaagagttcctggaggcaaggaacagcaagtacaaaagcctcggcctgtcaaagagccggtaaggaggccggtgtggctgaagaagagtgactgtgggggcagagaggagtggggaagggcaggaggcagcagagaagactgcagacttcctggcagtccttggaaggcattcgactgtgactgagtgaggaagggtccggagtggggaacgggggtgatccgcctcagatggaacagggaaccctccagccaccgggtggagaaacggaccatgaagtcaaagccaggagcagggggagctgcggggcaaggtgggacgcactgggttctgattgaccggctggcaggttggaccaatggactaggcatccaaactgaggtttggaggcctgagctcctagaagggaagggcggcaattcgtgtaaactgagggcagaactggttggtgggggggcaccgtggattcccccaaggggcagctccactcactcccattgggagtacagactccatctgccaagttttcaagaaaagccataaatccagatgtttctatgaagtggctccatattcaaatgttggcaacttattcaaagacactgggaacactgcagggccaaacaaaacagatacacggttcagatgtgatgcacgggccacctgtctgcagcctcgggtcagatggcagcaagtcccatttaccaagtgctggctgtggccagtggagtgctgggaccacgttatctggatcaaccccaacgatgctatcatggggcagataggatcatcctcatgccccagccaaggaaactgaggcccagagagggcagactcctacccaaggccacacagcagctggcagtagtatgaggactagaatctggaccatctgggcccaaaccctgtgatgggtcatgggacagggctctgtcacctccatcatccacacaaaacactcaacaaaacctccattttacacacaaggaaagaaaaggccagaaagagagggagtgtgatttctctgaagccactcagtaagttggcatcaaagcctggagccaaacccggggctcgtgactccagatgcagtgctccgcccaacgagcctggttggaggaacaaagggagcctgagtgagctgggctggggagactgaggagcagcacagcacagcaggcaagagccaggctccggagcctcccgcctgggtgcacatccagctttgccacttactagctgtgtgaccttgggcaactcacttcacctctctgtgcctctgtttactcacctaggaaatgagagcaaccacggcacccacctcgtagggctattatgcagacaaaggaagttatacttgtcaggccagccacagtggctcacgcctgtaatcccagcactttgggaggccgaggcaagcggatcgcttgaggccaggaatttgagaccatcctgagcaacatagtgaaacctcgtctctacaaaaaatacaaaaattagccaggtatggtggtgtacacctgtggtcccagctactcgggaggctaaggcgggaggatgcctgagcccaggaggtggaagctgtagtaagctgtgctcacaacactgtactccagcctgagccacagaacaagaccaaaaaaaaaaaaaaaacaaacaaaccatgtcgaggagttagagcaatgccttccatcatgcaaatctttgcccaacagatgctcccaacatgaaacacatcgaatatgacactaacatactcccaagcaccaaaaacctcccggttggggacatcacaggggtcctcatacttgtgacactgtagcagcataatttaggggactgggcagaagagctggggttctctgttcaaaataaaggaagacaagacaggtacagggaaggctagctggagacttgactctgaatgacaggagggcagtcagaggtgctgtgccccacatctaacgatgactcggatgctgggtgcaggatgaactggggagtgggggtgatggcagaggcggagagatggctgcagaagtccatgggagacacgggtggctgtgggtggctcagcccagggtggcggcaacaccgaggtggtgctccccactccctgccctacgtcaccaaatccttgcatctccggcgggtgctagctgctctgatccccacctacacagtagccctgggagtttcctgcctgaaaccacgctgctagtaagaggctgagcccagccttgaacttccaccagttctacaggggagagagtttttgagtttgaaggaaacatgctccttcctaccccaacgtctctgggactgtgggaggggccaccgcggtgtggggtgtgttggctccccgcctgggtcctgcatgggtcttctggcttcacacccaccccgtcaccacccagccctgggactggtctctctcttctctctccagtctcacctccctcctgccagcctggcaagtcccccaagacccctccacctccccccaatcttcccaagccacccctttcctgcggctcaaaagcatacaggatgaagtccaacgcatgtggacgtcacctgtgctcccagctggcacaagctcccacctgccccaccatcgcccctaacccagaccttcattctcccctcctccaggcctctcctcagccacccccaccacactgactagaacgatgcttgcttctgctccccaccaaacccctccccagcgtctcaaccagaagagaaatccaatttgtgtgaagggcttggggtgactctgtgtcgaggccacgcttccctttctgtttgtggaaggacgcgggtgctcttcttggagcaaggagaaaaggtttctttgtgcagggtctggtgaaagtgtgtctgtttagggcaggctgcagttttctttgtgaacactgtagatttttagtgtgggaaaaagggcttattacatttccctgtggctgcccgagtggggagaggtttttctgagcctagaaaggaatggccgaacaggcaaacaggcgttggagaggagggaacatttagcagctccttctcacggagcggtgaggatctcctggttggtgttcgcatttggatgcacgtgaaacacacagaaggaaagaaagctttgctgtagtttgatggaagggagggaagtttagccttgatgtataggggtgggggaggcgagattttgttcagggggctattgggatgtttttttcctcttcgagtaaaaaaataaaatagtcacagaacccagaggaaaggttgtcatggcaacaaaagtttgaggccaggtacttgctatcaccctttcaggaccaccgtggtggagaaggcaggattttggcactgtaggatcagctgcagaaaccaccccagctggctccgattcccaaatttctcaccagcactgacaagctgataactattttccaagctctcagagaggaaaattgtgattttgggggagggatgatctccagcccacagtggccaagaggaaactgggggtttcttttatttatgcaacaaactaaccatccgcatttctaactgagttttgggagtgagggtcttaactgagtcccccaaaatgccaacttccctgacccctcaactgtactattctcttccgcgatcccttcactctgatttctttctgttcccgagaaggtaattccagctcccttgccagaatcccctgtgagcctaagttcctcatctgaaaaagcaagtaccctagaagtgtctgcctcaaaggtggcggccaggattcaacaagattcaggagatgagaagtttcagcaggacctggtgaacgttaaaggctcaataaatgttagccaacattgttttttaaataattttcaattaataattttttaaaatacttaaatatcccaagtcaagccctgaaagaactacagggaaataattgtagcaagtactgggaccgtgaccttcagggagcagccaacagagactccaaacaattaagaggctcagctgagcagcttggaccaggacactccacagaggtagagacaggaccactccggtgccagagatgcctcattgtattttcaggtgtgtgcacagaggaagggaggcagaggtggtatctccccagggctgggtctcctgagccttggaaacaccttcttgaacttggagaaagatgtacagtagcaagatgtctacctccaaggacgaagatgttcctgacaacaaggtgttacgaggcctccgtgtgagagattagggttgggctgtgcggaaggcagggaattttggccaagatgccttttgaagttaataattttaattgcatcccacagtaaacatttgagtgttgagtgtaaaccagaagtgggtctgatgggatgaaaccaatcaggggcaggtccatattcaaacaccatgtatctctgacaaacggccagcctggctcaagtcacagaaaagtttggtcagccacccccagaagagagacagaggaggcagcaccgcaggaagcctccggttcatcatcccaaccccatccagtatgcacccggcaaatgtttattgaagacctactatgcgctagacattactgggaggcagcagtgaacaagaccaaccgggctggccctcacagagtgacatcctatggggagtggggactataagctagtgaccaaaaacaggccccagaaaatgtcagggagtgccaagtgtggcagggagataaacgcagtggtgagatccaaagatggagaccctccctccaacggggagctcacaaggttgtccctcctcagtatcctgacatggaaggcaggtgggagagtcccagtgaaaggagcccctgaagaaggaggtggggcggggaagggcattccagacagaggatgcagcctgtgcagaggcctggagcttttcactgggttcgcttcacagcttcctccctctgccctctaaaccacttaggccactggcttatttagggcaaactaagggtggaggtctgctgtaacccacccttgagcacacacatatgtgtggtgtccacactgaggagctaggcatgcagggaggagttttaaccttggagaaagaggtcaattcactcaggagggtgtccatgcctggacacccgctcagagataccacgtctttcgggccagctctacctgctgtgtggcacaaccagctgtccggcagctgtcccctgggccctgccacagcccggctgtctgcctccaaaacacgcactccagcccaggctgcctctggagggtagaggagggggtccaggcaaaggggacagtctgatctgccttctgaaaagtcagtcccccaccgaacctaataggagccttgtgctaagctaagccctcctggactcctcgacccggagtttgcccagctgtccccagttccctagcctgcctctcccaggagggggccaggatacagagggctccctggcgtctggcaataggggtgcctctgggcgggtgcggctttccgggagcccgcgggactcccccactccccactcccgtctgggaggttcggcgtgggttggcgatgggggtggaaggctcccgggtctgtggatctgcggcaggaggggcggctggtagcaggagtccctgcatcacccccacccccaggggcgttccggggtgggtgggggcatctagtgccccgcgaaaggaagaggaggagggggcgagcgtggagatgagttcaggagcggaaagcagcgcgcgcccctccgaccggcagcgggggtgggcgccttcccggggcgcgggagcgtccccaaagccgcggggcgtccgcagcgggtaggagctctgccttgcacctctccacggcggggcgtcccgcacgtccccccatgctggtccccggccccggaacggcgcgcgccccctgccccggaacgtcgcccctagccaggcggagcgctgggagctgggcccaggcggcgggaggagggcgaacgggtccggggctcgggcctcgatggccgcgccgccccgggggagccggagccgagctggccgccgcccgcgcgcactcaccaagcccgctgagctcctcctcgcacgagtaccagatgccggtgtggaaattcctgaagaggaagcggtcgtcgccggtctcccagctgtagagcgcgccgccaggggggccgttccccgaggcggtggcggcggcggcggcggcggcgggggcggcggtgccgttggccgtggcgttggcgcccgagttggggcagttggcgcgcccgccctggccgcagcccggcttggggacccgctgcgtgccctggcaccagtgcgtggtgaggaaagcggtggtggcgaacagcagcgccagcaggttcagggccacggccaggagcgctcggccgcggcggctagtcttcatgccgcccgcgccgccgggacgggactgcaccgccggggagctccgcgcgcgaagttggcagctggcgccccgcgtcagcggccgctgcccgccgcgccccggggctcgggtgcctgagatcggcggcggcggacgcggcgcgggcccatgccccccccaaccccggggtgggggcgcggcgcggggggcgtgcggggcgggctggcggggcgggcggcggtggaggagcggctacggcgcgcccggagcccggagcgcgagtgcacctcggctaggagccgctggcgcctggcagcggccacggcgcagggacgcgcgcccctccgtggggagacacctgcaggcggccggcgacactgttccggagcccgcccgcacggggagagggggccgccacgccgggcgcgggcgggggcctgggagtggagggacgcccccgaaagaaatccgagccagggtgagggtctgagacgcaaggagaatcccaggcaaggcgctcctgagaaaagatccccacggcggacgtggggcaacaaaacccgccgggagcgggcatctcatgagacccagagaggccctgccccaggagacaagggcagagcctgctggggctccccaagagggacacggaccagcaggaccctgtcccagaaggggatccccaaaaggacccccgcaccagaccctgagaaaggagtttttccaaaggttctaaacagcagagcctgcagggcttcccacagccagggagctgcaagaccccctggataagacaacccatgctggacttggagtggcagaatctgtcaggaggcgcccctcctggagtattgggttatagggtttgaaac

SEQ ID NO: 11 - DNA, 33383 bp, Homo sapiens
cgctctgtcatcacctagagatatttacactattgcccaggttccattgcaggaattctgatttaattggtatgtggcaacttgtgtttgggggattttaaaagacctccgaagtgatttttacatgcagactcgggtgaaaacaattggttcagggtgagggatgtattcactgtgtgtgatttccaggtgtgcttctggagctttgccccatggctgcttctgactttgaaatcttcaacagcagctctgccattgtaaaaatcaaaatgcaggccaggcagggtggctcacacctataatctcagcactttgggaggccgaggcgagtggatcacctgaggttaggagtttgagaccagcctggcaaacatggcaaaaccccatctctactaaaaattgaaaaatcagctgggcatggtggtgcacgcctgtattctcagctactggagaggctgagacaccagaatctcttgaagccaggaggctgaggttgcagtgagccgagatcacaccactgcatttcagcgtgggaaacaaagtgagaccatgtcttaaaaaaaaaaaaaaatcaaaagacaacttcaagatgtactcaaatattttgctaaattgcagcagaatgaaatgtcttccggctggggtcggtggctcacgcctgtaatcccagcactttaggaagctaaggaggatggatcacctgaggtcaggagttcaagaccagcctgggcaagatggcgaaaccccgcttctactaaaaatacaaaaaaattagccgggcgcggtggcaggcgcctgtaatcccagctactcgggaggctggggcaggagaatcgcttgaacccgggggcggaggtcgcagcgagctgagatcgcgccactgcgctccagcctgggcgacagagtgagactctgtctcacacacaaaaaagcctaaatttaaaaataattattctattcttttcatgtgtgagcagccatatagtatattatttacaaatatatgagaccttacacacaacgttaaaggcaaacaccttctgcggtgtgcttggctcagctcaggcaggaagccctgcctgaaaaggctgcaccttcggctgtcactctgtcctcattcggcccagcgtttggttacatcttctgtcactcagggcctgagggcggggggggggggggtcttaaacgttatccattcagcgacgctggcctgggaactgtccaatcaggcacgcagctggagcggaaagggcggcttccgggatgtggcggggtctttgtctctcgctgcagtcggagtatggtctagtgttcgctgttctgcgtcctctggtcctagaggcccatcctctgtggccctgtgacctgcaggtattgggagatccacagctaagacgctaggaccccctggaagcctagaaacggtgagagtgccgggtccgacatcccgagagaggggaaggggctggttggaaccggtggcaagaggctgtggcgggactcaggcctccccgcagtcggctccacaatctgcgccccaagttcgccttgcccagcccagcctcagtccccttcagccatcagattggcggctgcgctggcagccggacccccgggcgtcctgtctcttccctgcgcagtgacggtgccctggcctggagccctctctgggcagctctgcacccgcagcgtcgtgtctctcccagattgtgcagggaccacgggagggtggtcaggggagaatcctgactcggggtgcgggttcacgaatgggaagagctttggtttggtttatggggttcctagttcctcttttcttctattaaaaatttatgggagttatcgcgaaaatacttaaaaatttaagcaaggagtggttcaaaagttatagagcacccagctgtgggttgtagtttgtggtcggtccatgggaggatcttgaaggaaagatgcagatgaaaatacccaaattcaataatcggttaggtatatttacgtagtttcttaattttcaccttgagcctacaaatttcctggttgtgtaatcagagcttacttggcagtttatcgttagttaagcctgaattttgtttcccccaatgtagtaatttctaaaaaaaaaaaaatgcatttgagtttgattttttaaaattaggaatccaaagattagagccacctcagtctatttgccgccacatggggctgattttccctggcatttttcacataggtcccaagcaggttctcaagtcaaccccccacaccccatttctccagcttaactctggcttgcagtaaaatactgaattttcagttccttctgaaaatctcaaatgccaacttcttttccctaatttacattattatttgtcctttagtgtacatttttcatactgtattttaattaatcattttttgacaaagcattagatggcatatttaaaaagatatgttttctgtttgtaaatatttcccatgagaagaaagcaaggaatatcccgatagtgaattgtaaaaaatctctgtgcctctttttcttttgtcttccctaggcataaagatcttatgagaatgttttagtgtcaagatgtttttattttgcaaacgttatggggtgatttgtgcttagcaaccctgtcgtttattcttggtcctggctttcagtactgtctctgaataaaccaagataaccgctatggcgatgtctgctagagtatctagtgaatatcagctcctaaagtcattttctttcgtaggacaacctgagatatggagtgtagcctctcaagtggataccctggggaaaagatgaatctcttttaacttttatttttggttcaggggtacacatgcaggtttgttatacagctaaaattgtgtcatgggggtttggtgtgcagattattttgtcactgaggtactaagcatagcaccaaacaggtactttttctgatcctctttgtcctcccattctccaacctcaactaggcctcactgtctgttgttccctctttgtgtttacgtgttcttattattcagctcttacttaaatatttttttttttttgagatggagtttcgctcttgttgcccaggctggagtgcaatggcgcgatctcggctcacggcaacctccgcctcccaggttctagtgattctcctgcctcaccctcccaagtagctgggattacaggcatgcgccaccacttccagctaattttgtatttttagtagagatggggtttctccatgttggtcaggctggtcttgaactcccaacctcaggtgatctgcccgcctcggcccaaagtgttgggattacaggcatgagccaccgcgcccagcctcagctattacttagaaacaacatgcatttggttttctgctgctacgttagttttctaagaatagtggtctccagcttcatctatgttgctctatgttgcttcaaaggacatgatcttctgtgtgtgtgtgtgtgtgtgtgtgtgtgtgtttgtgtgtgtgcgtgtgtgtatgtgtgttttaacggccacacagtattccgtgatatttatctaccatattttatttatttatttttattttattattttttttttgagatggagttttgctcctattgcccaggctggagggcaatggcacgatcttggctcactgcaacctctgcctcccggttcaagcaattctcctgcctcagcctcccaagtagctgggattacaggcatgcgccaccacgcccagctaatttttgtatttttagtagagacggggtttcaccatgttggccaggctggtcttgaactcctgacctcaagtgatctgcctgcctcggcctcccaaagtgctgggattacaggtgtgagccaccacaccctgaccccatgttttatttttagtaaacctttttttttttttttttgagacggagtctagctctgttgcccaggctgaagtgaagtggtgcagtttgactcactgcaatctctgcctcctgggttcaagcaattttcttgcctcagcctcccaagtagctgggattacaggctcttgccaccacgcccgggtaattttttgtgtttttatttatttatttttatttttttagtagagatggggtttcaccatgttggtcaggctggtctcgaattcctgaccttgtgatctgcctgtcttggtctcccaaagtgctgggattacaggcgtgagccattgcacccggcctaaaccttttattttattttattttatttttgaagacagggtctcactctgttgtccagactggagtgcagtggcatgatctcagcttactgcagccttaacctcccaggctcaagcaatcctcttctactttagccccccaagtagctgggactacaggcacacaccaccaggcctggctaatttttttggtattttttgtagagacagggtcttgacatgttgccctgggtggcctcaaacttttgagctcaggcaatttacctgcctcagcctcccaaaatgctgagattacaggtgtgagccaccatgcccagccataccatattttctttatccagtatacaattgataagcatttaggttgattccatgtctttgctttcatgaatgacagggactgcaatgaacatacgtatgtctttataatagaataatttatattttactggttatatgcccaattatgaggttgctgggtcaaaaggtaattctgtttttagttctgtgaggaatcgtcacactactttttatagtggttgaataatttacactcccatgggtagtgtataagcattcctgtttctctgtaaccttgccagcatctgttatgttttgactttctaatactagccattctcactggatgagatgatatttcattgtggtttttctttgaatttccctaatgattagtgatgagcattttttttatgctcgttaaccacatgtatgtcttcttcgaagaaaacacccttttcatgttttttgtctactttttaggtcttttttttcctgtaacttgtttaagtttcttataaattatgggtattggacctttgtcaaaagcatagtttgcaaatattttcttttattctgtgtgttttttgtttactgtattgatggtttcctttgctgtgaagaagctttttagcttaattagcttcaatttgtcaattactgcttttgttgcaattgcttttggtatctttattttaaaatttttgccggcttctatttctagaatggtaattcctaagttatctcatgcattttttaaaataatttgaaattttacatttaaatctgtaatttatcttgagttgatttttgtatgtggtgtaatgaaagggtccagtttcaatcttctacatagtcctagctagttattccagtaccatttattaaatagggatttctttccagattcctgttgttagctttgccaaagctaacaaccagatggttgtaggtgtgttgtattatgggctctctattctgttgtattggtctatgagtttgtttttgtaccagtaccatgttgctttgtttactgtagccctgtagtatagtttgaattcaggtaatgtaatgacttcagctttgttctttttgcttatgattgccttggctatttgggcccttttttggttccatataaatttaaaaatttttttgttttgttttttagctctgttaagaaatatttttggtagtttgataaaaatagcattaaatctgtaatttctttggcaggatgactattttaataatattgatctttttttgtttgtttgtttgtttgagatggagtcttgctctgtcgcccaagctggagtgcagtggtgcgatttcggctcactgcaacctctgcctcccgggttcaagcaattctctccctcagcctcccgagtagctgagattacagatgcctgccaccacgcctggctaatttttgtatttttagtagagatggggtttcaccgtgttggccaggctggtcttcaactcctgacctcgtgatccacctgcctcagcctcccaaagtgctgggactacaggcgtgagccactgcgcctggccaatattgatcttctttatccatgagcacaaaatggttttccatttgtttgtgtcatctctgacttcaagcagtgttttcacagtgttgtcataaagatctttcacctccctggttagctgtatttctagatattttattctctttgtagtgattgtgaaggggttctgtttttgatttggcttttggcatgcatgtttttgatttacagggatgctactaatttttgtacatttattttgtattctgaaattttactgaagttttttgtcagtttgaaaagctttcctaggcctggcgcggtggctcacacctgtaatcccagcactttgggaggccaaggcgggcagatcatctgaggtcggaagttcaagaccagcctgaccaacatggagaaaccccgtctctactaaaaaaacaaaattagccgggcgtggtggcgcatacctttaatcccagctactcaggaaggctgaggcaggagaattgcttgaacctgggaggcagaggttgcagtgagccaagatcgcgccaccgcaccccagcctgggcaataagagcgaaacttggtctcaaaaaaaaaaaaaaaagaaaagaaaagaaaagcttttctgtgatgattatagggtttttcagatacagcattatgtcatctgtaaaaagaaataagtttgacttcctttcttcctgtttgtatgcctttttttttttatcttgcctaattgctctagccaggacttccaattttatgttgaataggagtgttgagaggaggcatgcttgtcttgtgcctgttttcaaagaaaaatgattccaggttatgtatattcagtatgttggctgtgggtttgtgatagataactcattattttgaagtatgcaccttccatccctagtttgttgagactttttaacataaaaatgttaaattttattgaaagccttttctgcatctattgacatacttttgtgctttctgtcttcagttcttattatgtgatgaatcacatttattaattcatgtgtgatttttttttttctttgagatggagtctcactctcttgcctaggctggagtgcagtggcgcgatctcagctcactgcaacgtctgcctcccgggttcaagcaattctcctgccttagcctcccaagcagctgaattacaggtgcttgctaccacgctcggctaatttttgtatttttagtagagacagggtttcaccatgttggccaggctggtctcgaactcctgaccttgggtgatctgcctgctttggcttcccaaagtgctgggattacaggcgtgagccaccacgccccacctcatatatgttgaattagccttgcatccccaaaataaactctacttgattatagttggttaggtttttgatgtcctgctcaatttggtttgccaatattttgttgagaatttttgcatcaatgttcatcaagaatattggtctaaagttttcttcttttgttttatctctgtcaggttttggtatcagaatggtgctgtttttagttttttggaatagtttcagtagaagtggtaccagctgtcctttgtccatctactagaattcagctgtgaatctatctggtcctagcctattttggttggtaggctatttattactaattcagttttcaagcttgttatttatctattaagggctttgatttattttttgttcagtcttgagaggatatatttattcaagaatttttccatttcttctagattttcaagtttgtgtgcatagaggtgttcatagtagacttcaatatatttttgtggggtcagtggtaatgtctcttttgtcatatttaattgtgtttatttggatcttttcctttttcttcattaatcttaatggtggttggttttatttttatgtttttaaaaattttactcctgtacttgttgatcttttgtatagtttttcatgtcaaaatcttccattcagaaatgattttggttatttcttctgctagcttaggggttgatttgctcttgcttctctcagtgttttatttatgatgtcaggttgttaaactgaagtctttctaacttttcaatgtaagcatttaatgctataatttttttctcctaacactgccttagctgtgttgcaaaaattcaggtatgttgtatctttgttctcatttttttcagagaacttcttggttcctgccttaatttcattatttacccaaaagtaattcaagtgcaggttgtttaatttgcatgtacttgtatgattcaagtgattttctttgtattgaattacatttttatcaagctgtggcctctgtgtgtggttcatataattttggaatttttaaatttgctgaggattgttttgcttctgactgtgtggtcaattttagagtatgtgccacgtgatgatgagaagactgtatactatgttgtttttagatggagagttctgtagaaatctattaggactgtttagtcaagtgttgagtttaggtcttaatatctttgttaattttctgcctcaataatgtgactattagtgcccacgggtgttgtagtctcccactattattgtgtcagtatctcattctcttcataggtctctaacaacttgatttatttatgtgcccccatcaatttatttacttatttattttttattttttgagacggagtcttgctctgttgcccaggctggagtgcagtggggcgatctcggctcactgcaagctccgcctcccgggttcacgccattctcctgcctcagcctcccgagtagctaggactacaggcgcctgccaccatgcccggctaattttttgtgtttttagtacagacggggtttcaccatgttagccaggatggtctcgatctcctgacctcgtcatccgcccgcctcagcctgccaaagtgctaggattacaggcgtgagccagcgcgcccggccacgcccccatcagtttattataacatctttctctcttctgcttttttaccataaacattctttcacattcacaatccagatgtcccagagttcaagaacgtgtccagtgacctggttgttttaggagaaaatgtaaattaaaaataagaggctttatttacatacgtgaaaataagggaggatattttgttcatctctgttttattaaagcatttagattatatgtaggtatttttctctgcttttttgaaatatacataaattatattaacagctaaataaaccttttgtctttttttttttttttttttttttgagatggagtctcgcactgttgcccaggctggagtgcaatggcatgatcttggctcactgcaagctctgcctcccgggttcacgccattctgctgcctcagcctcctgcgtagctgggactataggcacccaccaccacgcccggctaattttttatacttttagtagagacggggtttcaccatgttagccaggatggtctccatctcctgacctcgtgatccacctgccttggcctcctaaagtgctgggagtacaggcgtaagcgaccgcgcacggccttgtcattctttttgactcaggattgtctttatttgtaacctgagattcattgctttgtgtttgctttggcagaggtttatttttttaattttcagtcattaaaagtacacacagatttattcagagtaaagctcattttaagagcacttgaaagttggacacaaaggtagaattaaatttagcaatacagaatgataaagactaaaagatacagagttaagttcctttgacagaaacttgattatccaaggtacttatttgcaggctgaagtacttacaatgcaaaagcaaggtctggccgtggtggctcactcctgtaatcccagtgctttgggaggccgaggcgggctgatcatttgaggtcaggagtttgagaccagcctgaccaacatagtgaaatctgtctctactaaaaatacaacaacaacaacaaaattagccaggcatggtggcgcatgcctgtagttccagctacttgggaggctgaggcaggagaatcgcttgaacctgggaggcagaggttgcagtaagcgcacatcttgtcactgcactccagcctgggcaacagagtgagactctatcctcaaaaaaataaaaataaaaaaaataaataagtgcagactcagtcggatattgctgctttctgttttctctgtaaactttaaaaagccaacaaagattatgatactttaagatggagattagttgtcttcaatttgttccagaagtaattgtgttgtgacaagagtgccaagtataagggactctgtgctgtgcctgctttctctaactaatgctaataatgagcctagggggagcatcatcagcattgacaggggacttatttaaaacacccattcatggacctttccatacctgcagaatcacattacatagattgagaccaacattaccaagtgatttataagctcaataaaacttgagaggcaatgcttagttcagtggttgtaagcccaggctgctaattacaatcacatggccagtttgcagaactccctttactggtgcccttcccacaggttctgtttaatgttctgggtggaagcattcatgttattttaattaactgcctcatgtgactctaagttgtggccagaatcaagtatagggggttcaagatacatttatgagagttaagtttcacctgtgcactaaagggtagtcctagagcctcttttctttgggtttcatagggacagggcagtgtggctcatacttttgttactgtagcagaaattgctggcaggggagggcacctgaagacaggaaaggagaaacttgtatttttatatctgtagagcagctcattgttgctgaatctcttctgttataaagtacagaaatgggtggagttttttctgttttgggtcttctgcctgtgggtgtggtggtagcaggtaaacatgtggtgctgacacttttcaaggcatagtctcaagatgcggtgtaatttgtccagagaatcttatctgagaaggaatcctagaaaagaaggagaaagagaaaaaatggcattcttaatgatgaaatattgaatacttattttatttttattttactttaagttccaggatacatgtgcagaatgtgcaggtttattacataggtatatgtgtgccacagtggtttgctgcacgtattgacccatcttctaggtgccctccccttgccccccactccacaacaggccctggtgtgtgttattcccctccctgtgtccttgtgttctcattgttcaactaccacttatgagtgagaacatgcggtttttggttttctatccctgtgttagtttgctgaggatgatgacttccagcttaatccatgttcctacaaaggacatgatctcatttctttgtatggctgcatagtattccatggtgtgtatgtaccacattttatctatccattctgtcattgatgggcatttgggttgtttccatgtctttgctgttgtaaatagtgctgcagtaaacatacgtgtgcatgtgtctttataatagaatgatttgtattcctttgagtatataaccagtaatgggattgctgggtcaaatggtatttctggttctagatccttgaggaatcaccacactgtcttcgacgatggttgaactaatacacattctcaccaacagtgtaaaagcattcctatttcttcacagcctcaccagcatctattgtttctgactttttaataatcaccattctgactggtgtgagatggtatctcattgtggttttgatttgtatttctctaatgatcagtgatgttgagcttcttttcatgtgtgttggctgcataaatgccttctgagaagtgtttgttcatcttttgcccactttttttttttgagatggagtcttgctctgtctcccaggctggagtacagtggcacgatctctgctcactgaagcctacacctcctgggttcaagtgattctcctgccccagcctcccgagaacctgggactacagatacccaccaccacgcccagctaatttttgtatttttagtagagatggggtttcaccatattggccaggctggtctcgaactccatacctcaaacgatccacccaccttggcctcccaaagtgctgggagtacaggcatgagccactacacccagcctttgctcactttttgatggaattgttttttttcttgtaaatttttaaaagtttcttgtaaattctgaatattagatctttgtcagatgggtagattgtaaaatttttctcctattctgtaggttgcctgttcactctgctgatagtttccttttctgtgcagaagctctttagtttaattagctcttatttgtcaattttgggtttagttgcagttacttttggcatttttgtcatgaagtctttgccgatgcctatgtcctgaatggtattgcctagattttcttctagggtttttatggttttgagttttacatttaagtctttaatccatcttgagtaaatttttgtataaggtgtaaggaagaggtccagtttcagttttctgcatatggctagccagttttctcaggaccatttattgaatagaaaatcctttccccattgcttgtttttgtcaggtttgttgaatatcagatggttgtagacgtgtggtgttatttctgaggtttcttttctgttccattggtctatatgtctgtttttggaccagtaccatgttgttttgcttactgtagtcttgtagtatagcttgaagtcaggtagtgtgatgcctctatctttgttctttttgcttaggattgtcttggctatatgggctcttttttggttccatatgaaatttaaagtctttttttctaattctgtgaagaatgtgaatggtagtttgatgggaataacattgagcccataaattactttgggcagtatggccattttcatgatgttgattccttctatccataaggatgggatgtttttccatttgattgtgtgctctcttacctccttgaggagtggtttgtagttctccttgaagaggtccttcacattccttgttagctgtatttttagatattttattctttttgtagcagttgtgaagtttatttatgatttggctctctgattgtctgttgttggcttataggaatgcctgtgatttttgcacattcattttgtatcctgagactttgctgaagttacttatcagcttaaggagtttttgggctgagatgatggaattttctaaatatagaataacgtcatgtgaaaacagagagaatttgacttcctcttactctatttgaatactctttatttctttctctttcctgattgccctggccataacttctaatactatattcaataggaatggtgagaaaggacatccttgtcttgtactggttttcaaagagaatgcttccagctttttcccattcaatatgatattggctgtgggtttgtcataaacagctcctattattttgagatatgttccattaacacctaatttattgagagttcttaacatgaaagaaagttgaattttatcaaaggccatttctgcatctattgagataatcatgtgatttttgtctttagttctgtttatgtcatgaattatgtttattgatttgcatatgttgaaccagccctgaatcccagggatgaagccgacttgatcatggtgaataagtttttgtttttgtttttgcttttttgagaccgagtttctctcttgttgcccagtgcaatggtgtaatctcggctcaccgcaacctccgcctcctgggttcaagtgattctcctgcctcagcctcttgagtagctgagattacaggtatgcaccaccacgcccggctaattttttgtacttttagtagagacgaagtttctccatgttggtcaggctgggctcaaactcctgacctcaggtgatctgcctgcctcggcctcccaaagtggtgggatttcgggtgtgagccactgcgcccggcctggtggatgttttttgatgtgctgctggattcagtttgccagtttttttttgtttgtttgtttgttgttgttttttttttttttaggcagagtttcattcttgttgcccaggctggagtgtaattgtgcagtcctggctcactgcaacctccgcctcctgggttcaagtgattgtcctgccccagcatcccaagtagcctggattacaggtgcccgccactacacccagttaatttttttttttaatttttattagagatggggtttcaccatgttggccaggctggtctcgaactcctaacctcaggtgatcccccccaatctcggcctcccaaagtgctgggattacaggggtgagccaccacgcctggccctattttgttaattttttcaaaaaacagctcctggattcattgatttttttttgagggtttttcatgtctatctccttcagttctgctctcatcttagctatttcttgtcctctgctagcttttggaattggatttgtttgctcttgctttctagctcttttagttttttttttttttttttttgagatggagactcactctgtcacccaagctggagtccagtggcgtgatcttggcttactgcaacctccgcctcctgggttcaagcaattctctctgcctcaacctcctgagtagctgggattataggtgcccaccaccacacctggctaattttgctattttttagtagagatggggttttgacatattggccagaggctggtcttgctctcctgatttcaggtgatttgcctgcctcggcctcccaaaatgctgggattacaggcgtgagtcaccgttccccgacttagctcttttaattgtgatgttagggtgtcgatttgagatttttctagctttcttatgtgggcatttggtgctataaattccccttttaactctgtcccagagattctagtatgttgtgattttgttctcactggtttcaaagaacttttgatttctgccttattatttacccaggagtcattcaggagcagattgttcattttttatgtaaatgtgtgcttttgagtaagtttcctaatcccgagttctaatttgactgtgttgtggtctgagagactgtttgttaccatttcagtcctgttgcattggctgaggagagttttacttccaattatgtggttgattttagaaaagtgccatgtggcactgagaagaatgtatattctgttgatttggggtggtgagttctgtagatgcctattaggtccacttgatccagagctgagttcaagtcctgaatatcctagttaattttttgtcttgttgatccgtctaatattgacagtgaggtgttaaagtctcccactgattgtgtgggcgtctaagtctctttgtaggtctctaagaacttgcttcatgagtctgagttctcctgcattgggtgcttatgtatttaggagagttagctcttcttgttgaattgactcctttaccattaaataatgcccttctttgtcttttttaaatctttgttggtttaaagtctgttttgtcagagactaggattccatcccctgcttatttctgctttccatttgcttggtaaattttgcttcatccctatgtgtgtctttacacatgagatgggtctcctgaatacagcacactgatgggtcttgactctttatccaatttgccagtctgtgtcttttaatttgggcatttagcccatttacatttaaggttagtattgttctgtgtgaagttgatcctgtcatcatgatggcatctggttattttgcacactagttgatgctgtttcttcatagtgtcattggtcttcatggtgtgtttttgcagtggctggtaccagtttttcttttccatatttagtgctttcttcaggagctcttgcaagccaggcctggtggagacaaaatccctcagcatttgcttgtctggaaaggattttatttctttttctactcatgcagcttagtttggctcgatataaaattctgggttcaaaattcttttctttaagaatgttgaatattggcctccattgtcatctggtttgtaggatttctgctgagaggtccactgttagtctgatggacttattttgtaggtgacctggcctttctgtctgactacccttaacatttttttgtcatttcaaccttggagaatctgatgattatgtttcttggggttgatcttcttgtggaatatcttagtggtgttcttggtatttcctgaatttgaatgttagcttgtcttgctaaactggggaagttctcctggatgatatcctgaagtgtgttttccagcttgtttccattctccccctttccttcaggtattccagtcaattgtaggtttggcctttttatgtagtcccatatttctcggaggctttgttcattcttgttcattcttgttcagtctttttttctctaatcttgtctgcatgccttatttcagcaaggtggtctgcaaactctgatattttttcttctactttgtcaatttggctgttgatacttgtgtatgcttcatgaagttctcatgctgtgtttcttagctccgtcaggtcatttatgttcctctctaaactggttattctagttagtggctcctctcgctaactttttatcaaggttcttaggttttttgcatttggttagaacatgctcctttagctcagtggagtttgttattgcccatcttctgaagcctacatctgtcaatttgtctatctcattctccatccagttctgcacccttgctggagaggcattgcaatcatttggagaagaagaggcacccttgccttttgggttctcagtgtttttgtcattgattctcatcttcatgagtttgtctagtttcgatctttgatggggttcttgtggggacttttttgttgctgttgttcatttctgtttgtttttctttcaatggtcagatccctcttctgtatggttgctgtggtttgctgggggttcacttcaggccctatttatctggttcacttctgaacctggagatattaaggagattggagaacagcaaagatgggtgcctgctccttcctctgggatctctgaccttaaggaacaccaatctgatgccagtaggaacacagctgtatagggtgtctgacaaccccagttggagtatctcacccagttgggtggcatgaggaacagaacccatttaatgaagcacttttattgtcccttggtggagggggtatgcttcactggggttaaactcactcctctgggctgcttggattcctcagaactggcggggggaaaagctaagtccactggtccacagaaactgcagtcacctctccccctagggactcaggcccagggagatcagagttctgtccctgagcccctggctggagttgttggagttcctgcagagtggccccacacagtgaggagggatgtgtcagggtcaggcctgaagaggagctgtagctgcagtctggcacagccagtgtgttaggctgtgggggacacctcttgggaccaagccgtccagcatccctggctccagcaggggaaaagcatggccaggagctatagagatgactgccgcccttcccctgcccagggagcctagtgtgttaggcagctgtcagtcccagtgctggttgctgcccctcccccagggagctcaaatggcttaaacagcaggcagccatagctgtagtgctggtcacccctcccctgggaactcagcaggcttaagcagattttagctgagaggctgttgagaatctgcacagctctggggttgggatcctaggccccagtggcatgggttcacgagtgaaatctttcagtctatgggttgcacaattccatggaaaaggcatggttttgtcggctaagtagcacattcattcaccgcctcccttggctggggggtgggggctcccctgccccgtgtggctctcaggtgggttgctgcaccacactgctctttcttcctctctgtgggtcatgccagctgcctagtcagttctgatgagagaacctggatacctcaggtgccagtgcaggattcacaggccattatggttcttttcggtgggagtctctgatcaccgctgcttctagttggccatctttgccctgcccctaaaaaatggcttttttttctttttaagctaaacatgtctcagatgaagaactgtgtccactctgcctcctggaatgccatgtgttcagtacttgcaaagctttacttttctacttgtgctttttcttcctaatgagtttaactactttttagttcttataatagtcaaaggtctctgaaaaatatttctttcctacataccagagtcttctctacattctcaacatcatggcttcttacatgtcatcaagaattctcaccatgaatttatgaactgcaatattaagaatgtttccttcgtggctatggaacatgggaaggtgtagatactcaagattcctattggggaaaagctggggtccttaataaagatggagagcatgtaattttgaggttccatctctgttctccattagctgtaaacaaataagattaagaaaatgcttatttaaatgggatggcatttattacgcagaaagtttaaaaataataataattaggagatacttgctctttagggtgtgaaagaaagactacttaaaatcactattaaaatttacagaacatggcagatattggtatctggaactttacataaaaccagtgtttctttatgattaaattcagactataatttacttttggctgggcaatatcatagcagtgatgccgtgtccttctgtgtgcatcagcacatttgtcttcatgcacttgatgttaataactcacttgattaatgaactctgtgacagatttttttctatagagttaattatttttctcttcattactgagtatctttattcagcagatgtgcataaacaatcacatttaatctggcagctgacctttcttaggctttttttttttttttttgagacggagtctcgctctgtcgcccaggccggactgcggactgcagtggcgcaatctcggctcactgcaagctccgcttcccgggttcacgccattctcctgcctcagactcccgagtagctgggactacaggcgcccgccaccttaggttttctttgcatttatctgtctttggaaaatgaaagctctcatctttgtttacaggccagaaaaactgaaaaacacacaggcttttccacttactggatgtttgacaaaatagttttcttggaccaaaaacatgggcattactggtgagcttgttagagattcagaaactcagattttattccaaattttcttttcttttttttttttttgagacggagtctcgctctgtcacccaggctggagtgcagtggcgcgatttcagctcactgcaagctccgcctctggggttcatgccattctcctgcctcagcctcccgagtagctgggactacgggctctcgcctccacgcccggctaattttttgtatttttagtagagacagggtttcaccgtgttagccaggatagtctcggtctcctgacctcgtgatccacccgccttagcctcccaaagtgctgggattacaggcgtgagccatcgctcccagcccagattttctgaaaaaataatctgcattaacaagatctccagtttattgtacacattaacatgtgagcagtattttctaactgaatatgtcttttccatctgaaaaatttacacaacttattctgtatgatgtaaatgtagcactcaaaaatgtacatgttagtgttaatgccctcaattttatacttcatcatccgaagaagtatcatacttacctcgatgttgtggatcttatgccactctcttttctcagagttagagaatgcattagagaatatacttctgtgctgaaagttatttattaaatatatcagtcactcctataagtaagaaccagttctctttactcttgttttaccttgagtcaaattaaaaattctgttcatggccacttggtaaatatgtatgtgtgtttgtatgtttttcagggagtgttgacatttagggatgtggccatagaattctctctggaggagtggcaatgcctggacaccgcacagcagaatttatataggaatgtgatgttagagaactacagaaacctggtcttcgtgggtgaggataacttcaatatacaattccctaatataccctataaattttatttctcttttttgtagaatggtttttggtaatttatgctttcagatctctgttttttgtttttaacttcaagatttgtctatgtagaaaagaatttcaagatgtttcattttgacctgaactttccacactcctgagctgatctgtgttcttcactctagattagtgttaattttagaaatttagtggcataacgtactgttgcccacatcttaaaatctaattgccactaccagtttttgatttagtagtatcaggtagtgaaattaagaacttacaaaattaaaatatttcctaaatatttaaaattttttgttgtgtattagtattttggaatcaatttactagaatattctattacatccttttttctgaacacactactaaattggtaattggagaatatgagcaagattcatgttatttgtaataaaacaggtattgctgcctctaagccagacctgatcacctgtctggagcaaggaaaagaaccttggaatgtgaagagacatgagatggtagctgaacccccaggtaggtgagagtgaaagtgaatacaacagatgacacagatgagagctccaaagtagaaaaaaaaaaaagccagtccttaaaatgatttgaaatctgtgttccaaaggaaatagtttctgggaagcctgaattttttaaattttgctttcacatagaagcatcttctgtcttatatttttaaaatctctgaagattttactttccctttggtgatcttcttcaagtttacagtgacagccaagacagccctcttcatggcacataagagactgtgaaatctgactttttcactgtttttgaaaacacgtagataatctgcataattttgagaaactctatgttaaactgtttttcaagttctgtttttacattatgtcctaaatgtgtgagagcagtggtttctgttccattggtttctttattgctaatttttctgcacattgcattctgtcttattatagtcttgaagtatagtttgaaattataaagtatgatgttcttctgctttgtcctttttttttcaagattgctttggctattcaaagtttattgtaagtctatgtgagaattgtattttctttttctctttcttttttttttttttgagatagagtctcgctctgtcacccaggctggagtgcagtgtcatcatctcggctaactgcaacctctgcctcctgggttcaagcgattcttctgcctcagcctcctgagtagctgggaatacaggcgcgagccaccatgcctgactaatttttgtatttttagtagagatggggtgtcaccatattggccaggctggtctcgaactcctagacctcgtgatccgcccacctcggcctcccagagtgctagaattacaggcgtgacccaccgtgcctgactgagaattgtattttctattgctgtaaaaaaaaaatactggaattttgatagagaatttattgaatctagagagcactgtagataacacggcactttaataatattctttcagccgggcatggtggctcacgcctgtaatccctgcactttgggaggccgaggcaggcggatcacctgaggtcaggagtttgagaccagcctggccaacatgatgaaaccctgtctctactaaaaatacaaaaaattagtcaggcgtggtgacaggcgcctgtaattccagctacttgggaggctgaggcggaagaatcgcttgaacctggtaggcagaggttgcagtgagctgagattgcaccactacactccaatgtgggcaacaagagtgaaactccatctcaaaaaaaaaaaaattctttcaatcaatagacatgaaatgtttttaaatttatttttgtcttctccaatttttttttattgatgtatcttttatttgaaagatatttaagctccttggttaaatttgttctcagaaatttattattttagtgctattgtaaataagattgctttctgtctcttttttgtcagatagtttgtttaaagtgtatggaaccataacttacacttgtatgttaattttctattttgctaaattattgagtgtaattattactttaattaggttttaaatgtactgtttatggttttctatatacaagatcaaatgatctacaaaaagcaactttttacttatttgtcttcaatttcagtgacttaatttttttttttttttttttacttattccacatacttccagtgctgtgttaaaatagaagcgttgagaatgggcataataaacttttgcattggtgtctgtgagtttgaaggagcaaacacctcttcaagtttttcttgttgttttttttttttttttttttttttttgagacagcgtctcactctgtcgctgagactggagtgcagtggcgcggcctcggctcactgcaacctccacctcccaggttcaagtgattctcctgcctctgcctcccgagtagctgggactacaggtgcgtgccaccatgcctggctaatttttatatttttagtagagatggggtttcaccatgttggccaggctggtcttgaactcctgacctggtgatccacccgccttggcctcccaaagttctgggattacaggcatgagccaccgcgcctggccctcttcaagtttttataaattggtttcagaaagtgaagatcttttgttgagcccccagggtgatgggatgtcctatgggtttgtagtggagaggggtaggtagcttgtttacaaaggctgctgggtctgcattagggtccacctttagttggcttgttacaaggggcttaggtagttgtaattcccattttatttttggacagagtgagtatccttcaggactttgctctgtagggcagacgctagggcagatttctgcacttgggtctgcatatggtaggctttatattaggatgtagatgagtttggctttcactgaaaaccagagaggatttcccatggtcactgtgtgggtttctacataggcagaacttgccatgaactgtggctcagggtgataaaactgagtcatggaactgcttcagggaccacagtaagggccaaggtctgcaggcctgctgcatggctataaaggggtgtctgtctctaggcttctgaaagggcaagacctctcccagactgtggctgggaggagtttgggatgattgcagtgtaagttcagaattctcagtgggaccaagtttggtgggccattttctggtctgtagccaagaacaggggtcctatagtttgccacctgaatgaaagcctgccttctgaagagaatattcctcaatcttgggcattagcagagtttcacagctccctccgtagatctcaaagctctttaagggcacttattttggagatgggttcttgctacataacccaggttgatcttgaagttctgtcctaaagcatttctcattacaggtttgagtcatgattcctgtttctctcataaaggcatttttgtcaggctgatgaattttcttgctgtcagaaaataagcaaataaggcaccatttatttttccatcttagtgatgtcactcttcctgtccatttttactttctactttctatttcaattttgtcagtagttttagatttagacatttaggacaatatactaaaatttacatgttatgtctgaagtgaattaggtaattagtagacagacaaaaaggaaatatagacaggcaaaaaaagattacaggattttcactcacttttgtcagctagtacctaaaatatgacatgatttgttcccaaatatttgtttcatatatcagaggccctgaccatattctgcaaaatagatatattttttctttatttagcaatgtaaggctattttttgcttctaaatttggattacagcagttttattttgtgtaagaatagcatatatttaaaacttagaaatgatcttaaaatgcttatttatcagtttgtcattagagtcttctgtttatgattatactgcattttatctgaaacttttactgcattacagtgcatgccaatgattcaaaatagccaccttcaatgagtacacagttacagtaaaatattacagttatctacacaaattctttgttaatgctacatcaagttacataccagattttatgagtaaacatttattattattttttagtttcatattaacgcattttttcagtgtaggtttcttaacataagtttattgtgttttttggttttacaattttagacaatttgcaattctgtttttacatgtaagtcggtgtgtggtttaagagatagatcagccttatctctattacaatctgattatatgtgtgtgtgtttttatctataaatatgaccccaattttggttatggctaatcttgtatatattttttcttggctgatttttaatggtggctttatcttgtctaaatgagtagtcatggaaatagtcttattttcaccttgtgtttaataataaacatatttcctatgtgtgagggaaacacttttgtgacttgacggtaatttttggaaagatttataattctggatcttcttcagttattcttctaaaaaacaattgtataaacatataacctaaaatttaccaccttaaatctatttaaatgtacatttcatggccagtcatggtggtggttcacgtctgtaatccccggattttgggaggccaaggcaggaagactgagcccaaaagcttgagaacatcctggaagacatatggaaacctcatctctgtaaagcattttaaaacttagccagacatggtgaagtggtcctgtctccttgggagattgaggagggaggattacttgaacctggaagtttgaggctgcagtgagctgtaattgtgccatgcaccccagcttgggtgacagagtgagaccctgactcaaaaacactgtacatttcaggcatgttaagtatatttacattattttataaaagatttctagaaattttacaatacacattaaacaactaccaatttttcccatttcctggcacttttcaaataccgttctgttttctgtttctaagagtataactgctttatatatctcataaaatctgtttgtggctggctcattttattttgcataaagtcatcaagatttacctttatagttgttagaatatttcctgctttttttcaaactgagtaatatattggcatttttgtatttcaaattatatctgctgaacgatttggtgaccgaaatttgccttgcttttacctactggcttttagtaacaatgctaaaataaatgtgggtatgcaaatgactcttcatgtgaccatatatgtgagagtttatatatgtgctgcattctattttattagtctactttttcacctttatagtcataccaaattgttttaattctgtagctttgtgttttgaaatcaggaactgtaatgcctccaacattgttttgttttgtttttaatatttttgggtactttattgtatgtagagattctgtatactcgagggattgctgtttctgtttcttcaaaaatgcagtgagaaatttgaaaaacattgcattaaatctgtagattgcattgagcaggatggacatctttacagtattacctttttcagcctttcacaagagcatgctcaagagtgtgttgtttaatttctatatatttgttaatttttcagattttttttctcgttgtatactcatttcattttggtgatagaaagtaatttataaaatttcagttttaaaaaaactggtaagacttaattttcttctttttgtaataagaggaggtctatcaaggaaaatgttgtattagctattgagaaccatgtgtgtcctggtgttgaggggtgttttctatacctctgttagaaataattgtcttacactgcctggaagtcctctattcccttactaatattctcatttaatttttattacggaaaatgcagtgtcaaaatatcctactataattatgttgctctctatgtgtctctgttattctgtcaatgtttgctttatatgtttggagccctaatgtgagatacacacacacacacacacacacacacacacagagagagagagagacgtgtatacagatttgtcataggttcccagtgagtaaatctgaagtggtttttttttgttgttttttttttttttttgagacagagtctcactctgtgtcccaggctggagtgcagtggtgtgatctcggctcactgcaacctctgcctcctaggttcaagcgattctcctgcctcagcctcccgagtagctaggattacaggtgcccaccaccatgcccggctaatttttgtatttttagtagagtcagggtttcaccatgttggccaggccagtctcgaactcttgacctcaagtgatccacctgcctcaacctcccaaagtgctgggattacaggcgtgagccaccatgcccagcctaaatctgtaagttttaatgtccttttttgtctccttggagttttaacttcaagtacattttgtaaaatatgatagtttttgacttaagatgtagcttgcataatactatcttgatttcttctgctctcatttgattaatatttgcatgaaatgtattcttccatcttgccccttttagtgttttttatcattagatctctactgactcttgtagaaaaaaaagttggatcttggtttttaaaatttttaatctgttgaaagtatgtctcgatttgaaagttaattttatatatacatttaaataattgataaagacggactgttacatttttaattattttatttgattcttgcatctttgtttctcattttctctctttgtgtctttttgatttttgtattgatatgcttttacttatttctaattcacttttgtatatttgtacagatttttttttttggtggcaccttgggggttgcataaaacttctataagaaacaacagtatagttttaatttggtataaaataaatctcagttgaataaaaaaatcttcctcattacatctgccctgaaatttgtctttgatgttgctaattatgtttttacattgtatattcattaacagttgtttataatttctgtgcttttatttttcaaaatttagagatcatttaaaatgttttctgcaccattatgataatgccacaagattctgtttttatgtatgtgcatatctttcctggaaaataatgtatttttatatgattatgtgtttttttttttaatacttttactttcagtttaaggaactgctttcatcatcttttatatgtagggcatatgcagtgctaatatactttttcagaatttggttgttttggaaggttttttctttttatgtggcaggacagatttgttgatggtattatcctcaacttgatagctttttttttttttttcccctcaggactttgtgtcacacggtatctttctgatctgcagaatttttgttgataattcactggtaatatcataagactatgtttgtaaatgacacattacttttaccttgtagctcctaagactttcttcttgtctttgatttttgaaaatgtgcttaatatgtatctgtttaaatatctgtgtgtgtatcctaatttgtttgttgaacttcatttttacatcatttttcttttaggattttccagttgtttatttttctactttttaccaccaaattgttttttttaatattttgatattcttgtatttattctcatttttgtgactttctacagtggactgtgttcctgtttcactcattggatattattcaacttatgagtgtttaaaatgtgtacatcttttttatggtttctttctgaagtttatacggtatttttgatgaaattatattgccctgttttgtatacattgtaatcttggaatgagatttggacatcaaaaaaagctacctgtcacagtctttaaaatgtgtttttttctgacatagtctgaaaacaattatcttggctagagattctgggagtctctcaaacatgttcttaggatctgccttgtctaaaattttgtgtttagtttttagtcagaggagtttatttgtgtttctcttcttttttttttgaaacagagttttgctcctgtcacccaggctgcagtgcaatggcatggtctcagcccactgcagcctccacttctctggttcaagtgattatctggtctcagcttcccacttagctgggattacaggcatgtgaccccatgctcagctacttttgtatttttagtagagacagggtttcactatgttgcccaggcttggtctcaaactcctgacctcagctgatcctcccaccttggccgccaaagtgctaggattacaggtttgaaccaccaaactccttcttaataaccaataatcacttgctataattgtttcctgtctgtagtaccacagtctttctgctgctgtaaaacttacctttcttatttatttatttcattatactttaagtcctagggtacatgtgcccagcgtgcagttatattacataggtatacatgtgccatgggttaatgctatccttcccccagcccctcataccccgacaggccctgttgtgtgatgttccccgccctgtgtccaggtattctcattgctcaattcccacctatgagtgagaacatgtggtgtttggttttctgtccttgtgatagtgtgctcagaatgatggtttccagcttcatccatgtccctgcaaaggacatgaactcatcctttttcatgaatgcatagtattctgtagtgtatacatgccacattttcttaatccattctatcattgatggacatttgggttggttccaagtctttgctattgtgaatagtgccgcaataaatatacgtgtgcatgtgtccttatagtagcatgatttataatcctttgggtatatacccagtaatgggatggctggctcaaatggtatttctagttctagatccttgaggaatcataacactgtcttccacaatggttgaactagtttacagtcccaccaacagtgtaaaagcgtttctatttctccacatcctctccagcacctgttgtctcctgactttttaatgatcaccattctaactggcatgagatggtatctcattgtggttttgatttgcatttctcggatggccagtgatgatgagcatttttccatgtgtctgttggctgcataaatgtcttcttttgagaagtgtctgttcacatcctttgctcactttttgatggggttgttagtttttttcttgtaaatttgtttaagttctttgtagattctggatgtttgccctttgtcagatgggtagattgcatagattttctcccattctgtaggttgcctgttcattctggtggtagtttcttttgccgtgcagaagctctttagtttaattagatcccatttgtcaattttggcttttgttgccattgcttttggtgttttagtcatgaagtccttgcccatacctatgtcctgaatggtattgcctaggttttcctctagggtttttatggttttaggtctaatatttaagtctttaatccatcttgaattaatttttgtataaggtgtaaggaagggatccagtttcagctttctacatatggctagccagttttcccagtaccatttattaaatagggaatcctttccccatttcttgtgttttgtcaggtttgtcaaagatcagatagttgtagatgtgtggtgttatttctgaggtctctattctgttccattggtctatatatctgttttggtaccttacctttcatctcagcagcctcaaactgtcatttgaaagaataccactatttctttcagaacttttatgcaatgagacacaggaaccagtgtaaaagcccctgccattgagaaataaagatgtataagccattattttacttgtcttttaaaaatgaaaccaggagttggcaatttatttctaaagtcactatgttatatagggaagcaggaagatctgcactgggtaaatgtaacagacttttctttcttctatgtgactctttgcattgggctcacctggggcactgcacacacttaacttactttaatttttcagaaatgtaatttgttctgtatgcttttatatgtctgtgaaaatgttagagcgtgtaatattttgctgtaacatcttgtgatgtagtttgtataattttataggttagatttgtaaagtacattcgtctgagtcagtaagtgaagtaatttattatttttatttctttcagttgtatgttcttattttgcccgagacctttggccaaagcagggcaaaaaaaattatttccaaaaagtgatactgagaagatataaaaaatgtggatgtgaaaatttacagttaagaaaatactgtaaaagcatggatgagtgtaaggtgcacaaagaatgttacaatggacttaaccagtgtttgacgactacccagaacaaaatatttcaatgtgacaaatatgtgaaagtctttcataaattttcaaattcaaacagacatacgataagacatactggaaagaaatctttcaaatgtaaagaatgtgaaaagtcattttgcatgctttcacacttagctcaacataaaagaattcatagtggagagaaaccctacaaatgtaaagaatgtgggaaagcctataatgagacctcaaacctttctacacataaaagaattcatactggaaagaaaccctacaaatgcgaagagtgtggaaaagcctttaaccggctctcacaccttactacacataagataattcatactggaaagaaaccctacaaatgtgaggagtgtggcaaagcttttaaccaatctgcaaaccttactacacataagagaattcatactggagagaaaccctacaaatgtgaagaatgtggcagagcttttagccagtcctcaacccttactgcacataagataattcatgctggagagaaaccttacaaatgtgaagaatgtggcaaagcttttagccagtcctcaacccttactacacataagataattcatactggagagaaattctacaaatgtgaagaatgtggtaaggcctttagccagttatcccaccttactacacataagagaattcattctggagagaaaccctacaagtgtgaagaatgtggcaaagcttttaaacaatcctcaacccttactacacataagagaattcatgctggagagaaattctacaaatgtgaagtatgtagcaaagcctttagccggttctcacaccttactacacataagagaattcatactggagagaagccctacaaatgtgaagaatgtggcaaagcttttaacctatcgtcacaacttactacacataagataattcatactggagagaaaccctacaaatgtgaagaatgtggcaaagcttttaaccagtcctcaactctttctaaacataaggtaattcatactggagagaagccctacaaatatgaagaatgtggcaaagcttttaaccagtcctcacaccttactacacataagatgattcatactggagagaaaccctacaagtgtgaagaatgtggcaaagcctttaacaactcctctattcttaacagacataagatgattcatactggagagaaactctacaaacctgaaagttgtaacaatgcttgtgacaacattgcaaagatttccaaatataaaagaaattgtgctggtgagaaataatagaaatatgaatgtgacaaagcctttaaatggttatcacactggattgtaggtaaggtaattcattctggagaaaacttctacaagtgtgaatgaacagtgtggcaaaacttacacaatgctcaaaccttattgcacaggaaagcctttatacttgagaacaaatgtacaaatataaagaaagtaaaaaagtgattaatatctgtgcacatcttattcaacatcagagtttatattaatagcattaaaagtgcaattactgtcaaaagagttcaaaaaataagcatttaaagtgctgaagaggatttattttgaagacaaacattacaaatataaacgaagttgtggtaactttacttgtaacacagatcttgttgtattcattctgtattagagcaaaccctgaggcaattgctcaaactttgttcaacatcagagaatttatatcgaagaaaaaccctgtaaatgtaataaatttagaaaaaaacatttattcaaaaactacaggttagaaaattccagagagttcatattaaaatatttttgcatatacagtaaatagaaaaaaatatttaattcaatggtaagtttatgtaaatatcagagaatttatgttagaaatatataaggcaatgacacttcagactttacactgaatcagagttctgagtttagaaagtaatccaaaactaaacttggcagaaaaattatttgtttataactttaaaagagtagaagattttttggagagttacaagtatacttttttttagaaagattacagattttttttaaaagtaaataactctcaaattacttcatacaaataatgttgtaattaactcaaattacttcgtgttaatgttgtaattaactctcaaattacttcatgctaaggaaattagtttttctttttcttcttctttttttttttttttttagatggagtcttgctctatcgcccccccaggctggagtacagtggcacgatctcagctcactgcaacctccgtctccagggttcaagtgattctcctgcctcagcctcccaagtggctgggattacaggcgcaaaccaccatgcgtggctaaattttgtatttttaatagagccagggttttgccatgttggccaggctggtctcgaactcgagactttaggtgatcc

SEQ ID NO: 12 - DNA, 27629 bp, Homo sapiens
cgcggggcctgctgggaggtgttgtcctcggaaacgtcgctggcgcggagggatggttcggcgctttaggcgtctgtcacagacctatctgcgggtcgccttcacccagcatctcagaaactgcgcgcgggatgaacattcgggtgtttccggcaggtgacgctgccgagtccccgcagcagggggcgagcaagggactcgcggttgacgggacacggatcctctaaggcccagagtgtcccgagtagcggcagtggggagtgctcagggtacgctaatggtgagtggttgcagttgatgggacaaaaaactgtgatgggagttagtgtgggtgtgtggttgtgtgtgtgagtgtgacggcacgaataatctgatggggtgattgtgatatttggttgcgcgggattatgatgaaatgtgtgatatgtgtgtgattatgattaaggctgtagcgagtgtgaacgtggcgaagtgtgcgtgattgtaatatgtctagtagttcttgtcttgagctggcttttctgtagcatttggcacagttggtaacggcttgaaaaacacttatttgttttctactgatcctccctccttgttggccactcctctgtagtcttctttgctgtcttttttaccctagtagcccttggccctttgtaattttccactattccttggcgaacttttcaggttcattattatcttatgacttgctgcttttatgtatgttagttagctattgccatgataataattatgtctaaaaaccacccctgaactcaatgccatacaacagcaagtccttactctcctgttcacaggcttgcgcattgactgtgttcagctgatctaggtggggcttggctgagtggataggctgcgtgacgagttaagatctgcgccgcatgtgttctttcagggtctcaggccaaaaggacatttgttgccagggcatgctctgctcctgatgggtcaccagagcgcaagagagattgcctcaaccagagcaagtcacatggctaagcctaaaatcaattatgcccacagttggagagcaaagttacctcgcaaagagtatgaataataatctattagagggtgtgaggaattggactaaaattccagtctaccaccttaagaaacatacctctttatcctggtgaatgccttttagtccgggttctcttttgtctgataatattgcttttcaagttttattgtatttcttaagaatttcattttctaacccccttgtgtctttatgtttcagatctgtgtcttgtaaagagcatattgctgggcttacatccgtttatcttgtttgactgttattttaataggtgagtatagttcagtggcatttatcatgattgctcataaaaaatgttttattttctattacgccttaaacatttttgattgacatataatagttgcacatatatctttttttattgtgcaaattcaccttatccctttttctcccctaggttggtttctgctattatccttttttaatatgcatgcttaacaaaactcaaccttaagactttaaaatacttgaactccaaaatatccaccaatttctgtgttattcttgtctcatatattattttcttctagtttttgttgttgttgttgttttgttttgtttttttgagacggagtctcgctctgtcacccaggctggagtgcagtggcacggtctcggctcactgcaaactccgcctcccgagttcaagcgattctcctgcctcagcctcccgagtagctgggactacagacgcgccaccacgcccggctgattttttgtatttttagcagagacagggtttcaccatgttagccaccatggtagatctcctgacctcgtgatttgccgacctcagcctcccaaagtgctgggattacaggcgtaagccaccatgcccagcctattctcttctagttttaaatccccaaattagtagtagtagctcatttattctatatacagttcgtatccaggaggggttggtttcaagaccccccatggataccagaatccacagatgctcaagtccctacatccttctttatacattaaatcatctctagattatttgtaatacctaatataatgtaaatgctgtgtaaatcattgttacacgttattgtttagggaataatgagaaaaaaatctgtactgtacgtgttcagtacagacacaactgtagtaggcctaactgtattttttatctgaggctgattgaatctgaggatgcagaacctgtggataaggaggaccaactatgtatacacacatgtatatttaattgtggtaaaatacacaacatagaatttaccatctaaaccatatataagtgtacagttcagtggcatgaagtacattcacattgttatggtaccgtcaccaccatccagccagagaactcttcttcttgcaaaacagaaacccagtacctatcaaacaataactctgtacccccctttcccccggcctatggcatctaccattctactttctgtctctgaatttgactattctaaatacttcatataagcagaatcatatgttgtttgtgcttttgtgaccctgatttaacttagcataacgtcctcaagattcatccatgttagcatgtattggaatttcctccttttttaaggccgaatgataagtatgtcatatatggataaatattttgtttatcaatttattcatcattggacacttgggctgcttctaccttttggcaattgcaagtgacactgctacaaacatgggtatacaactatctgagtccctgctttcagttttttatatatacatgtggtaatgtctgtttttaatctttgattgtcatagtgttttcgataatgactgaaccattttatcagcatatttttgagcacctactatgaatatcaaaaacagacaaaaataagtccttgttttcatggagtttatgttgaggggggtgggtggacagtatatataactaaattatagtcatgtgccatatatgtatggactatatacatacatgacagtggtcctgtaagacagtggtccccagcctttttggcaccagggagtggttttgtggaagacaatttttccagggactgggggatgggagggttatggtttcaggatgaaactgttgtccctcaaatcatgaggcattagattcctataaggagcaagcaacctatatccctcgcatgcacagttcagaagagggttcacactcctgtaaggctgtaatgccaccactaatctgatagaaggtggagctcaggcggtaatgctcactcacctgctgctcacttcctgctgtgtggcctggttcctaaccaggaaccagtactgtaccagtaccggtacgtggcccaggggttgaggacccctgctgtaagattataatggagctgaaaaattcctgtcacctagtgactttctagccaatataacactgtagcacaataccattactcatgtgtttgcagtgatgctgctgtaaacaaacctactctgctgccagtcatataaaagtataacataaaattatgtacagtacataatacttggtaatgataataaatatgttactggttcatgtgcctactatactatactttttatcattactttggagcatatgcctatttatttaaaaaaagttaactgtaaaacagcctcaggtccttcaggaggtattccagaagaaggcattgttatcatagaatgtgatagctctgtgtgtgttattgtccctgaagatcttccagtggggccagatgtggaggtgaaagccagcaccaatgatcctggacactgtgtaggcctaggctaatgggtgtttgtgtcttaatttttaacaagaaagtttaaaaagttaaaaaatttttaagaagatagcttatagaataaggatataaagaaaaaatatttttgtacagctgtacaatgcattttaagctatgtgctactacaagagtcaaaaagttttaaaaaattgaaaagctggctggacacagtggctcacccctataatcccagcactttgggaggccgaggcgggtggattacaggaggtcaagagttagagaccaggctgaccaacatggtgaaaccccgtctctactaaaaatacaaaaattagccgggtgtggtggcagacacctgtaatcccagctacttgggaggctgaggcaggagaatcacttgaacccaggaggcttaggttgcagttagccaagatggtgccattactccagcctgggtgacagagtgagactccatctaaaaaaaaaaaaaaatgaaaagcttataaagtaacaaagttatagtaagctaaggctaattcaacaatttgaagaaataaaaattttataaatttagtgtagcctaagtgtacagtgtttataaagtctacagtagtgtacagtagtgtcctaggcctttgcgttcactcgccactcactcagagcaacttccagttctgcaagtttcattcatggtaagtgccctttaccagtgtaccattttttatcttttatattatatttttaccatttctctcctgtgtttaggtatgtttagatatacaaacacctacctttgtattgcagttgtctacagtattcagtacagtaacatgccatacaggttcgtagcctaggagcaataggctataccatatagcataggtgggtagtaggctataccatccacatttgtgtaagtacacttatatttgcacaatgatgaaattgcctaatgacacatttctcagagcatatctctgttgcaaagtgatgcgtgactgtatatattaatagtttgttagaaagtgatcactgtcggccaagcatggtggcttatgcctgtaatcccagcactttgagaggctgaggccagcagatcacctgaggtcaggagttcaagaacagcctgaccaacatggagaaatcccatctctactaaaaatacaaaattagccgggcgtggtggcgcatgcctgtaatcccagctactcaggaggctaagccaggagaatcacttaaacccaggaggcggaggttgcagtgaactgagattgtgccattgcactccagcctgggcaacaagagcgaaactccatccaaaaaaaaaaaagaaagaaagtgatcactgtcatgaaaaaaagtgagtgtgtgaggggtattaggaggatatctcaagcatagcacttctcaaaacttattataactgaatgttttctgttttatttgttctatcatacagggcaaaaattagtctattttgttacatatattttttttttaccctttacctaataaagactcatagcagctgctaaattaatatattttaatagtcatttcgtatattcatccaatattattgtgacatgagtataattgtcatttcagatgaagaatcttggaattctaaattgcaattctcccttaattcagttgccaagataatacagaaatggaatggaatagctggtctttgaatgaaactctcttttatgccaaatttggggttgctgcaaatctgggtgttttttgactcaggtttacatctgtcacctcatcgagcatacacctttagacacagaagatatctgaagaacagataggtaaacatcacttggtttatgcctctggtcagtgtgtccagagtgtatgaattacaaataaggaagattagtgtttgaggctatattatctattagtgtgtaacaaattacctcaaaaactagtggcttaaacaacaataaacattatctcacaatttctgtgggaagtgtcttcactgcgtatttgggcttgggtatctcatgaagttgcagtcaagttgtcagccgggctgcagtcatcagaaggctgggctggggctggagggttcacttccaagatagctggcttccaagttagtgttagctgtcaacaggaggcctctccctagggctggttgagtgttgtcatggtatggcagctggcttccctcaacatccatgatccaaatgtgcaagacagaagccctaatgtcttttataacctaaccttagaagtcacacaccatcatttctgcaatatcctattggttatgcaggtcaaaggtactcatggtgggagggatctacaaaggcatgaataccagaagacggtggtcactgggggccatcttggaagctggttatcacagggagccagtgagaaggcaccaggtaaattagatttatatcctaatccacaggtcctggttccacaaggataaaacacatctgcagtgcaaatagaagtctgaggaacaggtgtcttatcatggaaggagacctgacctgagacctgccttagaggctggagagtcctgaaagagagtggaccctggagttgctggagcttgtcttgacccttctgcccagagcaggcagggtctgaatgacatctcaatcttcagtgatcagcaatagctgtgtgacaatggagcgtttgagccacatgatggaaaggaaaggtgaggtggctcataggtggacagagcttaggagagaaaggctctacatttggggacagtgaaaagaaattcattactcctactgagaaaggtcacgtatgttaattgactaggcaggggagacatttgtttttaatcatattcatttgactatttgattttttaaaataaattttgaaatgcaatttttatttcttaagagtatgtttaagtatatctttaaatgctgtactataacataaacaaaagcttcctattccatccatcctggttccctgtccccattcctgaaaggcaaccactttgaacatttttgtctcaatattctggtattcacctccttttttctaaataacattcttacactgctaatgcttcatttctcagttttagatatttcctgttgatttttgataatgaagttaaggatttagctctctttcactacctaaccccttccgtttcatctccaccccaacacactcttctccttgcccttctttctaatatggtattattttttggaggttgaaggttgaccagatgtcagcatctgtaagcattttcttttgggctagtcagtttccccagcaagaagtcctagattttgcttgagaagtacaagccagaactcctgctttttgggagacgaaggaagtgagcatgttggacacctcatcttgcaatatgagaactttaattcttttctctctgcattgcttcaaccccacctttatctgcatctggtatgcctgaaattcagagcttgtctcattcagtttatctagagaaataatctttaatttttttctgttgccaatgtgagggaaatgtgactatgccatgttgggtgaaagaaaacatcaggtggttttaacatctttttatgacatcttacattcggttttatgtttttcagccctactcccaaactctagtccacagaagtaattagtagctccattcctgaacctttctagggtcttgtcatggcttccccaccctcctcccaccttcacttaagcttcagctttctctggttaagttagataccactcatttgtctgctctttagcttcccacattttgttgacagctcttatctgtggaaatcttctatattctttgtccttatgagttttagcctccttttttcctttattaacattatgattggtttgggagagagtggaaatattaataaatgcaggtattcaggcttttatttttaaccaaaaggccctgaattttttagggtaaaaaataaatcaagttttttaaaaatgtcattagaaacatgactgtattgcatcctatcttatcaatgttccacattacctatagccagtctctgatgaaggtttttttctaaattattttttttgagggggagacagagtctcgctctgtcgcccaggctggagtgcagtggtgtgatctcggctcactgcaacctgcactttccgggttcaagcgattctcctgcctcagcctcccaagtagctgggactacaggcgcacgccactacgcccagcgaatttttgtatttttagtagagacagggtttcgccatattggccaagctggtctcgaactcctgacctcgtgatccgcccgccttggcctcccaaagtgctgggattacaggcgtgacgaccgcgcctggccctaaattttttatggttaaaaaataacattttaggccaggcgcggcgtcacgcctgtaatcccagcactttgggaggccgaggcaaatggatcccttgaggtcaggagttcgaaaccagcctggccaacatggtgaaaccccttctctactaaaaatacaaaaaagttagccaggcatggtggtggatgcctataatcccagctacgtgggaggctgaggcaggagaatcgcttgaacctgggaggcagaggttgcagtaagcagagatcaggccactgcactccagcctggacggcagagtgagactccatctcaaaaaaaaaaagaaaaaaaaattttaaagatcatcccaatctttaaatttttggggtaactattattatgtacttaagataaacttcctgttagaaataaaacagcaagattctagggagataaaatattgccaatagattcattgggcactgcatacttagccctccataaatccccatcagaccccatatgattaaattagccatctgtgtccatttcagtgtctatagctagatggcagttaacatttcttattgcttcaaggatcattcatctgtagagggtcttctagccacctggtactgaagatttctatattcctttgtctgaaactttgaagcaaatctgtttcatttctcttccctcagcttggtgttctcaagagtctgccctttccgaggaagaagaggatacaaccaggcctcttgtacgtcttaagcatttatttgtttcctgcattattttgcagtgcagttacggtgggttcttgtaacctaccaatgtgttggaaaaaataaattgatgaaaataaaagtgagaaaaaatacagatagaaaatcagaacctggggaaatttgagatatggctatgcagaagcaggtacatacagaattattaaagttgagttcaaatttaaatatgatctggacagtcaaagcaaactgggacacttaagtttattccgtaagtccataagttgcaccatttatgaggaaaaacttacaattatttaagtaaaaggcttttaactggcaccttgttcaaaaagaaactctaaaatatagttggacttctgtatctgtagattctgcatccatagattgaaccaactgcaaatcaaaaatacttgaaaaaaaaatgggtggttgtatctgtactgaacatgtacagacttttttcttgtcgttttctaaacaacatagtgtaacaactatttacatagaaatcacattatattaggttttataagtaatctagggacgatttaaagtatacgggaggacgtacattggttacgtacaaatcctacaccattttatataagggacttgagcatcagtggattttggtatccgtggggggtcctggaaccaattctacatggtttcctagggacgactgtaattccttaattcttacaatttttagcttagcttttagaagttggtcttggccaaacttcaaaaattcaaattacctggaagagtaagtggaacacatatctttcaaatgatcctacgtatatattttcttcaattgagtttttaatccaagttgagctaaattatactaatattctatggcagaatcttatagttctgatatccatagcttttcacatcttttttatggtctcagaagatatagtcttcatcctcatcttacaaaattacgtattctctgctcttgattctttttgtttccacctctgaagtcactcacacacctatattttgaatgttttctgcttaactgcctctttttcttcagcttatgtctttcacatcatgaaatatacacacatacttcttttgaccatatgatcatatggctcatccagttacttctgttggcgcggtggccctagcaaacctctctggccctcgacaggcttgagtttaaatcttggctcagtgacttatgaagtgcatgactgtggacaagtttcttaatctttttgtgactcagttacatcatctgtaagtctataaatggggatgataatggtatttatcccacaggaatgttgggagggttaaatacatgtaacaagtaccccataaatgataggcattgttatttttttctcaaatatttttggtctgccattggttgaatccatggatattgaacccacagatatggagaaccaactgttacagctttattgagttcttactatgtgccagatgtattgtgctttacatagcttatttcatgtaattattatcagacgtctatgaagtacatattatttaaattttttaagataagggaaatgaagcacagaggttaagcttacataacatcgtgcatcaatgtgtcataaacccaggattcaaatccatacagtctgactctagggcccacactctacgatactgtacagatggaggctcattatgagtgaagaaatacaaaagccaattacccattcatattgtttgtctattttgtaataatagttttttctgtattcgaaattagaatattttaagaatgtctatttcagtattaggacttaggatttatgcagctaccttctcccaatctgtcatttttatgttatttattttttgttgtatagacattgaagtttggatagttacatttagtgtatgataaatatgtatacataatagaattcagtcaaaatatgcaactattaatatttagtagtcttttctcatgagttgccaatgttaatcttttctaagatatctttcctaattaatattagatcatagagataatctctgttcaaagcattgttttccatatttagtctttaatccaactggattataatattgtaattggtttgagataggaatttactgataattctattagtagaattatctttgcatgtagaagaccagttgttccaacaccgtttattaagtagatctttcctttgtgatgccacctttactgtatacatacatgatggtttctaggcttttactttttctgtaatctatttgtctacatttatatcagtactgtactttgtgtgtgtgtgttttacattggtttaattacaattactttatatgggcaatgatttcaccacttctttatgcacacacattattcttagtttttcaaaaatttttcagctactttgggacctctgggcttccatttgaattttagaattagtttatctagttctaggaagaaatcctattggggatttccattgaattgcacaactagttggagaagaattaagcaaaaaatacatatatataaaaaatatataaatatatatatatataaagatatatgtgtgtgtgtgtgtgtatatatatatatatatatatatatattatatatatatatatattttttttttttttttttttttttttttggtgatgaagtcttgctttgttgcccaggcttgagtgcagtgacacgatcttggctcactgcaacctccacctcccgggtttaagtgattctcatgcctcagcctcccaagcagctgggattacaggggtacaccaccatgcctggctaagtttttgcatttttagtagagatagggtttcgccatgttggccaggctgacctcaagtgattctgacctcaagtgatccacctgcctcagcctcccaaagtactaggattgcaggcatgagccattgcacctgtcccgaaagatattttctgtcacaattaaagatgtttccatttaagggaatctattaatataaattattatattcaagagaaaaacaatcagatctatagagctgaaaatttttttaactcagaacctgtgatttcaaaaggacctatttataaagtaaaagtaaaagaacattttcttatgatattttaagaaattattcacacgcatacaacacatatatatgtgcagataataagctacaagctagtaccatgtttacttgtaaaaattaggcactttcctactagtcaggaacacaaccagcttgccagtgctactactacgattttgtatgcctagacataagtaaggggagggaaatgaagtaaaaagcaggatggtgcattcaaaattatgatatctaagtgatacaattatgtttttaggcaacagaagagaaacacaagaatgattgaaatatggacacaaaattaatatacaaaaatcaataccatttttctctataaaccacaccatcaaaaatgaaatggaagaatgatgctcagactagaaaaaaacccgaaagaaaaaaataaaatgtatgtggtgtacatgggagaatgaaaccttcaaattattactgagatagaggatttgaacaaattttttaaatacccttttttggataagagccatcattattaaattaatataaattgtctttaacctacatagattgatcagaatctcaataacaattctaaattatttttcttagaattagacaagtttatttgagccgagtctagaatacatttgaaaaataaaaacatgcagaatggccaggaaaagtataaaagaatgtcatgtgccatgctctaagtttttaaaagaagaatatttgtttaatgcttacataactttagggaaaaaaaaattttataaaaagttgccagtcaacatatacacccagaactgacttgtagttatctttattccctcactgtaaactttgttattttaaacaattatattctattatgtatcttaaaagtgaagaaagcgaggcatggtggctcacacctgtaatcccagcattttaggaggccacagctggaggatcacttgaggccaggagtttgagaccagctggatcaatacagcaagacccagtctttacaaaaaattttaaaaaattagctgggtgtggccaggcgtggtggctcacgcctgtaatcccagcactttgggaggctgaggcgggtgaatcatgaggtcagaagatcgagagcattctggctgacatggtgaaaccccgtttctactaaaaatacaaaaaattagccgggtgtggtcgtacacacctgtagtcccagctacttgggaggctgaggcaggagaatcacttgtacccaggaggcagaggttgcagtgagccgagatcgcaccattgcactccagcctgggcgacagagcaagactccgtctcaaaaaaaaaaaaaaaaaaattagctaggtttggtggctcacatgtgtagtcccagctactcaggaggctgaggcaggaggattgcttgagctcagcagtgagtcttcagtgagctatgattgtggcactgctccagcttaggtgacagagcgagacccagtttcaaagaaaaaaaaaagtgaaggagaggaaggtgctgtggtaccagcaagaacattggaaatattattgcctcttgccaggggcagaagcgtgttcatgtttttttttttttttggttctgtttgacaggagaaggaataaaacttaatgacatgaactgtgaatttatgttttttaaggttcgaacccctatgtttcttgctattaatactgaatttcttaacatttgtatgtgaagagaatcaacatcttgggaaaatagaccctattgtaaagactgactcatcattttatacagtcaaaaattaaagcatattttacttcttggtattttgttacttatggcttttgtcagggatgcaatttcttttttttttttttgagacagagtctcgctctgtcgcccaggctggagtgcaatggcacaatcttggctgactgcaagctccgcctcccaggttcacgccattctcctgcctcagcctcccgagtcgctgggactacagacgctcgccaccacacccggctaattttttgtatctttagtagagatggggtttcaccatgttagccaggatggtctcgatctcctgacctcgtgatccgcccgcctcggcctcccaaagtgctgggattacaagcatgagccaccgcgcctggccaggggtgcaatctttttatatgagatttatgctaagttactagagttggtgggaaaatgtttttgtgctgatttgttagcactaatttaaaaaatgttttctctttttgtagttttcccctatctttgttgtggtgtatattccagagggattatctatttctgaaacattcatcagttgattattgtgtcaagctctgttctgagtcacatttactgtgttatttagtcttcacatcaaccctttaaggagaattccactttatagatgaggaaactgagactcaagtttggctatttgtcaaggtaacacaattagtaaattttgaagccagagtttgaacccatgacattggataccacagcctattaactggtaaaaaatatctaaacccagctccgttttgaaagtttagtatttcagcattttttttcagtcagaaatgtgtcagtcacatgtctgttcagcctttctgctgcttttgtgaatagaaaacaggcgttcattcttatccttggggtctgcaggttaactatgtgggcatctctgctttgggctgcagatcagctggccttggcttaggctccacagtgggcttgtgtctgctctgcatatattcattctgagtttcagctgaaatggcacagcttcctgggccaaggtcttcatttgctgtctcactggagcacatgagccaaggtaaagggtgtaagcaaatttcaggcctttgctcacatcatgtttactgacattccttttgccccaacaaagggctcagacaaggcccacattagtagatgggacattagtacaggcaggaagtgaagactcgctgaataatcaatttatcacagtaatattttctaatggaattattttttgttgagtttgtttttgagaccaggacttgctgtgttgcccaggctggagtacagtggcatgaacttggctcaggtgatcctcccgcctcagcctcccgagtagctagatgataggcatgtgccatcatgcctggctaatttttttattttttatttttcgtagagatggagtctcactatgttaccaaggctgttctcgaactcctggcctcaagcagtcctcctgcctcagcctcccaaagtgctacgattataggtgtgagctactattcccagcttcactgagattttttaaactttaaacatattgaaatatagtcttataacttaaaaaaactttattaacatataagtcacatactataaaattagcccatttaaagtatacaagtgagtggtttttagtgtattcacagagttgtgcaaccatcaccataatcaatgttagaacattttcatcaccctgaaaagaaaccctttacctgttagctttcacttcctgttttcccttaaggctctgatgtaggcaagaataaatgatttctagctctatggatttgcctattttggacatttaatgtaaattgagtcatatgataaactgttatcctttgtgttgcctttcgcttagcattatgttttcaagtttcatgcattttgtagcttgtacgagtactttttatttctgaataatattctcttgtagggatataccacattttctttattcattgattaatggaaatttgattcatttccccttttaggctattatgaataatgctgataagaacattgatgtacaagtttttatgtggtcatatgttttcacttctctgaagtttgtacatagaaatgaaattgctagatcatatggcaactctatgcttaaccttttaaagaattgccccactgttagccgagtgcaatggctcatgcctgtaatcccacactttgggaggctgagatgggcagatcacctgaagtcaggagttcaagacccacctgaccaacatggtgaaaccctgtctgtactaaaaataaaaaacaagtagccgtgcctggtggcacatgcctgtaatcctagctacttgggaagctgaggcaggagaatcacttgaacctggtaggcagaggttgcagtgacccaagaccacacaccattgcactccagcctgggcaacaagagcgaaactccgtccccagaaaaaaaaaacagaattgccctactgttttccatagcagttgtgctagtttacattcccaccagctgtgtatgaggattccagtttctccatcagcacttgttcttatctgtcctttggttatagctgtcctagtgggtgtgaagtaaagctcatgagattttgatttacacgtactgtataacttgtgatgttgaacaccatttcctatgtttgttggccatttttattaatatatcttctttgaagaattgtctattcagagcctttgcccacttctaattggtttgtcttttgattattgaacttttaagaggtctgtacatattcaagtgtcatcagataaatgatttggaaatattttatcctatcctctgggttgtcttttcactttcttgatgatgtccttagaagcacaaaaatttttagttgttctgatgtccatttttatttaattttcttttgttgcttgtgcttttggtgtcatatctaataaaccattgcctaattcaattgaaggtcataatttacaactatgtattctgagaccttttttttttttttttaagctcttacagctagatctttgatccattttgagttaacctttgtatacggcatgatccaccttcattcccttgcatgcagacagtccagttgttgtcccagcatcatttgttgaaaagactattctcttccctggtgaagttttttatcaccatttattatgatgtgggggttttgtagttgccctatatcatgttgaggaagttcccttcttttgcttatttgctaatttgttggatgttgggttttttggttgttgttgtttgtttgttttcaatgataaaagggtgttggattttgttgactactttttctgcatttacggagatgatcttatggtttttgacctttattatattggtatgatgtattacattaattatcagatgttaaattaatattgcattctgctggggtaaatcctacttggttatggtccataatactttttatatgttgttggattaggtttgttagcattgaggatttttacctctctattaataagagagagtgggctctagtgtttttttggggggtggtgcgtgtgtgtgtgtgtatgttctttgtcaggttttagtattagggtaatacttgcctcataaaagatgtgtcccctccttttattcatcctctttgttttggaagagtttgtaaataagttagtattaatttttttgttgtttgttaaaattcaccagtgaagccatctaggcctgagtttttcttttgggtaggtttttttttttgttttgtttttttgttttttttttttttttttagtaattcagtctcttgttacaagtcttttcatcttttctttttgttgcagtttaatcagtttgtgtctttctagaaattcattcatttcatctactctagtttgttggcatatatttattcataatatttctttgtattcctgtttatttctgtaagattagtagtaatgtttcttctttcattcctgatttttgtattttgagtcttcttgtcagtgatatttgtccattttgtcaatttttagttttattgattctctctaatgtttttctagtctaaatttctttgatttccattctgatgtttgcttatttccttttagttactttggatttagtttgatcatcttcttctagtatcttttttttttttttttttaattgaggcagagtctcactctgtcacccaggctgaagtgcagtggcatgatcatggctcagtgcagccttgatctcccaggctcaggtgatcctgccacttcagcccggtcccctaagctcccagtagccgagactactggcatacaccaccacgccctactaagtttttgtattttttgtagagatggggttttaccatgttgctcaggctggtcttgaactcctgggctcaagcaatccgcctgcctcggccttccagagtgccagattatgggcacgcccagccctcttctagtattttaaggtagaaagttagtttattgatttgaaatctttcttcttttttaataaagtgtgtacagctataggtttccctctaaaacttgctttaatggcattccataagttttggtatgttgcaccctcattttcttttacctcaaagtattttgtaatttccattgtgattttgttgatccattggttatttcagaatattgtttaatttttacatatttttgaatttcacaaatttctttctgttagtgatttctaatttttgcccattgtgatcaaggaacatactttacacaattctcttaaaatttattgaggctttttttttttttaagagacaggtctggctgtgtttccctggctgaaattcagtagctgttcacaaacataattatagttcactatagccttaacctcctgggctcaagtgatcctcttgcctcagcctcctgtgtagctgggcctattgaggcttcttttatagactaacatattttctatcttggagagtgctctatacacttgagaagaatgtatattctgttgagtggtgtgttctataggtgtctgttagatctggttggtatatggtgtttgagtcttctattttcttgcttataatctgcctagttgtatccattattaaaagtggtgtttgggctgggttcgggggctcacgtctgtaatcccagcactttgggaggctgaggcgggtggatcacgaggtcaggagttaaagaccagcctggccaagatggtgaaaccccatctctactaaaaatacaaaaattagccgggtgcggtggcaggcgcctgtaatcccagctactcaggaggctgaggcaggagaattgcttgaacttgggcggcagaggttgcagtgagccgagatcgtgccactgtactccagcctaggcgacagactgagactctgtatcaaaaaaaaaaaaaaaaaagtagtgtttggagtctccaaaaattattgttaaattgccagtttctgccttcaattctgtatttttgctttaggtattttaagactgttagatgcatatataattgttatatctttctgccagattgacccttttatcattataaaatgtcctttagtaacagttttgttttaaattctattttgtctgatattagtatatccactctagctttctatggttgttcgcatgctgtgttttttccatcactttattttcaagctatttgtatatttgaacctaaaatgtatttcctgtagacagcatgtagttgaattctgtttttctatccaatctgacaatctgtccttttttttggcctgtttaatccattcagagttaatggtaacactaaaattattgggctatgtctgccattttcctttttgttttccatatgtctcatgtcattttttgtttctcctttactgctttcttttcactaagcaaatattttccagtataaaattataatttctttaatgatttttcactatattttcttagtggttgctctaggacttggatactatgtatcttatcagaacctacttcagatttatactaagttccattaagatatggaaatgttggtcttatgtagctctattccctcttcccttgttttgtactattattgttatatatgttacagactcaacccattattataattactactgcatataatgttgcatcacttaaagaagctgagaaaagagagcaaatatgtattatgtttattatattaaccttatttaccatttgtttgtgttgattcaagttctagtaaatcttgtgtcattgcttactctattccaaatttgctctgaagattctctctttatctctggttttcaacatttttgctatggtatatctgactgtgggcctcttacatttattttacctggagttcattgagcttcttgaatgtataatgttttttgtcagatttgggaaatgtccaaccattatttctttgaatgttttttctgcacctttctctcttcttcttctagtactcctacctctgacccctgagtaccagctaaacaagttcttgtatgttgtgatcacaatgcctaattttgatgacttcaaattaattagcattatgtttttacaggaaacagtgacatttaaggatgtggctgttgaccttacccaggaggagtgggagcaaatgaaacctgctcaaagaaacttgtatcgagatgtgatgctggagaactacagcaacctagtcacagtgggtaaggtggcttggtagccttgcaatttaacagagaattcttttccatttctgaaatgtgtgaagactgtaacttgccagatgaatctagcctttcctttctccatgtgactatatgtgctccactcttcagtgttaaaggctgattactttgtgtcattgtgtaagttcattcatcctcatcttttataagccctcaagcttggacttagcctaagatctgaatggttgtctccagcattgacatccacatcctttgctatttcttgtaataggctgtcaagtcaccaaaccggatgtgatattcaagttggagcaagaagaggagccctgggtgatggaggaagaaatgtttgggaggcactgtccaggtgaataagtgaaaagcagctctgaatgagaaagccacatgagagttgttcagtgaagggttgatatcatttcacaatttccaagattttcttaaaggccttattcttctagagtgacaaatgggatggagtgctttagattactgtgacatttctaggtattattcttcctattttgcagatattttcctcttttaaattgtagagggccagtagccctatccaatttcataataccaaccttccctaattcattcacagcttcactttcaggattattgttcctctctctatgatcctcgggcactctctttcctttatgtttatggtttcattttcttatgcattcagtatttcatggttgtgtagtaattttaaaacatgtttcacacttaggtttcttttcatttctttccttctttcttttttaaaaagccttagatttgtgtttggttaacaatagtttcacttcccattgtgcttcacaaccctcacaatcccatggcttagaaatgtaaaagtttctggcttagaaatcccatggcatctcctttctgcttattcctgccttccattcctttaatttttttgaaactacatgaggtccatccttggttgaaaagatataaccaatgtaaccaatattatacctataataccaatattataccttttgtgcaaaagtaaatcttcctcttatcctggacatggtcccttcctttccacagttgcatacacttcttttttggagttatcctggctatttttgattatttattttaccatatgaattttagactaaactgtctatttccagagaaaaacctgttggaatttttattgggattgtgctaaatatataaattaactttcagaaatttaacatccttttaatgccaatgttttctgtctaagaacacacactgtctttgttcagattttcatatctacttctgtgtcctttagaaatggagctttccaagttttcccattgttgcttttatacatttcactataataatgggtaagaaagctataaaaccatccttatttacagataatgagattgtatccctagaaaacacaagcaaaccaattgagaaagtacaacaaatagtaacagaactcagtgaggtggtaggatatcaaattaacaaagaaaaatcaatagctttcatatatacttcaacaaccaagtagaagatactaaggaaagaaaactacatttatagtagtaagaacaaagatgaaatactcttctgggcatggatatataacagtataccaaacaaaatcctgtctttatgagcttataatttaatggaaactagagtccctgaggttttgcatatgggaaaatatctttttaacctttacatttggttgatagttggctgtgtgtaaaattcttgaaccatactttcttttccaaagagttttacagacagttacctgagggatttagacaattctctgttgtttcctagattcaaatgttgcttggagaagtctgaagcctgattatttcccctcataggtgacttattttccaggatgcctataggtttctttttctttaaagcttaagtggctttatgaggctatgccttggaattgatcaatcagtatcagtttttcctttcagcttgtggattcatgatttttgttccttgaaatgtcgtcatatagatttcatgctcgtttcttttgtggttatcattgtcatctttcgatgaaggtatttcctgctgtagccactgtttacagaaggatagtgttgaagactgtccagaaaaatactctgagttggtaagaagtctctatacctcacactgacctcctttatcatacaaggttttgtgttgagagttggtttaccctttcattctcccaagttaaagagagattattatttgcatacttcctctagaactcagtgtctcttccatcttcctatgctaacaaactgcttatataagaatactggctgtttgcatctctttgttcagccctgcctttgtaccatttgtcagggccagatgaagtccattctgtacctgccacaatttcaagacatctggcaaaaaaatgactcattcattctgcccacaagggggtgcctctgttttagagaactctgttccctgtactttttgttggagataagaaacaggaactgctatctctgggtttcttccctgcctaatccagtctattttctgttctttcctcctattctggggatggagtttagctatctttaaggttcattgaagatgtattttctttctttttttttttttttttttttttttgagacggagtctcactctgtcatccaggctggagtgcagtggtgcagtctcagctcactgcaacctccgcctcctgggtttaagcgattcttctgcctcagcctcccaagtagctgggactacaggcacgcgtgaccatgcctggctaatttttgtatcttttagtagagacggggtttcaccatgttggccaggctggtctcgaattcctgacctcgtgatccgcccacctcggcctcccaaagtgctgggattacaggcaagagccactgcatctggccagaagatatattttctttttctgtttcttcttcatgtttgcagagtgaagaggagacagagatgtttaattctaccatattgaaacaggaagtcctctatgctgtatttgatccatttcacccttcttggaaatgtctttcttctttgtgcttctctaaaggattcaaattcttccttggttctggtttattgtttatttcttcttcccttgtgaaatatcttttacatgacttctttctcatctctcactggacatcacccaaagtagttctgaattacaatagacttctttttcctcagagtaccttcatgctatatctgtgttcatgctattaaataggtatttaactctagaaatgacagcattggaatatgtatctttaatgcctccagaattttgaaactcttcatatctctgccattaattatgagtgctcttacctaagttctagcagttatttaactttaatatcattttctaataaatggtcctcaatatttccagcctacattggtcttgcccatctctcaactaacattctattacacgtctaccagagtggttggaatctgaaaacatatactatcttctacatgttttcatattttgatgtctaacacttgtttattagtccacctggagaaagaaaacttttattcttcctataaatgagtcatgattgatgtagagctatatttgggaagatttttcttatttttggttgttttaaaatatttacctacagatttcaaaataaacgtggaagaaatcaggctagagttagaaagacagggcatagtcacatgagatagtgttgaatgttaaattgcatgtgaagtgtctatttagtaaatgagtaaaccagacaacacctagaaagttttaagagaagggctgtagaaggagtaacaagattgaggctttctttttctttttgataagagcttggcattgaagccattttcctgtaagatctatagcttatttagacttattaaaaattagaaaacataacaaaatgtttggaaagtaaaattagcgtgtctgtttggggggtaaaattagaaacatggcctgattagaggagagaagattgtaagagattagtgaaatcaaggatgagttttccattgtagagtcagaaagttctgaattttgctagcattcatgttctcttttgctgtcttttatttttaaaattttgttgtcaatttagtttattttttcccctctttaatcactgaagctatagttttgccctgtgcatggtggcagcaaggttacaatggtcaattataagcaggggtttataagataaacagaatatgaaggttaaaacacatctagttatctgaattttaagttacccacagctgatggaactccaggggcgtggaaaaccattgtagaactaatgatgtaggaatgttatcattttgggtgatggtatgaaagaaaaaagtcaaaacacaatggaatttgatataaaggcagtttcagtgtggagaaataaacataggataagatgataggacctgctgttaacacactgtggtgaatcaaagatggcttgcctcctgatcagctttatactttttattcaataaaattagaccttcctatttctaatatgccttgttctttaagcacatataaaaatgaatcacaattagatggaaagttggagctctctccatatttattaccaattttggatcgtatttagtttggacagactaatcttcaagtatgtttagatagaaataaaggaatttgaactttatgaaaattaatttgcctgtggtatgcagactgcacaaaagatagacttgtcaggatcatgacagttaatctaggcaaaagtaatgagaacttgggttatcatttgtttctcttaacctaatgtagctgttattatttctcatgccatttctttcccttttaatatgcatttttagttttttcaaagtataccttatacattacttgttttagagagccagtagaaatgtcagattatagcagtgctgtgctctgacctcacatttcacctcctttagtcaattatttttgactttttttaactatctcttttgttgtcgacctacgtattttgaaacaaatgtttatactgctctgtaaatttttttttttttttttgagacagagtcttgctgttgttgcccaggctggagtgcaatggcgtgatctttgctcactgcagctctgcctcctgggttcaagtgattctcctgcctcagcctgccaagtaactgggatcacaggcatacaccaccacgcccggctaattttttgtatttagtagagatggggtttcaccatgttagtcaggctagtctcgaactcctgactcacctcggtctcccaaagtgctgggattacaggcgtgcaccaccgcacccagtctgtaaatgtttctgtagtcattttcaaacataagaatagagagataaaggagctggtcgcggcagctcacgcctgtaatcctagcactttgggaggccaaggtgggcagattatgaggtcaggagatcgagaccatcctggctaacatggtgaaaccccatctctattaaaagtacaaaaaactagccaggcgtggtggcgggtgcctgtagtcccagctactcgggaggctgagacaggagaatggcgtgaacccaggaggcagagcttgcagtgagccgagatcacgccactgcactccagcctgggtgacaggaccagactccgtctcaaaaaaaaaaaaaaaaaaagaagaatagagagataatataaggaatcctcatgtattcatcactcagcttcaacagttaccgacattttcttagatttgtttactctgtttctctcttacccccactccagttttgttttgtttttttgctgaactactttaccttttcttttaaatactaccatatgtattgccaagagatttgtttaatcctgcaatatttctaacacacctaacaacattagtaataatttcttactatcatcttctacttagtctctgttatatatttcattgtgtcaagaatgttgtttatggttggtttatttgaatcaggatccaaataaaatctgcacattcttagttcacagactatacaaaagcaggctgtgggtatagtttgccaacccctgctctagatgtaccttattctggatttgccatttgacctccttgtggtggtgtttgacatgcttctttatcccatttttcctataatctggctttattcaatgcagattcaaatctttggcaagtatacctcataggtgatgctgtgtacatcctattgcatcttatgtcagtttgtcccacttacagacataattgagattgatcagtagattcatgtattgtcaggccaaatcctcctatttcagtgatctctgtcaacctttcacttaagggttttagcacctattgaccatcatagcctagatccattattttattgagcgtctttcacttttattagctgaaattctcccaaagagaaaaactctctcattaactatttgattgcactgaaatacagtttctcaggccaggaaaaagaaatactctttctcttcaaaagcttttagaataatgattggtgtcctagaggtttccaaaatttgtcaagttaaatcattataaatttatgtaatttgagcatcagaatatattataggcatataaatatttttcatatattattattattataatattgaagacagagtcttgctctgtcgcccaggctggagagcagtggtgtgatcttagctcactgcaacatccgcctcccgggttcaagcgagtctcgtgcctccacctcccgagtactgggattaaaggtgtgcgccaccacacctgtaatttttgtatttttaagtagagattgggtttcgccatgttggccaggctggtctcgaactcttggcctcaagtgatcagcccgctttggcctcacaaagtgctgggattacagtcatgagccaccacaccaggcccatatattaatactcaaattgtctcatcttgagcaagagggatctttagttaatcttgtaagtttccc

SEQ ID NO: 13 - DNA, 226279 bp, Homo sapiens
cggcattgctcttagtttaaaaaaataaaaatacgtcaatgagtaaatacaaaattgaaataaaatcctggccaagagattgactatgcaaatagcctaggaaaatttcaaaatagcctagaaaaatttcaaagtcatcatgaccaactgatcttaaagatgccccaggtttgtacatttttaagtatcatcacggaccacagagaagagtgatgcacctgaggtaatgactggcgatgcctctccgccaagatgaacactgtggttttacaatatttggtcttcggccatttccagtagcaatcaagtagtgagacctattgtcttccagtgaatgacaatcaaccattgagagtaaacacagttttcataaacttaagtcactgtaggctactcccacgatcttggctacacctgaacagcacctgcattattatttgcttagtcatatcctttaaattaactcctttttacacttaaaatttgttttagaagaccttatactattaccactcatggaaagctactgcagtgaacaaaggtaaccctaaaataggaatacaaaaaaaaagtttaaagtccttttaaagtcaatttcaaagtcacactttaactcatcaaattctagagagagactcctgcctgccaagctctgagctgaagggaaatgagcaaatgtgagacaggctaaagctggtagcaagtgaggctttcttcctgaggtcaccataaagcataaagggaactaggaagggaccgctcagtgcagtgcagccccagctatgtttatgcaccaccgaatcaccttccatttcccatgctttggaaaatgctggatggagaatacctcattctcatttctcagtaaaggagtggtaggctcagacacccatgccaacattcaaaaggtcatgcagctggttaaaaaagcaagaggcacccccctccagatgtgccctccttggcacctgggctgtaggcggcgtctctagctctggcctaggagcctcttagcgggaattgctcctgacccatctctgggaagagagactgagtggagggaagcactgtctgacccaattttccctgatgcttcttgtctcctttaagctgcgattgcttttgatgatcaatgatctgagctctgggcaggctgaactcagccatcgctaccatggttgctccctccccaggctagcccccgggcccggccctatgcccaaggcctgtccccatgacactgggctgctccccactgttctttctcatggccttccacgctttcttccctctccctggtgggactcctcagtggtacagaaaagggaggagtgagacttccatgggcaggacacagcccaggccccaggtcaggaggtccctcttgaacccagaccctctttctggccattttcagcaatgtgagagaacacaggccctgtggctgcctgggaagaccttggaagacatgggcaggccagttgcccagagagccaccactgccctgcccctctcccgacccaggctttcccggggctggcccagccccccacctgagccggatgggcacctctcccttcctggacgagtagcccaaggccgagaactgtgcctggagccagggtagtgacctgctggtggctcacggcaggtgacctggactagcaatgtctgggctactgaccccacattcccactccacaggctctgctccaaagatgaggagaaacccatctcgggcccttttcctgacgaggagacctccatatagaacctagatattcttgcgaggtgctcatatgacatgattcaaaacccggagtcacggtggggtgtctgcacggtttgctatcagattttggaaaatacctggggaggggagatacacctttcagggggaggggccctaaatatctatgttgggcagtggggagtggggcagtaaagtcattcaaattagaaaccggggtagttaatgctactgagtgaggccccgcaactcctcagtgtctgggcccccaaaaagagaaggagccatcagcttgccaaacccacgcacccagtttcatggaacttttattgagtttatttgtgggatgcatgacaggaggtctttccatcattagtaagaatgaaaggtcattttcacagtcactttggcacacgctaacgtctcataaaaaaaaccagaaaagcaacgacaatggaacctatagaatacgtcattaaatacatacaaaacactaataaaatatccctgataaaccaaagtgcatatgcccaggacagtattgcaccttccccagtcgcgcgtgtcgctcgcatggcctcgtcaaagttggaagttaacagtcgtgagattagtacgcaggtgcacaccagttatttacagaacggcggtcagagccgcgggagtaggggccggccgcccggcaggggtgcggtgtgaacagaggcggtggctggggtggaggggcggggaggagtgctacatggatcgcggctcagggcccagggggtcgccccctgggtgtaaggccgcgctgtggagcaccctcgggggctccatgcaacagtcagcgccgactggccagtggggcatcagggcagactccagtccgcggagacggacggtgcgcaccgctcagcccaaggagagaagccgtctgcacttggaaacctcaaccttggcaaaaggtggatgaacgcaccggctcccctacaccttccctgccttctactggcccacgttccccctctgaagctggagttggcagccaatcccgttacctttcaactttaaggcatcttctacatagtttttctaagcaaaaaagcaataaaaattgaggtaattctgtagtggttcacacgcgtgggcgaggcacgcgcgcaccagacggccactctctctctcagccctgcggcgggggagctgtgcgcgaggcgagaaaaggccaccggggccgacgggcggacagtggaggtggggagtgtccccgcgcccctccgccgcctccgcgaccggacccccgcaggacagggccgcgcggggctgtgagctgcgcgaaggccgggcggaagcgggccatagttccacgagtcagaaggacacgctcagcaaagggtcggcggcagcagcgacggcggtggcagccgggaagcacctggcagtgccggaaactcggggtggggtccccgcacgacgccgcgagaccgcgaacccccccgggccgggacgggctcggcccggagggtcgccctttggccaccggcccctcctgcaaccacgacagatctttgcccctttacaagccatcaccaaccaggttcggccccagcagaggcccgagcccccgccagcaggcagcgcggcccggagcggacgccgagctcagaggcccgggagaaaacggtcaccccagagcgcgcccgcagagtcaggggagctttccatagacagagaggaggggggcccaaggcaagctccacagggcgcagggcatgcactggagggcagaggcagagttataaacgggtcggttacttgacgagatcttccggatgggcgagtcggggtccgggcgggacagccactgaactacgtagctcttcttggagggatctgagatgtttcctagagggaggagagaggggctgcggccgcagggcaccaggctggggcccccaccccaggcagagaggctccgggtctcccggggtcctggggaagcgtcattcaaggccctcgcctccccgggcggacaaagggtcctccgctgccaagtccacgcccacctcctgcccctcctgacagcagccggggtctcagctgggtctcagctatcccgtccctctcgctgccctggcatgcaggccctgccgcctccttttctgggccggctcctctgcccctgcaccctgcccgcgccccgggttccacctgctgactcgagctctgagctcccagaaagcttggacagagagtgccaggggaatgagagatcctggatacaccctccccagctgggggcaggtgcctagaccccccagagctccctcctctatagaagggaactgtggcaggcacggtccagtcttgaactgtgtggagaccttagaggtgacacatgtatagcgtttggacaggcatctgtgcgtggtaggtattctggttctcctcaaaggtcacagagcacactctctactcgcacaggcgtccccctattcacacaggcaccccctacaccatagccaccagcattccctagctggccgagtcctgctgtcaccgtgagtctgcagtgccctgaaagcagggaggggcgagtcagctccacacagctccctccatttcctgccaggcaaaggtcccagacctggcctgcagtgccccgcttctccatgctcacagatgttgagtccagctactctccgggaagagccagatttgcctgaaccaagcctctgacacccccgccctgggctgctgcatgctgggagcaggggcaggggctgcaggtggcttacggggacaggggccaagcctgcaggtcctcgctgtctcaggacgctcctcctggcagatgccgaagctgtcgtccgcggtgcggcagagcactggccgctcctgggtgccgttgccacaggttactgagcactgcagggggagagtcgccaggcagggttcacctcccacacagggcccgcactggcagagctggaggagcccacagtccccaggcacatgacccatgcgctcaggaggaggtgtgggacagtggggagagtggggtttcaggttgccttgccccaccctcgggggcagccccaatctcctggggctctaaagaagggacccacatgcctgtctctctgagctgctgtgagacagtgcccatatacagactggcataggcctggcgctgctggactctcagtgacagcctcacttctctggctggaggaggtccaaggcccaggagaacctgctgtgccctgggcaggggttgaggtggggcactgggaaagctctgacccagcctaggaggcgccagtaggctccccacaatcctgggcatgagggtccaccactagtgccctcactggctcctccagcccccagcaccaccactgctccaccacactgaccagggaggtgccagaaggagcagtcacgcccagccttgcccaaggaaaattctccaggcctcaccaggtgcacaggaaaaggctgactcagcagacctggattgctcaaagcctgcacattcccaacaaaggtctgtgtttttgttttgttttgttttgtttcttttgttgttggtttcgagacaggatctcgctgtgtggcccaggctggagtacagtggcacgatatcagcacactgcaacctccacctcccaggctcaagcaatcctcccaccttagcctcccgaggagcagggagtacaggcacacgccaccacatctggctaattttttttaatttttttgtaaagacggtgttttgccatgccgcccaggctggtctctaacacctgagttcaggcgatccacccgcctgggcctcccaaagtgctgggatcactggcgtaagccactgtgcccggccaacgcctgttttcaagactggcccttgtgcagctcctgggaaccaagctcatggaaggctccacctattaagagtgtttttgcctgcctgaggccttgagtcaccagtaccagttggtctgggtagttcataccaacagtgatggatggggaacacctgcttttcctctacagtctgaggtcacacctatgtagctgaccccattgaaaaccctggacgcccaggctctggtgggctcccctgcttggcagcatttcacatgcattgccacacatgggtgcagggagaattcagggcatttccgtgaccccactgggaggggacaccgggagcctgcgcctggattcctcccaacctccttgcctgtgacttttctttttcccgattctactctgtatcctttcaccgtaagcccctgcaactgcaagtcccgcttctgagtctgtgagtccttctagtggattactgagcctgagggtggtcttggggagcccctgacacacgctcctccagctctgccagcgtgggccctgcatgtgaccgggctgtcagagctcacgtcagctctgtcctggcctcagctggctctcaggccctgcccctaggaccacccctgaagcccttcagtccatcctcattcttcctcccagcacaagcctaagcacgccctgctcttctcccctcctgcgagtttgtcccctcccacctctgcatgagacccaggcgtcccctaggatcctggagccccgaacatcctactgggcctcggagcccgggctaccctcagtttcctgggattccagaccccgtatcatgcagaagcctctgcctgtgcagtgaagacacacattccactggtttcttagtacagcactgaccacgtggcagccactggcgccgtgaaacccacaggatgtggctcaggacaggagctacatccaggcccacgggccgaaaggggaatgctctggtcacctcagtcccacccaagctcagtttgggagctgaggacacgggatcaggggattgcttacctgggaccagggcccggctcgccaatgatcagggcagagctcgctgctgcaggcccggcggctctcaggccgggcgtcattgcagtgcttggcatgcacggagcgggtggtggtgttgtgtagcggctgaatgcagcgcacggagcgcacctgcatgcctgtccaccctcagttttggagctgaggacacgggatcgggggattgcgtacctgggaccagggcccggctcgccaacgaccagggcagagctcgcggctgcaggcccggcggctctcgggccgggcgtcattgcagtgcttggcgtgcacggagcgggtggtgttgtcgtgtagcggctgaatgcagcgcacggagcgcacctgcatgcctgtccgcccacaggtctggctacatggctcccattcgcctgtgacccacctgccagggcagagcggggcacagtcaggcttccgcagcacctggagaacctgcctggctgagctccagcgccgctccctgcagcccaggtagacagcgagcacagagggcagcctgcacccctccccggtgcaccttctcttattctcactaagatgctggctgtccaggcttgcacagaggggaaactgaggctcagctgccccaggtcctactgaccatgagtcccatgcatgtcaccactgggaggccctggtggagctggtggctctggaggtccctagcctgaagaggtttcccagcctccttagggtctgggccctgctacctggcctcaccttctgctgacgtcacaaatccttctcggcagagctcaagagcagtgtggattccctcagcacgctgtcctatgtggcccccacctgcccatttcccaactgtcttccccactgaggtccctggacccagaaacgcagctgggcccagccccagggcctgaacgtcaaagccactgcttaagaaacatctaccccgtggtacagggccaggaggcgagccctgcgcctctgaacccccatttccccatctgggcatccctgtttcttgtcatctctaagatgctgttcagtttggcgggtttgaagctggggtgcgccttctgccctgcagcatcttagattccatgaaatgtggtgagagagacttggtcaaatgcctcggatgatgccaggcccaggccccacacctccaagcacgggagcccctggtggcccctggcctgtctcctctagtgggagcccgagctgggggcactcacactggctgggagcattcctgtgggttgcacgctctgcggatggctttgggcttcgagagggcggcacagaagccacggtgtaccatcttgtggtccagcctccggcggcagccatacttggtgaactgggaccctgaaggcagagagctcgacgggggtcggtggggcagcatgccctgcccgagggtgcaaggaggggtgggctgcaccagcagtgctggcctcgttttcctgctcacccttgtgatgacaataagggtgggcagggcaccgagcctgcggctggctggggggaggccttggtgtgtcccgggtggaggggcgagagggcaggagaggccattttctcccctaggctgcctctccctcactgggctcctgggtcagagtggaggccctatttccttgctactgctaggcaccgcttctaccttgacctcacatgcccagcaggcctggtgcaagccaggagccgggcaagcactgggcccgcagcccgcatgcttcctcccacaggcccagagcagccgtgctcaacccgggtgattttctccagcaggggacatttggccacgtctgggacatgtttggttgtcacaactgggggaaggggtgctactggcatctggtgagcaaaggccaaggatgctgcttgacaccccaccgtgcacaggacagcccccatggcggcgagtgacagagcccaaaatgtcagtgatgcccaggcttcgaaaccctggcctgctgggtaagaccaaagaaagcatggagataaagcctgacctcctctgggtgcctggaggcatcccaggaagcagaggctggggaggctgacgtggtggcagggcggtggaggggctcaggcgaggagaagcctgcgcagaggccccaaggtgggacatggtgtgtatccaggaaaagcccttaaggccggcgtggccaggacctgggggcgaggcacagggtggagatatactgggagaggccaacaagttgccccaaccctggaggccatgaggagaattttgttttttatcctaagagcagaggaagctgttgaagactatgacaccaggaagagagagacattgtctgatgtgttccctcaaacggttactttggggtgagagtggacacacaagggccagtccagaggaaggtgggtgccaggaccggggaatggccaggaagatgggaagagcacacaggcccaggagatttcaggaatcaccaggggtggatgcgctgatgaaatccaggcccggtgtggggccgggggtgcccaggggccctggaagaggacccttccatctgcctgggccagggagtgaccccacctcttggtgagctccttgtcctccaggtgtgggcccagcatggcatcgagggaggactgtcctggtcacttgcctggtatcgcccagcccccaggagcacgcagaacagatcagcgcttcctgtctgcctctgggtcctatgtcccatcaactgcagactctctggggtccagagtgggtaggacccctctgtgctcagccctgtcccagaaacatctgggaggcttttcccagtgaacggagagagaagcctctggaggtgtcatctgcactgccagagtcttgcctatgcgatcctgccaatgccacggcatgatccttctgaggtgtccacacatcaacctcttgctaggccagcctgtcacccccacactgaagcaggcccacaaatacagggtccatgccccacacaccctttggccacatttgacccaatgccccagcaccccccttcctgcccacccaccggcccctccattgccgctaagcccttgcccacccaggcaaaggtccctgctgtggctcctcggcccctgctcacgctggccccaccccagggatgctccctaccttctcgtggtcaccctcatgtcacccaggtccccagcttcgagaccccctcacctccgccacagggcttggagcacggagaccacttcttcagggcccactcgtagaccacagagtcctcttccaggacgttgttgtcgtcgacattcagtgagtcctcatggatcatgtatttgtacgtcagtgagacccgggtgtctcccaccgggatgacctgtgccagcccaagagccttgatgtgcctgacctgccctccatgcttcctccccagccagcttaggaacggcagctgaggccgactccagaggagtctcatcattcatggcagttacattccatgaagtcgccccgagcaccaaattcttgaatagggagccattaccccagggggcacagggtgaggttcctgtgagcctctgtctcaacatttttgttacccgatcaatatataaccttgttttatgtgtgagtctgtttatttttttgtttgtttttgtttgtttttgagatggagtttcgctcttgtagcccaggctggagtgtagtggcacgatctcggctcactgcaacctccgcctcccaggttcaagcgattctcctgcctcagcctcctgagtagctgggattacaggcgcccgccaccacgcctggctaatttttgtatttttagtagagacagggcttccccatgttggccaggctggtcttgaactcctgacctcaagtgatccacccgcctcggcctcccaaagtactgggattacaggcatgagccactgcgcctggcctatgtgtgagtctgtttaaagacactttatttaatttttactgtgattcattaacactgaactcacagtcaatcgcactgcagcccatgcctgaacgaagcttattcaacacatgtattttcttcttaagacaccactgcttcctgggcttaggaacactggacagcacttcagcaacaggctcagggtgattttcaacagcgaaatcgcccccaaaatagcacaaaatgtgatgtatgtgacactcaacagactgcagaaagaacccctgtttgtgggatgagagcagaaacaagcagacagcgtgctgagttgctcccacctccgctgggaacacgtgtggcaggcgactcacacttcaccactctgtgcgtgtccgtttggggctcacgaatcaattttagtgagcaggtgaatttgcaaatacagaaaccgtgagtgccgaggaccagctgctcacacactgatgcaggcaggtcaccaaaggcacgtccagggggccagaagtcactgcaggcgaggcaggcagggtgccagggggtacacggggcatacctggctcactgctgcacctgcttacaggtgcacccacgtgtggagcgctgggggctggtggattaatcccaatgccagcatgcccaccttagggaggggctccagagcatgggagccttatttgtgatatgtaccttttttgacaaataaaatatatccctatgcagttaaattacattttaaaaagtgatctgacctcctcaaaaccaggtaaaaagaaagtgatttgaaaatccagcccccgtggtactttcctacaaccaggagatctggggtcccatcctgcttagagacacagtccagctcaacctgggtctgggcatctagcttcccagaccctgagcgtcacctcccagagtgtcaccgattccaatgtaacagcacactcgaacgagcatgctgatggcagctgtgaatgtcattcagatggtgaaaccgaaaccctcaaagggagagtgtgcccaaggtcacctaggggtcatgtggggtccagagccccggctcgtggatgcatgtcccttcctggctctgaccaagtcggagccccttggtgccaaaggcaggccaaaggggccacgcagagtgtcacctgaagggtcaggaggctcagcgtcccaggcacccccatccctcccccagtggccacccgcacccttccctgggcccagccctgcttggactcaccagaacggtgatggtgccgtggagggggcccatggtctgcagcgtctcccggccgtcctcgtctctgtactcccactccacgcccatggcaatgaaggttttggaactggcatccacgtcattctcttcatttaagatgaacttgcctgtctccaggttcttgacggctgagaatggcaagaccaagtcccccgttgtggtcacccaagagcaggacccaggcccactggtttgggctggtcggggagtgggggcagctagctggaccccttgtctctctggctgcccccggccagtttcctctgtgccacgacagcccagatggctctgggagccctgcttgcccatcactgctccctcgggaccagattaccctccactcgcatcctctgcccccaccagccctggaggtgccggctccccttggaagccactcagtagccgtcaaggccacctacccataccctattgggagcactcagtgggcgcttagaggccacccggggcaggatggctgggaggggtctgtacgcggtgcagggcatctgctggacaggcgagcacatgaccctgctggagtagggcttcctgccatggggtgagtatatgtctggctgaaacagcagaacccccaccccatcagggaccatggcccagccgaggccccagcagctccccacagccccagaagaggcctggcctgattgggtgacactcaggtcatctaggagcagaggacctggctagccaggaagccccatgctctctgcagtgtggggggtggctgctgcggggcagctgggtgatgtgagtggggccgcagacagggcactagtgagaaaatcattccctgtcacgtcccctgtaattctgtccactcacaaacaaagcctctgcttggtgccacacgtccctgccttctctctggcccttgctccctttccacagagagcgacctcagccccagaggcggtggcaggaagcagcgttgggacagaaatgtctttttgttcagaaactgacttttctgttcacctgcttcaggcaagtggtacaggtttttatatttagggtagcagtcgaaagtttcctcttaagaggcgaggtgcagtggctcacagctgtaatcccagcattttgggaggccgaggcaggcggatcacgaggtcaggaaatggagaccatcctggctaacacggtgaaaccccgtctctagtaaaaaatacaaaaaattagctgggcatggtggcacacgcctgtaatcccagctacttgggaggctgaggcaggagaatcacttgaacccagaaggcggaggttgcagtgagccaagatcaggccactgcactccagcctgggcgacagagcgagactcaaaaaaaaaaaaaaaaaaaaaaaaagtaagaaagaaaaatgagtatcaagagagtgagatcctgtctctaaataaaaacaaaataaaataaaacaaaagggagataaaataaaagggcatggtatgtttgtcaggcagcgtgggtgctggtccacggcagcgtgggagccccaatcctgtccagcctcctggggatggggatgaatgtggggctcagattggggaagggacttatccaggggccccagcagtccctggtatcacttctgaccttggcccatgaattcccagaaggtagggcccaggcaccttcagagggagggtggacaggtcctgagagcctcccgcgtggcctgggagggcgtggtctcccaggcagcgctgcttcgtggaaaggggcaccgagaggtgtgagaacatccatattttcaggagataccaggatccctattttagctggaatctcttgaatttaaaattaaacgaattgaaaatgtaagtgcactgtgtgcacccacctgacagctggccttgctgaggggatgggagggctgcccaggaccctgctgcctgcagaccctgcctgccttcccgagggcagggggccttcccgccccgactgtgagaacaggggacagggagtcatcctgtagactgagggacacatgttttgcatatatgtcctttcatagctgctgccaagcggagccctctgatcccaaaccctggcctctccacaaggggaggaccctgggaaagggcccaggtgggctgagcagagggacaggttggggaggggctgccctggctcaggtcatggctgcacaacccgggcccctgacccctgacccctggcactctgcccattgatcccagaggagccaggtcctgaggacgtcaagttgtccggctctgagactcacccagatggtggctggtggcgtctacctcctgaatgagcaggtgtctggctcctgcagggatctcaaacatcttgatgtaacctttttttgatgtggaaagacacagaaaactgagaagggaaggcgccgctcaaattcgcaccatgcaaggaggggcctcgctcttgaaggcagctcctccggaggctctcccaggaccctggtatttctctggctttgaggacccacctgagaggggccaccaggaaagctgctgcctccaggctagtctttaaggcccaacccgggcatcctcatatactggcattctccactctaacccctgtgaccccggcccccactctcctcttccccacccaccctggcacccagctggggctgtccccgacttaggattctccctccccctcagtgtcacagacctctccccctccccagaacagtcataagcccggacagccccaggatgagtcaggccctcagctgtccgggcatgagcctgctgcaggcatccaggctccagggtggagagcagggacccactcaccatgcttcttgggtgaccgtgtgaacgtgcccttgaccactttgcagtggctgttgtcccctccgcacacgccacacttgtcttcctgcttgctggagccgatcacaccgtcacagcccaccttctgttgggggaggaggcagtgagcacttgagacgtcctgctagtagagtcagggtcatactatgttgcccccagtctcgaacacctggcctcaagcgatcctcctgccttggcctcccaaagcattgggattacaggcgtgaaccaccttgcctggcctcatcttttattatctccaaaatcagagtgcgtctagtcatcagttaaacggaccttgcctgccacctacagcagtgtctcgacctggcagtttccgtctgggcccctgtgcacgcggctggtcttgggcaggggactcatcgaggcccaggcaggcaccgtccctggcttgatgaacatttatgtttggcaagcaggagatgctgtttatttttacatttttttttgagacggaatcttgctctgtcgcccaggctggagtacaatggtgcaatctcagctcactgcaacctctgcctcctgggttcaagcaattcttctgcctcagcctcccgagtagctgggattacaggtgcccaccaccatgcctggctaattttttttgtatttttagtacaacggggtttcaccatgttggccagactggtcttgaactcctgacctcaggtgatccacctgccttggcctcccaaagtgctgggattacagtcctgagccaccgcgcccggccaagttttgatattctttaacagacagaatccagttggatattattttttgacccagtattaggttctgcatgaatatttatgttttctaattatgcaaaattgagcaacctgctattacctgtcaaaatcaacattaataaaatatttaacctattctttttttttttttgagacagtctcgctctgtcgcctaagctggagtcagtggcgcgatcttggctcactgcagcctccgcctcccaggttcaagtgagtctcctgcctcagcctcccgagtcgctgcctgtagtcccagctaattttttttttttttgtatttttagtagagacggggtttcaccatgttggtcaggctagtcttgaaccccagacctcaaataatctgcccgcctcggcctcccaaagtgctgggattacaggcgtgagccaccacgcccagcccctatccttctttaatacccatgtcaggagtgacgtgatagccacacccacggagacagtgcattagtgatcttccctccccgttaggtttacaaccatgatcacagctgccatctgaagctacttgtactacaactgtttcccatgcttgctgcctgtattaattatgtttttgtttttcaaaacgtcctatgtcttgatattttgacatcttaaaaatcttcctgtctggggagagactacacctcccaggggtatccagttctaagggacagcaaagcactgggttggggacacacctttcacatgcaagccagccagtcttcagtctataccccaagcacctcctttatccaggactcacataccaaaccaagattcttgcaccctaactcatcccagggttgggtaccaggctactggggaccaccctaaactccagagcccactggaatgattcaaactggccattcctgagctgtcccccttccactgccctgccttcctcaggagccctctcagtgacattggcctccccacgtcctcactgggtcacctccataaattaaaatcccaagggtacagagcagacaccacctgttcttgttttggcgtatttggtgtcgccatctctgagccagctgtatagcccagcctcccggccctgccgaagtcacaggagcaaatgcagagcagccctcgagcaccctcccggctccagctccagctccagctcccggctccagctccagctcccggctccatcccccagctcccggctccagcccccagctcccggctccagcccccagctcccggctccagcccccagctcccggctccagctcccagctcccgggtccagctcccggctccagaccccagctcccggctccagcccccagctcccggctccagcccccagctcccgactccagctccagctcccggctccagcccccagctccgggcctctagcccccagctcccggctccagtccccagctcccggctccagctccagcccccagctcccggctccagctcccagctcccgggtccagctcccggctccagcccccagctcccggctccagcccccagctcccggctccagctcccagctcccggctccagcccccagctcccgactccagctccagctcccggctccagcccccagccgctgtccctgcgcccactcccctagaggtgccttcctgccgatgcggctgtttctcaggaaggtcaagccagagtcagcctccacgactcctgccatcagtcctgtctacacaagccctaagcagagacttccggttgttttcgggggagcctggcagggacaagtctatgttcatgtcaccgtcacatggcgaggtgacacgagattgtttttcctgacagccaaagattgaagccaaaggcatcataataaaagaaaacagaggagggcatttctacaaagcaccaaaccagtgaccctcacagtggccacccagatccagcaagaagctgcccagtgccctgcagggtgcaaggatggggcctgcttcacaagggtcccctgtaggtcacgtgcattggaaatcacctgggatgctcctaaaaattcatgctcccaggccgccaccaccgtgacctgtggaatcaggacgtctgaggtggagtccaaactctccaggtgagtcctaggcatactcaagtctcaggctcccagcacaggggaggggtaaacagacatttgccaagagcctgccctggtccgggcattgtttctgacacttcgtatgcttcacctcatgcatcttgccaataccccgaaaagggggaggtcagtacccaggaagctgagacttgacacggtagccccccgtgccggcctctgtgtactcaccctgcagtccccgcgcacacagaggctgaaggcgtccttgtaggagcagcgcgtcccgtcatgcaccatgcgcttcatggacaccacctccccggtctccctggactcgcagtacaggtggcatctctccttggctggaagggaagcagctgggggtctgcaaggagccctgatggcttccccatgtgtgtgcaaaggaggcaccaagcaggagaaatttccacaagggtccccacgtggcccaccctccagggcagacagagagggaaaggggtgggtgacagcagcccccttcctgtctctgtgtctcctaagcctttgaccctggtggttgtggactttggaagagcttttcccaaccaagccagccaggctgttggtgcagcccggctctcacatccccgaggccccgcttggagacctccgaggctgcaaatgtctgtttgctgggttgctatctaaagaacccttttcaggccaggcaagatggctcacacctgtaatcccagcgctttgggaggcagaggcaggtggatcacttgaggtcaggagttccagaccagcctggccaacatggtgaaacccgtctctactaaaaatacaaaaattagctgggtgtggtggtgagcgcctgtaatcccagatacttgggaggctgaggcaggagaatcgcttgaacccaggaggccgagcttgcagtgagccaagactgcgccactgcacactgcactccagcctgggtgacggagcaagactccatctcaaaaaaaaaaaaaaaaaggccaggagcagtggctcatgcctgtaatcccagcactttgggaggccgaggcaggcggatcatgacgtcaggagatggagaccatcctggctaacatggtgaaaccctgtctctacaaaaaatgcaaaaatttagccgggtgtggtggcgtgcgcctgaagtcccagctactcaggaggctgaggcaggagaatagcttgaacctgggaggcagaggttgcagtgagcagagatcacgccactgcactccagcctgggcaacagagtgagactccgtctcaaaaaaaaaaaaagtaaataatccttttcagtcaatctctgaaatccagaatgaggccagcctgcctcgattcagactcaggtccctggaaccttcccttctcagcctttatctgaggcaactaaaacgctgggcccccagactgtggcctccgccagagggggaccccatctgctgtgtcacctccaaccctgcactggcccacatgaggcagcagctgctgggctagggcaacagccatggaggagaaacaaggactgtgtttacagtccgtcccaggagggtccccagctgccacacaagcactgccatgcccaaggccaccagactcctcaggtccctgagccaataaatgccttctagtgctgaaaccggttggagtcaactttctgacactcgcaactgagagtcccgactaatagagaaggtcagaggtcaccagattccttggcagggtcagccctggcctcagccctgagctgaccacacagctcaagcctcgtccacccacggtgaactgcaggagcccggcccctgccgagcccgcagcccggccacctcttccatgtcctcagctactctggggtgttctggtgctctgggattgcagccctgctaggaactttaatgccccacccaggagtgggccagggcagccacaccagccagggtgggctctcctgccagcccagggtcgcggcagccttgccccatgcaggatcagaggcacaagcccccaccctgcccaccctagggcctgcctgctgagcccccactgatgcctcccagaagggctcaccatcccggtgctcgtggggcagccagtggtgctgggcgtcgccgtgctcgaagtacaggtcccactggcggcactgctcctcgcggaagtcagccagggagtcggggcagtcctggcggctgcagagctggaagtcgtaggcaaggcccgagcaggtgcggcccccgttggccgggctggaggagaaagcaaaggccttgccgctccgtgccattggaaagaggcagcacccgggtgcccttgtgagatctttttaggggggatccctaagtctcaggtgtccggggggcagctctgctgagcaaagggaccttgccctgccatgtcctagctgtaagacctgggcagttgtccagcctgtcaggcctcagagtgaagctcttgaaaggacaggacaggatggccacatcctccctcctggggttcctgtggggaggcagcatctgctcacagccctggtgccacctcctccccagcactgatgcctgggcttggagatgaacaggaagctgtgattgggtgtttaggttctgtgttccccacagggcgaaaaccccagcacggcaggagctgagtgagtctcctctgcagctggccctgggcaccgagcctagcacagaaagaggcatgctgaggccccagagtcccggtgctgcagttctcagcaagtgtcttggcacaaagcagacgcatcacggccgctgggttttctccctgtggagaaggcgggctgcgtttctgcaacgtcttcgcttcactgggaacagcaccaacccacacactgcctcttgaggttctaaatgcccagcaatctctttccgagtctggcgtaaaagccccaggggtgcttgaggaggggccacggggctccctgtctgcttctggccgggagggcagcctggagcctggggcaggaggacagcaggggtaggagagggatccatgcacgagcgtgttcacacgtgctgctgagggaggctgtcccactgcgggatccctccgcggagccgtgactgcgggtcctctctggctccgcagggtccagctcgggcctggccagagcaaggagagcagcccgagtgaacaggacccaggagcggccgcagaggccggagcgcagcagccgggacgcacccggagccctgcccgccagctggtaactgggcccggctgtgcatctgtgatgcccaatttggaggctggaaatctgttttgtttgtttttctaatgtgaaattacagattgtcaatattttcaggcaaatcaaaatctttaaaataccagacaggccaaaaaggaaagaccgaagctctgtgtgtctaagcagctgcagggcctgcggcgtaagagcccgctgcgcaggtgggagacgggggtaacgctgatgtttgtggagggttctccctccatgccagcccccccgggacactccctgggtgaggccagggtgagcgttcaggcaggaggagacaggcagtggaggagggagaggagggtgtggatgagaaagtggctgcgggctgaggagggagcacgggcccgggagatatttacggggtgtgtgggggtgaggtgggaggaatgagaaggggcaggaggacagcacagggcatggggcctgcgtggcgggtggggctgaggtatagctgagcatggggatgcagctggcatgggccggctctacaggttgtccctcccctgggcagccagacactgatgacaaatcccgaccctgccctcacctggctgcaaacagctgcccaggtgctagcatcgggggggctgagagaccacccccgcttacccccatttccccagctcggtcctccctcctctcctccatgcccgtggccaggagagacagagtaaatctgtctagagtgggctgcaggcaggtgggctgtgggccccggccaggggaaggggtaagaggcagagctaagcgtcccctgagccgtcaccccctcccaggtagggtgaggcaggcggggcagcctgccctgcacctctccagaactggtgtgcagccacagggccctccaggacagggctggctggagagggtctcctggaccctcagctgccactcagcaaggccagggggacatggggccaactcactgtgggttgtcacactggcgggtcctgaacttcacgcccgtgccacaggtacgtgagcaggagccaaacggactccaagcgccccagctgccgtcccgtttgaggatgtcaggtgtcagccagatgcagtgtcctttaaaacaatgctgaaagacaggaagccagtccctccactcaccctcacaccgggccgtggggacagtcctgcgctctgcagcctgcagtgtctgggacacgtcctggccccactctggggcacagggggagctcaccctcctcgcccctagatgctcagagcccccagaagacaggcctcattggccagaggcaataagaggcacagtgaggggctggcctgccctgcctcccgcttgctgacccaccctcctgccttctagcagctctgtgtcccctcagctggaagctgcaccacatgacgccgccaggatagatgcctcctgggtgcccacacacagcccatttataaagataccactggcctatcaggccagtgactgcaagacatacaaggtttatttaagcaaaaaaggcaatttagaggaaatactatggaaaaaagggacaagtaatatgctgacatggtaaaaaccaggaataaagtccaatgctggcatgtaggaaaaatgattccacatcttaatctgatcacagtgctctcattcctctagggggaggaagcgtctacagtttaggggacccactttaagaagaagattgcaaaattaaagaattaaattaggtgcaaaatgggttattgacttgaaatgagaaaatacatcacacaaaaacgttttaaaactgacaatgaccaaacaaccaaaaaacagagaacaaggacttctaatacattgactgacagaacttttccttcagttccgactgcatgctctttttttttttttttttttgagacagagtctcactctgtccccccaggttggagtgcagtgacgatcttggctcactgcaacctccgcctcctgggttcaagcgattctcttgcctcagcctcccgagtagctgggattacaggtgtccaccaccacccccagctaatttttgcattttttttttttttatttttagtagacacagggttttgccatgttggccaggctggtctcgaactcctgacctcaggtgatccacctgcctcagccttccaaagtgctaggattacaggcgtgagccaccgcgcccggccgactgcatactctttaacccttctttgtatgacctaattttgtagcactgtttccacaaagagaacagaaagagaacgcagccattccttggcaaactcttctcagcaaaccattcctcagcaaattctttctgtaaaagggccagagagtaactattgtagactttgcaggctatataatctctgttgcaattaatcaattctgccatcagagcttgaaagcagctatagacaacctataaatgaatggacatggctgtgttccttattggaactttattttgtaaactttatttacaaaaacaggcagcaaacagaaactttgaatggaagtgtaaggaggttggtgaaccctctccccagtaactgacgaaaattagtttttaaaaagcagccatttaaagtctctggaaattgtcctaaggtctaaacaacaaatgaagaagctttttttttttctcaagaaaatctattaaatcttggtaagaaaagcaaaagtctatggcattggagccacagccctcccccattcctgccctagctcagtgtgacagaagctttactgccaagaagacggggctgcctctactccaagctcccggtctgaggctacagtttcatactgagaaacccaggccactggtgtcatccctctcaactctgttgcagagtctctctctggtgggatggccaagaggcctggggcccccttcccccacccaggccccactcatagggcacaagctctgctccaggtacaccaggccaagaatggtggacctgatagcccctccccagattgcttatagggtagaggttccatgttgaaaggggcaagcccagaagactagtggctaccattcccatctagtgagcagtctgtaggccaggaatgtcactctgggagaagcaggccactgaccctgctcctttagctctggctcagtggtgcaggggcctgcccagagggagagtcagaacagaaggcttcacagctctccctaaggggactgactttgatctgaaacagagcgtggaggatgttcatgtctaagggcactgtcaaaaacaacaagggtcttagcagtgagcaattaagaggaggccaatggtcctaatagcaacaaacaaaatgttaaaccagctacaggttgagtgtcccttatctgaaatgctcggaaccagaagcgtttggaaccagaagtgtttcggatttcagattttcagattaaggatgctcaacctgtagaagttaaacagacagaaccagggacaaagacagctaagagccctcctgaaggtctcaatacacctcagatactggcaacaccctgcccctgtgaaaggtctagaatttaattaggtcatattgtagagcaagctatataccccaggacactgtcaaaaacaatacagcaatcaatcgcactagctgttagtagcagctagcagttagtgaaggctaacagttgggtgtgatagcaatacaggcagaatgaccagaagcttaatggaaagatctgggaaagagatagtcaaagagcctggctaatgccactaccccagggcattaggggcaggggtgcagtcagggtgactgcatatgaccaaggctgtgacctctggggagcaatatcagtggctgcacactgcaggggacataagcttcattgaaacagcaggaccagggcactaaaatcaacaagcaaacagtagcagcaaggcccaggggatcattatccagtttcttcaatgtattatctaaagtttccagttttcaaggaaactttctgagccatgaaaagaaacaggaaagtgtgacccatacgcaggaaatgaagcaggtgacagaaactaccactgaggaggcccagatgtctgactcagcagacaaagatttcaaagcagctataagtaatgtgtttaaagaacaaaaggaaatcatgtctaaagaactaaaggagagtacaggaatgacgtgtcaccaaatggagaatctcagtaaagagatagaaattataaaaagaactgaatagaggctgagtgcaatggctcacacctgtagtcccagcactttgggaggccgaggggggcagatcacctgaggtcaggagttctggaccagcctggccaacatggtgaaaccctgtctctattaaaaatacaaaaattagccaggcatggtggtacaacctgtgattcccagctactcggaggctgagacaggagaatctcttgaacccgggaggtggaggttgcagtgagctgagatcgcgccactgcgctccaggctgggtaacagagactctgtctcgaaaaaaaaaaaaaaaaaagaagaactaaatagaaattctggagttgaatggtacaaaaacttaaaagataaactaattagctggctcagtggtagatttgagctggcagcagatgcaatcagtgaacttgaacatagacagttttaagaggtggggccttaaggagatccttaggccatgaggtcatcctggatgggattgggggccttataaaagcgccagagggagctagcgaggtccctttttgccctttcgtccctgctgacgtgaggacaaatagccattaagcacacgaaaagcaacggaatagatttgtgtgtgtgtgtgacaaggagctttttgaagtcagtcatttttcttgatttcatcgcccattttttattactttagttccatattccattaatttttatctgaattttctttcctttaacaaatatatttgaaaataataaaagaaggtactttttacacatatattccaatcagagtctgtcatttctcccttattttatcaaaacattctggaaccactttcaaaatggcagttaaaacagtatattatctttattttcagacaaaatgatcttctgtatagaaaatcccaaagaatcccctacaaaacttaaagctaacaaacaaattaactgaggtttcaggaaacaagaccaatatacaaaaaaatcaactgcatttctataaactagtaataaatgatttaaaaatgaaattaagaaaataactccatttacaatagcaccaaaaagaaaaaaagaaccttagtaataaattgaacaaaaggaatgcaaaacgtgtccactaaaaattacaatacatcattgaaagaagttcaagttctaagtaaatggaaagacatctcaatgttcattgatcagtgttaaaatggaaatactttcacactgatctacaggttcaacataattcctatcaaaatgcagactagaattttgcaaagttgagaagctgctcctaaaattcatatggaaagtcacaggatgtagaatagccaaaataatattgaaaaaagagcaaagtgggaagacacttcaccatttcgaagcttactattaaactacagtaatcaagacagtgtatccctggcataaggacagacaaatataccgacggaatagaacaaaagcctagaactaaacctttacatttgataagttaaactttgacaattcaatggaaaaggaatagtctcttcaacgaatggttctgagacaactggatattcacatgcaaaagaatgacgttggacatcttcctcacacttacacaaaaattaactcaaaaatggatcacagatgtcaatgtaagagctgaaactctgagaataaaacataggagtaaatcttcttgacctaagtaatggtttctcaaatacaacaccaaaagcacaggtgataaaagtaaaaatagataaattagacttcatcaaaattaaacacttttgcacctcaatgatgccatcacgaaagtgaaaagacaacccacagaatgggaggaaatatttgcagaccacttacactggtgagtgtgataacagacttgtatccagaataaataaaaaactcttaggattcaataataaaaatataaataactccatgaaaaaataagcaaaggatctaaatagacatttatacaaaaaatatatacaaattgccattaagcacatgaaaagacggtcatcataggtcactagggaaatacaaatcaaaaccccaatgagatatatcacttcacatgcactaggattggtataacaaataaaataacaagttttggggaggatatggagaaatctgaagcatcattgccagttggaatgtaaaacaggctgctttgggaaactggcagttcctcaaaatgtcaaacatggagttaccataaaatccaatgattccatttctaggtgtacatccaagaaaaacgacccatgcacgcaatactttgtacacgaatgtttgtgcggtatttcccatcattaccgaaaggtggaaacaacccaaatgtccatcaactaataaatgatgaatacccacacagtggattagtattcagcaacaggaaggaatgcagggctgctgcacactacaacagggatgagccctgtgaacattatgccaagtgaaagacgccaggcgcaaaatgtcccatgttgtatgattccattgatatgaaatgtccagaattggaaaatcgataaagacagcaagaggatgagtggctacgagtggctatctggagttgggcgagagtaggatggattgaggtgactactaaagggtttggaacttttcagagtgacaaaaatgttccagcgcttgtttgttgtgatggctgtaaaactctatgaatacactgaaaatcactgaattgtacactctcttttacttatttatttatttttgagacgaagtttcgctcttgttgtcccggctggagcgaagtggcgagatctcggctcaccgcaacctctgcttcccgggttcaagtgattctcctgcttcagcctcctgagtagttgggattataggtgcccaccacaaggcccagctaatttttttgtatttttagcagagacagggtttcaccatgttggccaggctggtctcaaactcctgacctcaggtgatcctcctgcctcagcctcccaaactgctgggattacaggcatgagccactgcacccggcctgtacactttaaaaagtgaatttaaatatagatctcaccttattaaagctgttagggaaaaaaaccaataccaaccaaacaggcagcagatggagttggccagcacttggccctggcatattgagggaaattctttctttttaaaaaatgatcagtactttaaagaagttatgggtgacgccatctgaacatttaggatgatgacatttggaggaggtgctctctggtttccgtccttgatgtggttttcagggcatttcaagttttctctgtgggagcttgactttaagacactctttggatgagcaacgctcagtagcagttgccgtggacgccctgactgcagtggcagcgttcgcagctccctggcgtctttgatgttgtcaacatttcatggcaaatcagaaagatgtctgaaccattttcctatgtgttcatcagattcactcctcttcgttaatgagactgtcaaacgctccaaggcctgttaacttctttgatatgtgtctcttcctcctaatgagcaactgcttttggtttgatataaaacctttcttttttggtgacaatgagctttttgaagtcagagttattattttttttatttccttgctcattttctactactttagtttcatatcccattaatttttatctgaattttctttcctttctaataaataaattagaaaatgataaaaggtatatttgatacatatatccaaatcacagtctgtcatttcttccttattttatggaaacattcccaagccactttcaaaacggaagtgaaaacagtgccttcagacgtaaccaacatttctgcatctcgctttcattgcggtttctcttctgtctttgaaattttttagagcccttcatttattgtcatccatatgttgtgaggctaggctaacttttatttatttatgttttatttatttatcgttttgagatggagtctcactctgtcgtccaggctggagtgcagtggcatgatcttgactcactgcaagctccacctcccgggttcaagtgattctcctgcctcagcctccccagtagctaggactataggcatgcgccaccatgcctggctaatttttgtatttttagtagagatggggtttcaccatgttggccaggctggtctcgaactcctgatctcaagtaatccgcccacctcggcctcccaaagtgtcgggattacaggtgtgagccatcacacctggcctaagccagcttttgaacaagcagaccatcttgttacacttggcctttctaaagaaatatccatgttggatctgtgtttaaagtactccatctataaaacaaacctaaaaatcaaacaaaatactgcccatatagaagtagtgacaacctccggtaccgctgaggcacctttttctgcaaagatctgagggaaatggccagcacacagcctgtattctgcaatgaccctagatgagttggcacagcggtgtggcgagtatttctggaagctactattacacctggacagacacaatcatttaactctacttgtaagagacagaatcatggcaataagccaaaacaaatgccctcaatccattttctctgtagccaaagcagcaaaatgcccaaggccattctaatggcacccacaggaggggaagtgtatcagtggcacccacgggaggagaattgtatcaatgagaagcaggaatgaaaagagaagtgctgttaatcaagtatggttaaaatatcttatttttgcaaaatttacaaaaatgtgaccatgtaaacacatggcttggcctctcccagggtctcggaaggggctcctgtgagcaagggaccccaaagcgtaagcatcatgagcttcatggtaaatcgacttctgcttccctcccaaagcccctccatggctccccactcgcagcaggacaagccctgtggctggcatcaaagactcggtacgactggcctctacttacgcctcagggtcaccttcccccagcacagcagcactgcagcgctggcggctctgaacagaccgcactcccttccctccctgcccctgtgcacgcctccatctcctcaacacacgcctggcacagcagaccctgtgctgtgccacccagatccctcttcaggaccaagtcgtttattcctcaagctgtggagcatgtgggctgctcatggctcacagctgagttcttctccaggaacagcccccaggaacagtcccctttcctgcagacagccatagccagtgactggtcagggttgcggttcaaacgttgcttcaattgggccaactctgaaaggctccagagctgcacgtggcgctggccgagccctctgctgaggtcgcatccctgtgcagtgcctcactctccccacggtgctggccctgaaagtgcgccctggaattcctgccaccaggtctctgtgtctgaggtcattgctggggagccgtcctcctgtgtccatgcctgagctgctcccctcccgtgcttccttcctggtcctcctcgctcgggcaagccccacctagcgcccacctgtgcccacatctccccttccttcctagcaaaggcccctcattctcatgccttgctaaaaccctcccagacctgcctttgtggcagtctgagccacgtggggactgcagaggccgccactctggattctccctcccagacggaggggggtactgtgggcaggtggtcaagggctcctcccatcaggctgggccaacaggaactggctggggccaggcaggcctggctcccggcccctggggggtcctagccatctctttcctggcaccattacctcatctcttgcccccaaagctcccctcactcgagcatggaggggaggggaacaacccagagaaatgctggctggcgttcccctcagccagtggcgcaggtggggttgcaggcgaggaggggcccaggtaaggcagtgctgtggcctgagtgcgtgtgtcccctcaaattcatatggtgaagccctaacccccagtgtgggggccttcgggaagcgttaggtgatggccctcatgagtgggactgatgtcctcatgagaagagacctgagagagatgccctctctccctgccatgtgaggagaccacaggaagatggcaagccaggaagagggtcctcccagaagccaaccttgctggcaccctgaccttgggcttcccagcctccaggactgcgaagaacaaggctctgttgtgtaagccacccagtctgcggtatttctgttagagcagccgaagctgaggaagatggagtgtgagctgtcctggcaccgtggaaggctgcggccggggcagactctaagtcactggtggccgcaggaaccaggagccaggaggatggaaggagccacgcagtggtcctcctgtcccaactgggcaagacggtgcctaacctggaaatggaagctgggcatgaccactcagggtccttgcgggaaagggtgggagagaagatgattgctttccagatgtaaaatcacagcgtgagagaacagtgatgcacaggacagggaaacatacagacccacattcagggattctgacagcagcccgggaggagcccgtcttccacgttcccccaacatccccacaccgaatcctgatctaggtcggttccagcctgtgctcctcgggaaccaggggaggctgagcagagccccagctctgcccctcagtcagcacaactatctttaatacataaaaggcaatttcacttactgggctaaatgcagaggatcctaccaccaaaatgagtgaagggctgcggccaggtgggtggtctctgtgaggtggggacacttcggttgcatctgctcactgtccttaccagacctccctctgccccacttctaccttgcaggaaaagcagggggcaatcagctggggtgcaggccagccacacacacacatatgggggccccaccagctcctgctcctgctcctgctccctgaaccagcatgcctgtgcagggcctgcctcccattccctctgcctcctccctgcctggggtgggtgcggcgggcggggagccatgcttagctggccttgttctccaactcagcttttccgaagctccccctggggccacggcagatgttctgccccgctccttctgctgagggcctgtgggaaggggaatagctgggtggttctggcctcactgggcccccagcaacttaccaacaactcacttcggacttctaacccttcattaagtctgggcacatcttaaaaacaccaattcccaggtcttcgaacaaaaccttatacacaaatgttcacagcggcgtgactcacgacggccaaaaggtggaaaccaaccaaatgtccctccgtggagaaacggatacaccaaatgtggcacacccacacgacgggaggttattcagcgatcgagagaaatggaatgtggatagatgccacacaggatggcccttggaaacattctgctgaatgaagtgagtcagacacaaaaggccacatatatatgattccatttatatgaaattccggaataggcaactctatagagacagaaagcaggttggtgctagccaggggatggggcgaggagggaggggagaggtgactgataaatggcgcttcctttttgcagggatgaaaagctctgggaccgggtagtggcgatggttgcccaatattgcaaatgtactaaatgccaccgaatggtgcacttcacttttatttttattttttgagacagggtcttgctgtgtgatccagactggagagcagcgacgcgatcttggctcaccgcaacctccgcctcctgggctcaaacgattttcatgcctcagcctccggagtagctgggattacaggcacccaccaccgcgcccagctaatttttgtatttttagtagagacgggattttgccatgttaaccagacttgtcttgaacttctgacctcaggcgatccacctaccttggcctcccaaagtgctgggataacaggcatgagccaccgcgcccggcctgaactgtgtaaagtggttcagatagtgaattttgtgagaatttttaccatagtttaaaaaagaacaccaaaaacaattattggatcctaccccaaacaaaagtcttcaaggatgggcctgggaatttgtttctttcagaagctccgccagagactaaaattaggcagctggcccagtcccgagccaaagacttccatcaaggagccacaggtccatacagtttgggggcgtcctaggcctggctgggatgtgcaccggtgtccactccctactccctgcccccactgcagggccaaggtggtctcagtggggctgagccttcctgggtggggatccaggcttagctcatctgcatatgccagccccctagcaagtaactggctgaggagtgggtgtgtgatttcatctgaacaaatgagaatcaggtctggagttctgggaggacaacagggaagaagtccttctttcaagagtcaccagagggtgggaagtgggcctggggcagccatcaagggacctcgaaggacagtgtgcccaacaagggacaaacactgaggtcctggggatggaaaggttaagcctcatgctgggcccgaggactccaatgctggcctccaggtgaggtgacccacagtgcccaggggtgaccgaaggctgccaggaccccagaaattgctccttaaagggggattcctgagtggggggcatgaagcaccatgaggaactctcagatgccaggtgtgctccagcatcagaagcacagggtggaggcagctccggcgtacagcgtgtgaggggtaattagaagggggaaaggagagggcagcagaggtcccctgagagggcccccacccccacttcagggcctgtccctggtgacccgggcacctaagattcctgtcctctgccctgctgccctccaagagcccttgatgctgcctcaccttgccaggtgcacacatagtcccgtccaaggggggccccttcttggtcttgcaaaagtaggggttgtcaggatggctgcaccacagctgcttgcaggggtcaaaggtccggaactggaagacagcaccatagcttgccaggtccctcccacctcagggacctcccagggatgccacccacccccgggttctggaacctgagatgccccagtgggactggcccatgatgggcccgtgaggctggtgggtgttgtgattctggggtggtgaagaccttgcccatacggtgtggaggctgcagcatccctggacgcggctgggcctctctgcctccagtctttggaggctgcacacctcagggagcctggcgggcagctgggccctaagtgccagcctgaggctaggtgggcacctgctgaccctttgccgtggatttccctcctaaaccctggcgaagccctacccccacccccacaggcctgccctctctgcagcctcggcctcccctggacttcacagtcctgttccctggcctttctgcttcctgtcctgatagcacttcctgcaggacgtccctgagggatcagctgaaactcagacgtggccctgagcctcccctactcaagcctttccagagcccccatcgccatgagaatcgagtccactgtgctccttagggagtcttggaaggaggtggccctcctgcgttggtactcgactctaccacttgctcgctttgtgggctcaggcaggttacctagcctctccgggtctctgtttcctcatctgtaaaatgggactactttgcttctttccttcatgcagcagaggcgagcattaagacgctcatagacactgaagctcccacagtgtggcctccatgccgatggccggttcctctgacggctcagccctggcacttggccctggagagcagcgagtgctcctgtgcctgccgcgctctcctccaggcctctgcgtccgtggcctctgcgtccgtggccctcccttcctgaatgccctctccttccgcttagcctgcaggcctcccttcttccttgggagccctcctgacctctgcaggctctcactgcccctggctgacaccctggtcacagtcctgtcccccgtgtgcttcctgcctaggaccacgtctgggcctgccaggtgggctcagggtgcctagggggtggggagtggtgggtgcagagggacaggctgccactctggagggccgctctgccctccccacactgggccggtcctcacactgtcccgggagctgcccctacaccagcacgcctccccccagacctgggagggtcccggctgcagggctgcacactcaccgccgtgcacatcatgtagcccaggccgaagtcaaagcggcattgctcgttcatggagtagtgcagtcccgggagctggggcagcgccggccagtcgtgggcgaaggggtcatccagcaggcagtcataggagctgtgggggacacacggtgccgcgagcagccttcagcgcggctgaccatccacagccctggaggcagctgaggcccctgctggagctgccatggcagccctacctgcacatcccggcccctggctgtgctgcctcagtttccctgctgcatctcttgtccttggtgtaagacaccaggacctggcttgagcggaccccagggtagccgccgtgcccacttgccattcaaggacagacccctgacaatgggttctcctccagacaccaggcttctctcacaggtgtgccctctctcctcccccgcacacaagcttagaggacctgaggtcggagggctctggctctggtgcatggggacttgcaccctcccagagctgaccccagggactgaggggtcgcccacggggcacatgggcagtactcactgcaggtagcggctcagctcctgctggctgcagcgggaccagtggaagcggtggaaggcggcctgcaccaggggcgccatgatgctgcccagccgcacctcgtcgccacagcggttgccctgcccgtcgtgctccatgcccagcctgcgagggccgaggcagctggctgaatcccactggcacacgggtctgccagtcccaccccaccccgatgataggagggtgccccatctttccccaacgggcctcctgaccttggcccactctgagccgggtggcaccgaccatctacctgctgcaatttgaaagccgaggcactctggggagacagtgtccagcgggcagtcccccaggtatcctgtccccaggaggggcatgcacacctgggggggaccgtggcttccctgcctccaggtttctaacccagggcgagccaccctccaaacctccgagcctcctctataacatggggtagagcccaccctgcctgggggcttggatgtgataatggggcaaggtccccagctctagctggcccagagcgcctgctcagtctgcaggcaagcccttcctccttcaattggttccttcagcaaaagtgggcctcgggccagcactgcccagcgctgggaagacaggagaccacaccccaagtggctttgacacagggcgtgtccctcttaaggcacagaggagaagtgggcagccagggctggggatcctagggtggcccctctgtgccccacccttccccaggccacttacacgtggccagtctcatgggccaccacaaacgctgaggagaagccgtcctcatggttcagggtgcagctgcggaccggatggcacatgccggtgacaggagcatagcctgggaggagacaagaggcggctccagatgctgccatagcctggccgggaaggtgaggcctggcctaactcccaggcgctgcttctcctcaaggccccaatgccctctctaccacaggcaactgcccccggctggcacagctcagaagacaccacagcagacagctcatagcctgtgacatctggctgacagcaggcccccagcccgtcaccacacaagccccgtggccgttctgcctgtaacagccacactgcagctggggccctctgcttagtcagatgtcacctgctatggcttgtctgacacctgactttcctgcctgccgttctctttcacgccacctgcctctgccccctgcctgcctcactgagtggcccctgagcagcacctgcttccacacctctctctgctagaggcatcctgcccctcgtctgcctggtatcacaccctccaagcccacctcctctggggggcgtttcttgggtctccccgtgtttctctggggtccttgagaccctagctagacctgtttccataatgccgcagaaggctgcaaagctgttcagccgatgggccacactaccctgcagaatatcccagcagggggctggctggtgcggactgggaggtcagagccgccgtagaagatgaggccagtggcctacgacagcccagggccagggggagggtggcagaagttcatgacgcagagaccccacgtcaaactgaggaagatggataatgagacctattcacttccccagctcctgtctcagcagagggaggcggcttggaaagatagggaagtgcctacagggctatgggtgccacacgaggtctctgcttgtacccctgggagtcttcctagaggcctgccaagcatggagccctgactttcagaaccccaacctgccctcactcctgccatgccccactgagagaccctgaggccacgcgttccacagagaagggaaggagggccactgggaccccgggtgagctggcggtgtacgcgcctaaaaatagaagcatcgtgatctaacccttgtcttttcccgttgtaataaacaggaaaatctgcattttttgctctgcagattttgagacgagcgtggagtctgtgtgcctgagtggaacgttgccatctcctctttgccctttgtatgccaggcttgcagatgcatctgcctccgtgggaggctttccattcatcctactcagcattacaggagcctgcgagatctgaaagcgcatctttatgtttttctttgttttcttccctcttattttactttgtggctgttttctctctccggaatcttattagatagagtgtgcctcctcgatggagggtctgtctcctaacttttctctcatgttaatctttttgtcttttgctcccattgggagatggccttgactttttatttcagctttcgattttttttttttttttttgagatggagtctcactctgccgtccaggctggagtgcagtggtgtgatctcggctcactgcaacctccgcctcctgggttcagtccattctactgcctcagcctcctgagtagctgggactacaggcacccgccaccatgctcagctaatttttgtatttttactagagacgggatttcaccatgttagccaggatggtctccatctcctgacctcgtgacctgcccgcctcggcctcccacagtgctgggattacaggcgtgagccaccgcgccccgtctacctttcgaattttttacttcccccatcctatccataattttatacaaatggtttgttgttctctaatttttcatagaaaactcttagggtttatggatgtattttctcaaacattctgggaatactacttttaaaaacatgcttttcttgtctctaaattatctctattttctcttagagccagttttcaaactttttgttttgttttacatcttggtccatctttttcatgctgtaaggatttcttgtgttttggtttttttaaaatatctggtaacccttggctgtcctttcattttttcttttttttttttttttttttgagacagagtcttgctctgttgcccaggctggagtgcagtggcacaatctcggctcactgcaacctctgcctccggggttctagtgattttcctgcctcagcctcctgagtagctgggattacaggcacctgccactacactggctaatttttgtgtttttagtagagatgttggccaggctggtcacgaactcctgacctcaagtgatccgcccgccttggcctcccaaagtgctgggattacaggagtgagccaccacacccagccaatttcacatttttaaatgagggatcaggtcacttaatataaaagctgtgtcggtttcccctcctaggggatagctctgctccccattagtgccctccccaagacaaaacagccaacagcactctcatcacatggtcagggcaacacctggctgcgctgtgtttgaggggagctatccactcctcacccagacatggtagtttcagtctttttaacctagctatgctattaggtgcgtcttgatatttcattgtgtttttaaattttccttttttttttttcttgtaagacaaggcctcgctctgtcacccaggctggagtgcagtggtgtgatcatagctcacttcctgggctcaaacaatcctcccacctcaggttcccgagtggctgggactacaggcatccaccaccatgcccagcctcattgttttaattgcatttttccaatgtctagtgaggttgagtgccttttcatatgtttattgctcattcatattttgtcaagagcctgataagagtctcctgcccattatctgactggattgtctttattatccttattatgatttgtaggcgttcttcacatacttcagatataaatccttttttataaatatttcccccagtggattagcgtgcctttaatgcacaaacttttgaaatgtgctactatttatcagttttttccattgagttcatggtttgtttggttttttttgtctcttttttttttgagacagagtctcgcactgtctcccaggctggagcaaagtggtgcgatctcgactcattgcaaactccgcctcccgggttcacaccattctcctgcctcagcctcccgggtagctgggactacaggcgcccgccaccatgccctgctaatttttttgtatttttattagagacggggtttcaccatgttagccaagatggtctcgatctcctgacctcgtgatctacctgcctccgactcccaaagtgctgggattacaggtgtgaaccaccgcgcccggccttttgtctctttttaaagaaaacatctcttactccaagaacatggagccatccacctacgttatcttctttcattattttgcgtttcttatttagacctaaaatccatgtgagatgctctctgtctatagagtgagtggaggtgacaggcctcctttctttccaaattggccccacaccatttgttaggctgttttcctcctcttctctgaaatgtcacttttgtgacacattagcgtccctatacacataggtccaattcaggacactggattctcttctaatgatgtatttgtccatcagtgcactgccccacaccctcacccagctaaggtggccacggccttccctgccctgacactcttccctgggctgggccaaggctcccggggccccttgcatggccaggggctcatttccagcttcacgcctctgtggccctgcatgggtgaggctcaccttgcatgccggaaggcccaaagtcctgccgtgtgaggaagatggcgtgatcgtggtattcatcgtggcccgtgtctggcttctgctggaggtaggcccagcggcagacattctccaggctctgagaggggttcccgatctcgatgaggctcatggactgcagggggatggagagaaatggaagagagaggttggcgcctggtggcccagtggggggccgagcaggctgtagtgttgacagaccccatccactgggaatctgttccaggtggtacaaaggccctgcccggtcactctcaggacctgctcccactgggctccagtctttgacagggaagaaaagtttccccagtcacactcacctgcgtgagtttccacacaaagtcaccgcagttttcaggtgagatgcagaagccaagctctacgtcatctaaggcctcgcatagtcccaccgtctaccccatttccagaagtccctgtgtttgttctatgaggcacctgttccgtgcaaggcctccacagaaggcaaatgtcatgtggacctcaccccaaagagctcacagttttgggagggtccgtggcaggggaggcggaaattccagtgtggtgtgcaaggccagaggaagcagatcaccttatacgttccccccgtgtgaaggtacttgcagaaaccaacacaatggaggaaaagaaacagcaactgacatatttggtgggtgcaaaagtaatcgcagtattgccatgaaaagtaatggcaaagactttggcatcaacctaatagaaaaacagccatatcaagaacaagggcatacacagatgattcccacaggaactatgcatgggaagcccccgggaaccatcccattccattttgtatcatgacgcacacctgacagctagggtggcctcgggaccgctcgtcttgcacactctctctgcaccatgacatcagcaggcactcccatttagacttcaggactaagaagcctgtcttggacaggaaactgagactcagagaagttaagaagcttgcccaggtcatgaaactaggaagtaggagaattgagatcggatcccaagaaggctgaaaccaaaatctagattcaactcactgccctaaacttcctccttaaataagacatacacaatatcatttcaaaagcaaggcttctgtgagcggcacccttccttttttcctccacaatcctcacagcaggcattttggtttctgttctcaccatagactccaaacaccgaagtagttccctccaagagaaccgagagcccctctgagtcctgggcatgttcttttcccctttaaggatttatctggccataaaatagagatgtgcattccttggaagctacgtatgcaggtgttttttctcttgcataaatgtatccacaaagtagagccacgtatttctctttgtgtctataaataacaaaaagttggccgtgcgcggtggctcacacctgtaatcccagcactttgggaggctgaggcaggtggatcacctgaggtcaggagtttgagaccagcctggccaacatggtgaaaccctgtctctactaaaaatgcaaaacttagtctggcttggtggcgtaatcccagcaacctgggaggctgaggaaggagaatcgcttgaacccgggaggtggaggttgcagtgagctgagatcacgccactgcactccagcctaggcgacagagtgagactccgtctcaaaacaaaacaaaacaaacaacaaagggtattgttagcaagccagttagttccagaagaagggagcacaattcaaggctaggtaagacaagtcgttcccaggggtcccagtcaatgactgacaagatggcagaccaattcccaagtcccaagcacagagttaattgtaaagactttatttcctgctcctgggagataagataactcattctaacaaggtttccatgagtcccgatgaaataagtcataaatcagagtgtgatgtcctgtgactaagacttgtgggacattggcatagaagtggacagaccagaggaagctggaggagggcaaggggaggtgcacttcctgttcccatcatgaccaggaagagcatgtgactagctctggccaatgagctgtgagcaaaagtggggcatgtctcttttcggttggagcatctaatttcccattgagacccttcagagagctctcctttctggcacgagatctggcaacataaagacagtggctgctctgtcacctaggacctgagtgacgatgagacccgaatcctccgccaacccacattgaacatacagcgtgagcaggaaatcttggtcgttttaagccactgggatgcaaagtgtgtttgtttctgtagcataacctcacctactataattgatacaggaggaagggagtgggtatctgcatcacatccaagcctgacccctgcagctcatctcgagtccctgccaggtagtatccgcctctgggtagccttgagaggtcacagttctgaaggaggaatcgggcgaaagaatgtcccttctcactgtctccagctagggggtgagcttgggatggcacaagaaggaagggaaactcggggtggatgtgattcggtgctagagcgtgggccttgtggttggttgtactcgctgaacttaagattggcagcccagatatggatgagcctgggggaccttatgctaaatgaaataagccaggctcagaaagacaaatactgcacgctctcactcatacgtggaagctaaaacagttgatgtcacagaaatagagagtagttcctggagagtggggggcagcgggctggggattgccaaggctggttaacatatccaaaagtgcggcaagatgggggaataagcgttagtgccctatagtgccggaaagcgcctggaatccgtaagaatgtattgtgcattttcaaatagctagaagagtggactttgaatgttcccaacacaaagaaatgataatgtttgaggtgacagatatgctaattaccctgatgtaatcattacacattgcatacacgtgtctaaatatcacaccctaccccagaaatatgtacaattattacatgccaattaaaaataacagtaagagcaaaatcaaaaaccaaacaagaatgactttttaacatacattttttaaaaattgccagtccaaatccaaatcagagggtcagcacaaaggtcactaataagcgcttttgctagggtggtggcagggcccctgctgcagtgtgagtgtctccatccaggacacccagcacagctcggtagccttgctgggctccagggaaaggggccttgcttcctccagggcacgtctcccagcatcagtgtcaagggagtcctgtccaagatgaactcacctgccctcagggtcctaagccccatgtagtgggacggtcccttccgatgccctggtgggttgcggtgacttctgcctgcccttgtttccctttcgtgaaacttcccctcctttaatctgagtcagaccccaggcttcaggggcaggcaggcctggccaatcccagcaccacgccttcctggccaccatgaaggatcagggtgaacatacaaccaaagcgggccaaggagtaggcaaggtgtgaggtggggggcctgcagcggctggagcccccctgcactacaggagaccccccaccaaggattaaaggaggatgagaccactgtcgagctaagactggggctgcagtctcatctgaaggctgtaccggaggcgggtcagctcccaggctcattcaggtggtcacggcgggccccagctgagctgttgcacaccataccgtatgggcccctcctggggccgtcacccatgtcagctttaccccacacggtcgcccctgctcgagggacccaagagacaacaagagaaggcacctcccctacagaagccacagtctgcttttgatagaatctcagtcccgcctaccgcagggcatggacattaagagactgggtcactggcggccatcacgaaggctgcctgccactgacgggtgtcatttatgcctgaagaagttcctctccttgtgaaagccaattctgagttgtgctcttgtcacttgcagcgaagagaatctgagccacgtgcttcctcctttgggggaccacagggaccccagtcaggacactcgctggcccatgaaagatggcgtctgatctgggggcagctgatatgttctgggggcagtttatatgcttctcagtgggagaagggccctggccaagtctttgaggaggagtcaagagtccagccagaaagacatgccccaatatcaggaccagaggcaggaatgaggctagtgtgtaggacagagctgcgggaggagccaggctgaggcaggctgggggtgtgcagggaggtccgctatcctagtgtgtgggcttgtggggagtaccgggaggatgctagaaacccaagcgcctacaggagcaaggcaggtgacaagtcaatgaggcaggctggttgcacgaaaagtaagtccatcttgtgttttcccagttttgaaggagaaagggtacagaggaatatttccctattagaatagagtgggggtcggtgataaggagtggcgaggactgtggcaaacccaggtgcccaggcacagctgaagggagcaacatccgcccagtgctggcaggaacagaggcccagagctgctggatcagatttctcaggtcaatcgtgaaatctggattctacagacacctacctaatagtaaacactggctcaaattgaaatcagttatgcagacaaaacaacgcatcctccccgtcaccactttattccagaaccctggaataagagccctgcagtgggcagccccttctccacgtcctgcagactggatccactctggccgatcacctctctcctcccagatgctggcttctgtggttcagcctgggttcccagcccgtcttagcagccaaagtgatcttgctgctgcggcaagacaatttattgaaatattgatttgtgtttttgttcttgcctcgctttgttctcggcccagtccaagaaggcagcctgccactttcgttctccaaccccaaggaggttgtgctgcagggtccagagctaaaggggtctatgacccccttctggctttggggttctgaggagactccctgaggagggggcagaggggagggctggggtgcatgggcacagggaggggaagctgcactggggccaggggagccctgggaggcaggacttcaggagacatgagagtgtgctagaccctgggagcctgggtcccagcagggggtaccccaagaagtagaggagagggttacctcagtgtccgggcaccccaggactcaacctgccactgggagcttaactgacaagccacagagctgcttgtgcttcctctctctctctgccaacgtcccaacatctccaaggtcccagcctatctctgacgggcacagaggagcccaggggcagagatcttgtccttgctgggtctggagcattcaagggctatggggtacccatgaggcccagacattgaccttgtgcccagaggccagggcaaggtctgtgtgcattcttaaaacagccctttgggtcagtgaggaaggagtggggatagaaggggacagtgtggcactgagatgcatgcaggtgtggctggtgccacgtcaggagggtcaggacctggtggcaggagctgagaggcatcagggctgcagggcgggagcaatgaggcagagacggcaccagtgtctggctttggggattggtagcaaggcagaagaggcggcgcgggaaggggacggcaagtgccagaggaagagcgtggggtccgcagtgcaggaaacatggtcacggcaatgtctttcctggccagcttgctcgttgggaagagctgggctgttttgctttgggagctctcccacttctgggggtgcagcccttgtgggtgatcagtcccaagccgtagctgggacccatgttaggcccatggagcacaggttcgaaaggactgaaaactggctgaagtgggtttgcctggtggcagcacccaaaacaaccatccgcaaactcaggctcatgcaccccagagccccctttcctccacccactcctcccactccatgagagctacaggcagccttgggttctgcatgcctctaaggactcctcacagaaagaaactgatgtccaggcagagacatcggggcagctggacaggtctgcggcccaggagggaagtctgggctggccgtggacagggcaaggccctcgctactggaggcagtcggaacccaagggaagagccaagctcaggtctctccgctgagacctccagccaaggatactgtcctgacatgcagtgaactcccctgtgggtcacttgggctccagcgggaccacctgctgggatgcgacctcctttgctcctctgccacctggcctgcatgcaggaggccagatgggtccctgctgcctggggcaccccagcccccaccatcctgtgcccttgctatgtatcaagcctgggaactgtgcttcccctgagcgagaagaagacacatttctcatatatggatctcctccagaagtgagggaggctgcactgcttgtttccactgaggagtctttcaccagctcgccctggtcatctacgtccctcccagtcctgaatgcacctgacttccagctgcctgctcggctctgcacggctcctctaggaaagtctgtctgtgtgactccacctgttcctagctgtgctgagggggggaccaggagtgagccgtagcaccctgggctctgcaaagggggtggctgcaggaccagccagggactttacagggcagccagtccctcccaggggcagccgcgggcacccagcctccagagcagggggcggtagatggtgctgtatgaccggggatggacatttcgaggccctggggctgcatggtagctgcagggtccacctcctgagtgaggcagggcctctgagggcagactcttcacagcggcagcagctcccagaactcccaggtccagcctagggccccagaagagccaggcgggagaagcctgcagtagggctgtggatgaagtccaggggcccatccagcccaggatgcaggaggagtcctgagtgggctgaccctagctcagagcacgggaacagatgagcttccaagaggctgatcggatcctctacaggggccccaggacagtcgtcacccctcatggagggctctgccacccctgtttggaggtgacatcgaccactgcagacatgggctcccaactgggctccactgcccgagtgctctggggccctggaccaggctggctcttccagagtgcagggtcctccttggccatcatgagtgcccacctatgtccacatggagaccctccttgctatgctggttcacagagctgcccagatgcaggaggcagacactcgtccaggcccctggggccctcccacagcagcaccgggagcctggtcccaagaaggatggtgtttcctccgggttcagcctgtttggctcccctggcccgggctggaaagggtctgaggacatgcctgaaagacccagggatcccaccatgaggtggagagggcagatctgagggccttagggaggcaagagcttgatggccctcaccttgggtcagaaggtcactttgctgaatgctccccagggctgtcaggaggcttggccagggcaagggtgaggaaacactgcgggcccctgaacctcaggcccagcctgcaggggtctgggtaaccccacgggcctcagggaacagccaggagcttagggggcccgtgggccttgggtggacgagtaggctgcgtccagctccaagtcccagccccatcctggccgcgggaccctggctctgagctgcccgccgggtccctcctcctgcgtgcgatcggtcacctgccagatggggcacctactggggatgtgcctgttgctgtcgctggcctctgagtcactaaagcctaagctccttgagggccgggtggttgctgggcccgagtctgtgccccagccctggcccacgcctgccctcagtagccccactcctcccttcacggagcaatcccggcttctgctctccatgccaggatgaggcagcgaacgcggccagaggaccccggctgctgggcgctcagtgatgaaggaatgaacacgagcaccctcaggagccaggctgggcagggagggaggcgccggctgcggggacgttctcgggaggcctggggaagtgagcccaaagggccgccccggcagatgctgaccccagcaggaagtcaccgtccgcaaggagcgccccgctaggctcaggcttggcacacgacacctcgcttccacttcattttcctaccttccggatgacgaactgcgtctcagacaactgaaaggactcgcctgagtcccacagccggaaagaggtcggggtgctgccccccgcgcggggcgggcagaggaagggccgggcccgagcggccaccaggtggcgctgctgccgcgagaacagcggcccgggccggggacgcacccggcgcccagactccgcggccgcacccgggctcccggggccccagcggccccaagacagcctctgggcctcaccctaaatacatcaattatgacctgagcaaaaagttctgttccaatcgttgctctccgacatttccattgtttgctctggaaggagctgaattatctatgctcttccctccttcagtcaaggagacgtgggaggaaaccgggatggggatcagcagcctggaggccgcctccgctggaaccgcgcccgccccgccaggaggctctgcctgctgggcaaggcgcactcagccagccccgcaggccgccacgcgaccgaggctcaccaagtccactgcaggtggcaggtgaggtcacctgggcagctctaggcccggccgaaatatctcatctgctctgttcttgggcaagttaccttacttgtccccacctgcaaaatgggcacaactgcagctccgagcttggagctggggggcttccgcccatgacagttcaggcagggtgcagtcagcgcccacaaatgtcccttgtccttgtctctgccgtgctgttgatactgatggagtataacaccagtccctggggactggcctacccgctggggctggctcatgcccccaaggggatgcggcttcagcaaagcttctcaaccgtccccatcccagaggggccctcctgcctcagaccagcctcctaaacaggtgcaggataggacagcagggaggttgggttctggtgagcagaccacatttctcaacctcagcactccagatatttggggccagataattcctgttgggtgaggcgggcaccctgttcatggcaggatgttgagcacacccctgggcactccttgccagaacccagtggaaccctccccctagtcgtgacaaccaaaagtctctccagacactgccaaatgtcccccgggtggggggaggggtggcaaagtcactcttggttgggagcaactgaccctcaggggaccaggacaaggagcctgaagctggtgctcctgaccagccgggatcacagagtccagcccctcctcccagagcagagtggctccaccagcgtgtggccccgggcaggccgctcgccccctggagccagggtcctcactgtcaaatggggatgatcacagcgcctactccacagggttgctgtgggggtgagggcataaagtcacataaagggcttcagacggtgcctgtcccagaagaagctctacaaacagtcacttgcacgaacgcctttatgattgtcgtcattcctgttgtgtgctggggtttcacagacctcctcttatgggggaaactaaggccccatgatgttaaattgctcaccaaaggtcccacgagtatggacaaagccagaatgaatggcagggacaaggtcccaccatccctgctctgtgagcacatgttctaccgtgccccccagctgagtgcaaagtgggctcccccaaggctggaggtctcttgttccaggcagggcttacagatcaaatctcatcacgacagagaaccacgagagctggggcaggaggcgtgcacctcatttctctgccagaactcccatatcgttccagcattttgtttccagccatcttccccaaagcctgggaagctattcccagagagagccaagctgccagaacaggattctcaacttgagccttcccaggcatgagccagtgcaggcctgtggggaggcagaagaggggcctcctgctagaatctgaatgttgtgtcccccacatttgaaaggttgaaagctgagaaccaatgttatggtattaggaagtgtggtctttgagaggtcattaggtcatgagggtggagtctccataaatgagattagcacccttacaaaagaagcctgagggagcctgttcacccttccatcatgcgagggcacagctagaaggtgccctctaggaggaatgggtccttacgacacatcagttctgctggcgtcctgctcttggacttcccagcccccagaacagtgagtaacacaattccattggttataaattactcagtctaaggtatttctgttattgcagcccaaacagactaaggcacctcccaagggcagtgtccagccttagtgcctcctagttctctggacccaggtaggtctgggtgaggaggtggatggaggatgatgtgggtgggccatcatgccttgcacccctatcaggttgggggttgggacccagatgctcaggaggacagggggctgtccctggggtgaggcatggggtgtgtttcccacctcatcccctgtcccagatccccagggcccttgatatatcctccccagaccttcacttcctggccttcctgcaccatggctgggccactctaaatcctctaccctataggtgggtgggtgggcacaccaagcccccacccccagcacctctcttctcgtgctttccactaagagactcacatgcagaatttctcagacctttcacctccaatgctgaaaaattccagcaagcattccacactttgtcttgacctggttttttataacaagacactttatgtccttctctgatgctccccaagtctctgatttccatttgctttgattttcatcatcctaggaaatatttaaaatgagaacagttgagtagctttggtaccttctcaaaaaatcaattgaaaagccagttgctatgcaacctcaagtgttgccgatgctctgctccctggctggtggtatattgtataaaataagatcatctcttttcttctgcttttttttaagaaatggagaaaaatgttgttttaggaaaaacttgagataactcagaggcttctcataagctagaagacaaacatgtcactcaaacaagtgctaccaattttatccccactggagcctggtgaggcctgggggacaggcaatgggggagcggcaggtggggagctggtctatttctgtcacaatttgggatgaataacaggaaccgagtatctgggccactttctgcccaagtctgggtcatggtctcacatcccccagagtctgtccccaccgtgggggggacagctcagccccctcctgactgccatcgccttggttttgccatgctaaaattcttctagagacgggggcctcattccttgacgggaagcctgtggttccttgaagagcagctcatcagaattcatccccaccatgtgccaaactttgtccccagagccccatcgagaatccctggctgtgcttctctgtgagcaaaaggggtctgttcccttggacacaggagctaggccttttgcccccagatcttggctgggaagtccccatcctggctgctccatccatggtcccctattgcctgccaccctgctgtattccttgccggtgctcaccactctgtcgctgtcttgtctgctgctactgcctggacacagggctcctctcccctcctcgttcatgcacctccctgggattaaacagcagctgctcgggaagccagaggctctgggctggccggatgctttgggggcacaaggatacatctcctcccacgttcatcagacacctcagagacctgaaaacagggcctcccccagtgctatgcaaagtgaagtctgtgcctggtggacacaaactgttccagtccacagtgagataagtacagaaactagaaacttttatagcaattggacgggttgagtttatgtccacagaatttaataataaaaatccagacctagagtttttggatacctcggtttttgtcacatttgcttttcccagtaattcatttataacgtatggtacggaagtattggtctgtgatgggtttgaaataggaaaaagaaaacagccaggtctttggcattgaggtgcactgtgtactgctgctcccaggatggcctctcccctggccacctggggatggcagatggctcctccggtcccacagacgctgctcccaagccctgtggcccacagcacattcgctaagtcagccagggcccatgaccagaacccattttcctagccgctgtgccctctaccccaagccttcagcccagcccctagcagtgccacctcctctgctctactatttcctgcacttttgcagtaggtccaacctaaagcaacgaggactcatagcctcggctcacttcccctctcacagcccagaaccccccagagaagggcacagcagcgggcaggcccggctcttctggcagtctacactcagctgatcaactcaggagatccccgggatggagcggaccccatgggcactggcgtcccctacccccatcactgcctcctgtgcttgatctgggaggcttctaggaggaaggcggggtagggccaggcagaaaaaggtgggcagagtatggggtgagctttgctgagccccactctgggcaggcatgagttaggagcagaaaaaaaggcccagaatgctggaatgttccagaacattccaggaggccaatcatccctgaattcccggggtctgacagagggaccggctgtgtgttgtcctccaagctaggctgaggggcctgggaacaggcactggggtgtcctgggtcccacacccctcacaacccagcactgcctctcccctgcctcctcagctgcgggtccactgagccctcggggccgggggtaagctggttccatctggagttagctctggaagcgtgcgtccagcttccggttctgtcttccaatccctcaccaccatcagttctcaagccccttcccagcaggaggcggaagcaaggccagcctcagttcacctatgtcctctctgttctctttgtacctgggtcgcagaagttgcccggtgcccaccacaggcatgagctgccctggtttgctggctatggatctcagcacccccagggcctgcacatgtccccatgttgtccctgggaagagcaggctgcacctgacaaccggtcccctgcccactgccccattcccaactctgccaaaagtggaagtggggccccagcatggccccagtgaagcagagcttctgcaggtgcatgaggggtgggggtcccagcaaagcagaacttctgcaggcaaggcgcatgaggggcaggggccaaggaggccctggccaggagggtggtgcctgctaacccaggggcgtgggcttctcatgcaggggagaccacgtacctatggcagcctgcgtcctcactccaagatttcccatttccttcaggtggacccgctgcaggtggaccccctgccccagccacaggaagcgtgagctagcgcccatagggtggaacacagaaacctcattactcctccccagcccactgcagagatgacgtgccaagggaaagcatgaattctctttgatgtcttcattgaaatcagaaataaaggactgagcgtgacagagccctgtggcatgccaccggagacctttctccagagtgctgaattcagtcaaacggcatcatttggatcctaccatttttaaatgattttttaaaaaatcatttaaaaaatttaaatttcacaaatttaaaatgcagtgttttgtttataaaagaaacatgctggtccaggctcagctgctcacacctgtaatcccagtgctatgggaggcagaggcaggagaatcatttgagcctgggagttcaagaccagcctgggcaacagagtgagaccctgtctctacaaaaaaaaaaagaaaaaaaaattagtcgagtgtggtggtgcgtgcctgtagtccaagctacttgggaggccgagatgagaggatcccttgagcccaagagatggaggctgcagtgagttatgatcacaccactccactctagtctgggcaacagagctagaccccatctcttaataataataataataataataataataataataaaaaccatgctcatcatattgaatttaaaaaattcagtaaagtacaaagaagaaaatgaaaattaattagcctactgcccacagagaaatcctgttcacatttgatgtgttccttccagtctttttggtaaatatatttgtacaccaaattgagatcatacggaaaactgagatcctgcttttcaaacaacaaacagctttagactgtaaccatttcccaatgccattaaacatgtttcgaaaatgcaattttgtggcagcctaatactctaccacataggtttatcattacttaactagaccactattattggacaatataggttgtttgctgttgttcacatgagagataatgccatgacccttgtcttgttcctaaaacttggcccacagctgggatcactgctttggaacagagttgtagaaatgaatgtctggggtcacagaaatgaatgtctgggggcaaacatcaagaacattttaaaggccaaatgcggtggctcgcgccccataaccccagcactttgggaggccgaggcggatcacctgaggtcaggagttcaagaccagcctggccaacctggtgaaaccccatctctactaaaaatacaaaaaattagctgggtgtggtggcaggtgcctgtaatcccagctacttgggaggctgaggcaggagaatcacttgaacccaggtggcagaggttgcagtgagctgaggtcgcgccactgcactccagcctgggcaacagagcaagactccatctcaaaaaaaaaaaaaaaaagaaagaaaaaaagaacatttttaagggcagtgataaatattgctacatttccttagaatatctgtactcatactcaaagtgtgcctgcttcattcacccagccataaatccctcttcatcttaacagggttgatgctttataaatggtgtattatttatttctttaacagtagagttagatatttttccatatgggctttctcttagccacttggatttttttctttgtttccttccattgacaattttgtttccttatgatttagaggaggttttatatattaagatatatttatcacattgcaaatgtttttcctgcttgtcatttgccttttcattgtgttttttgacagaagtttggtattatacttatccaaatatatccatattcccctttacaattccttcaattggatttatgcttagaaagctcttgacaaccaatattttcttcttgatttgtgtgatttaaatagttgaatgttgtattggcttatatttgtcacatgataatttaatttcctatttattaaatttatgttatatatttatttataacacaataagcattctgtgtttatcacggtaggttatttgtaagaggggtattttcaactattttattcaactgaactgtctatgaaagtttatgcacatatggcactattttaattatcttcactttacaagatgtttggaggaagtctcttacttgcttgggtcccacagctgtctcggccattcttgaccgttcatgttcctttggaggaagtctcttccttgcttgggttccgcagctgtctcagccattcttgaccattcatgttcctttggaggaagtctcttccttgcttgggttccgcagctgtctcagccattcttgaccattcatgttcctttggaggaagtctcttccttgcttgggctccgcagctgtctcagccattcttgaccgttcatgttcctttggaggaagtctcttccttgcttgggttccgcagctgtctcagccattcttgaccgttcatgttcctttggaggaagtctcttccttgcttgggttccgcagctgtctcagccattcttgactgttcatgttcctttggaggaagtctcttccttgcttgggttccgcagctgtctcagccattcttgaccgtccatgttgctttggaggaagtctcttccttgcttgggttccgcagctgtctcagccatgcttgaccgttcatgttcctttggaggatgtctcttccttgcttgggttccgcagctgtctcagccattcttgaccgttcgtgttcctagatggtgcttagaatcacttcataacatttccaactatgaatctgggaaaggccaacctctcgattatacccagcttcccatgaggacagcatttgtgtcttcatttgtgatcactttcttcctatcattaatcaggtacaatttccttccaatgggtccattgtcttgtcaggactattccaggtattctacatttttggttactaccataatggaaattttctctccctgttttccccactaccaaggctgttgtttttggttcacacagaagctactgattttttaaacaatggtctgatatttggccacatcaccagactcctctcctaactctacaagttgtaccgtggattcttttaggttttcccgacacatgattaacagcaaacaatgagaatttgtctctgctcttttccaatactagtttcatgtcacatacaagtatctaggattttcagaaccacagtaactagtttatgggtcttttttgtttgtttgtttccaagactatctccagggcagtgctccccagagcaggttcagcaggctgcggatctgctgagcaagaagcttccgtggagaaagttttcagagaccacctgtactgctcggactctcggaggtacaccatgcacagctccacaggaaagtctccgggaaatttcacccccaggaatgcccattttcctttgtttgaccagcattttccagacttctttgaccttgggacccctctatagtcctctgtaacatctactcatatcctaagaattcgctgtgcagaacacttttagggaaatgtgcttctttttccgcctttaaatacaatcttggttgtcctgttgccctctgttactagttttctggggatctggaaaaggaggagtgccctgtgaggggctacggggccgtcacgcccttgccctgccagaggcttcaacactggagccctgaggcctctctcccaggctccccctaggcagcaagctcctcatgcctgcagttgcttctgctacccccagctccagaccccgcagggctccagacccacatccacatcttcttggcctcctccgctgggatggcaccaggtacctctaactgcacatctcagctgacctcttcagcttccctcctgtgctccccaatctcaggggttgataccatcatctacccagctgagagtctctccgccttcacccacctagtgccacatcctctcgaagtggcctcctctgtcctcctgtctgtatccctggacccaggcctggtcccagtccagctgccagcatcccccatttgatggcagtgactgtctcctaagccactgctcccacctgccccttctgcacacaggagccagtgatcttcttagaaatgcacatgggatcgtgtcactgcttaaagctgccctcatgggcaagccaaaccccttggcgggagacgcaggtctgctctgctccttgcgatcggctccttccgacgtctttggcattgggtctgctgttcctgtccctgtgctcgtccctctgggttcagctgccctccctcccctcccagcctatgaactcagagcatctctatgctggtgacttcactggaccatcttcaggtgtgggtggaacggtcacttcctcccgttgcttttcctgaccttgtaaggaaagactgcctgacccgcgtctcctccatccagccctgagccctggtacaattgtttccttgtctagatctgccttctggaagcggtcccctgaggacagagactatgccagtgaatattcccagcacagcacttcccacacagaagcccttcaaacagtatttgttagaggatgagttttgtcatttggaaactgatgtgatgaactgtatgaatagatttcctgatattaaacaatctccacattcctaggataagccctagatgatcacggtagaagtttctctttatacattattcaattaaactcttaatgccttgggatttttacttctatttttagaagtgagacaggtctgtactttgtcctgacgggctacctttggcatctttgggtataagggtcccattgactacgaaagacacattgggtagatttcagaatacatgagtttacagggtattgtattagtcttgcctgataaatgcttgcaaatgagtatgaatgcactggcaaaactttggaaaaggtgaagaacttgagttccctccatggttatgggacttatggcatattctccattttttggagtcagctttgaaatattcacatcccaggaaatcctcaatttccccaggatctccgtgtccctggcatagagatcctcaaattctcaccttcagggtttgactctcttctgcaaatgttctgactgtgatcacatactccttctacctacctgaggcagttaaggaaaaaaaaagaaaaagaaaaagaaaaggcttagggtcgggataatttagcatagagcctgctaaggagtaattaataaaggaggctttattccatcaagtactcaagactgggaaagagcagacacttttcaggccaaataagatccaaagctttgccagcactggtaagcaattaaccctagtcaattacaaaattcttctttttaaacaatgtaggagcaacctgggggaaaatgcaagccgccacctggcacccagaccaatcaatgggataatcttttctcccctttctagccccaggaccaggagtttcccatttttggaaacttccaaaagaggatataactctgtccatctctcatgccaaaggcttgagaattcctaaaacaccagaggatcctggccaggaagggacaggctggaaagacccggcttggggaaggccggaacagggaactccactggaggcaggcagccagccacatgggatagtccaaagatcccccccgcacctccccgcctgtgaatggagagctggaaccggattgctgggctggggcccacccccaggctctgcatctgtgtggtccaaagccccctgccacaaacctgggatagagggctcagcgagcctctctctgccctcctagccagcattcactggcagaggatgccctgcacatccctcctccactgatcatccctggacctccgaagtggccggctgcagagagcctcccaacagcttcctagtgggcagatggccctgcatgctttcctttctgccaggagaagtatctttttgtagtcacattacatatactctttctgatcttttagtttgtgccttctctctttttttctagattaaataggtcagagggttgctttttccaaagctctcttcttcattgattctatgtgtttcttccattttctaatttattgatttctgctttttctgaactatttccttatttttgctttccttaagtttttggttttgttgctgttgaaattcattcaaatgtactgagttgaaggcagggctaatgtgtgtcgaacatatcacccaaggaagaagcttttggaaaacatctgtgaatttgcctctgaatacagctttaaccacattccaaaagatttgacagtagtgctcttgtttttattagtgttccaaatagtctgtactgcagtcctaatattctctttccttgctctgttacccaggctggagcgcagtggtgtgatctcagctcactgcaacctctgcctcccgggttcaagcaattcgcccacctcagcctcccaaatagttgggactacaggcacatgccaccacacccggctaatttttgtatttttttggtagagacagggtttcaccacgttagctaggctggtctcaaactcctgacctcaagtgatctacccaccttggcctcccaaagtgctaggattacaggtgtgagcgaccatgcctggcccctagtaggttttttttttttttaatgttttcaaatgaattggatttttttaggtttataaattctgctgcccccacccctacttttaggcatttcatcagcgaagatggacaaaatcgttttagctgtataaaattcacaatattttctttatgacccaaaacacttctgtaatttttaagtgttctatgattcctcgaaaagaaggttcatctttctttttttctgtagggcaagggaaacagtgatataactactaatttagctttactcattgtgtcattcaaaaattctatgccttattagcatctaatctgtgaaaggcttttaaaagtgtattagagactctcatagttaggtttttgccaatttcccctttgttccaaggatttgttttgggatgttttgtgttctcttggggtacacgaaggcctgcaactggcatccgccctgtgggtgccttcggtcactgtggaatgaggtgcttggtgggtgtagggaagtggccccaaatctacttagtattcctgggatcccttctgccaccggagtccttcgtcatcatttttacatcgtgtgccttataagttgtatgcagtttgattttattttttgagactgagattctctttgaacagagttcaacttttatataattatctgatgtatttgatcctattatgatttgattttctatgcacagccagaccacaggctcgaattctgctgtctgggtaagaagcctgactcctcgggtgctggatggccctggctgcttacctgggcatgtcactaagtcacattaagcctcggtgttcttatctgtgaaatgggcagagtcacagtgtgcacccctccatctgccctgtagattaagggcattcatccatacaaagtgcttcccacacggctggtacaggcactttgcagtctacacgggccgtaccgtggggctcctctcttcctctgtctgcacagcatcccgtgttgccatcccaggtcactgtccctggcggctacacacccatgcacaccgccaggaaaggacgtcccaggtttggctgcaagaggaagtgggacgggcaagagagcccagctgggacagcagccgaggccagaggagaggaggccacagatttaatacgggggcagaagtccaagggagggtcgtgttaaccacgtgtttctgatgctttgacatccgagccttgctgactctggagggactgccccgctaagtggtaaccaatctttagagacaggaaacaactcatccatgagcacatttttcagatacaaaccaaccaatccagcgcccatgtccccagccacctcctttatcagacttcacactctgagccactatccccctgccctcattacccagaaaactaactcaggaccgctccactccccagagcccactggaattattcaaactggccaaccttaagccagctcaccctgtccccatcggtccttcctgcagaaacaacatggactcaggctgctgtttacccaattccctctgcctcctgaccacccctggtgcctccctgtgtggcccccgtggcctggtatgtctcttcctcttgggatctgggagtaacagactcttttcagtgaacaatagtaatggccacattttaaaacaaggggtgaaagggagcagggatcttgtttcttataggaacctcaggggagccagggagaggcagggtggttctggcaaacgcacacactctccaaggaggcccatgcctcactcccaggcccctcactccgagggggtggaggcaggcccggctggccacagtgcactcacctttccatagctcaggaggatgatccgcaccaggaccacgttgatgtgggcacccaaggactcgtcatggtagatttcattgacctgaaagaaacagggaggcatcagcgggaaccacaggccctaggactggctctggctctgccaatgggatgacccccacctgctccttcttcttcccatgctttccacccaggcgtcaccatcaactaggagccaccttgtgacccctccctcattgccccctgccctctgcctctccaggctgccaccaccacctgctgggatcactgtagccccttcctgagcaaccccacccaccagcccagggtttcctcacctggggcctgaacatggaacgtgggcagggaaagcagccctacgcttgctgtagcctccagctgaaacacaaccttcccttcaacagtgaacgtgggtgatggacccccgcggcacaggcagggctgggaccggccctggcagaagtcactccaagctatagctggtgggtgtggggattacctacctgcatcgctacttggaaatgggggcggttctaggcccaccaccaggtataatgttttaacgtgttaataaaaagctcatattactgcatccccaatgtgctctccctgttctgttttgatggctggagctcctgcagtcgccgtctctgtatttatcacaatcatattcttacacgtgtttcattcttcacatttaaaaccattattctgagcaggtgccaatgggcttcagcagatatcaaagggacccgtggcacaaaaacaggggggtgaactccccttctacagaacacagccagcaagaccctccagaaacataggtcaggttatcccgggctcgaggctgtcaggggcttccttcgcactgagcccccaccctccagcttcccaccgcacacacccagggccctccctagcgcagcccccttcctgtcacctcctttgttggttaaccaaaccctactcctcctcgaggccagctcagcagtcacttccccctggaaggccccccgcaggcctgagccgcccctcatcaagcacaaggtgtgttatttctggagccctctgtgtgcccctgtgggctgggcagccacctgcatcctccctgcttgcatgcccagagccaggctaagcagcacctggcaggcactcagggatacccgctgaaaggctgaagccattggcaccatcaagaagtggagaaacagggactggctgtgtgcagaccgagcccaggggctgctgacagctccggacatggccaagacatacttcccggagcctgctgccacgtcaggccagcacacactccctgcactccaatctgtagagcctgcatctgagcaacagtgattgctacctcaaaacagtgggaaggcacctcaggaaacccgagggttcacaaggagaatgacatcatgatggatgggtggacaggcatacagggcgtgcaagacaaggatcccgaggcccgctggcatcggtgctgggaacaaagatggcaccgatcgtggggcagagttcatgacatgtggaccctgctgagggtaccatccagcccaaacgcagctcctcttggcaactgctgcccagcaaatctacatctgattgtaaatgggctccccacaactcccacctctctttcctataggcaagggacaactcatcagacccacgggagcgtggctggtcaccgtggctccgggctgtaggcgtctggggagggtgggtcagcaacccctgtaggcgctgagggttatcctctagacccccagtgacccatctcgcccctgtggctgacaagatggagctccgaggagggcacccaggtccccaggaagccttgccatttggtcatcgccctccgtttcctctgtaaaatgaggattgcagtccccccatcacaaagctgttgtggggatgaaaccgtcatgcaggtgcaatggaatggtgcttgtgcaaacaatgaaacggtttttcattgctggtaaaccatagtgccctgcagctccctgtgaggtcctgggggtagggtatgcacccctaaaccacagaagtccttgcccagctttgagggtcagactagattgtttagtccacgctggcacagtagccttaaaagccagtttttcttaagagagaaggggtttctgtaattgtccacagtattgctttctctatcacgacaaagcttggccagcttggctcatggagtctgaccgagggaaggtcccactgcagctgaagggagcagaataggagagaggagaaaggccagggatgaggggccaggcttctcctcatcctcaaccccaacctcacaggtcatacagaacagtcctgacatctgagaaggaaggaaatgcaaaagagcttgatcctggctgctgcctgggacctgagaggggacaggttcctagcagtaggagtggcttccagggcccaactggtggcccagcctgctcaggcctgagagggtggcccagctcccagctgtgtgtagcagatgccagggtcccctgcaccccagagacacatgggcaagatagttggggactggcttgcaggtttacctggctctagggggcaccaccaggcttcagggcaagcccaggggggcactggcctacaggagaggagggcaggcctgcttgcaaggctactgcagaggggactcatccctactgccccccaccaggcctctgcctgcaaatggggcttttgggaggtaattaggggtagatgagttcatgggggtgggaccctcatgatagggttagtgtcctataggaacagacaccagagagcctgcatcctctctctctgccgtgggaggacccagcaagaaggcggctgtctgcaaaccaggaagagaatcctcactggggaatgacccagctggcaacatgatcttgaaattcccagtcttcagaactgtgggaaatgaattcctgtgatttaaacccctgggtctatggcattttgttataccagcccaagcggaatgagacaaaggctttatggggaagagactgagccacctcccacaggccagactgcagccttccttctatcctggggctgagtgcccgagatgagggcagcaccagatataggaacgaaagaaagccctggccaggcgcagtggctcacgcctgcaatcccagcactttgggaggccaaggcggtggatcacctgaagtcagaagttcaagaccagcctggccaacacggtgaaaccctctctctactaaaaatacaaaattagccaggcatggtggcgagcgcttgtaatcccagctgctcaggaggctgaggcaggagaatcacttgaacccaggaggcggaggttgcagtgagccgagatcgcgtcattgcactccagcctgggagacagagcaagactctgtctaaaaaaaaaaaaaaaaaaaaaagaatgaaagaaagttgcatttttccccacgtttgagcctaagcgtgtaaatgttgacctcaccgtccacacagaccctcagcacagccacgggcccctcacaggctctcaatgggacttctcaaactaaactgaccctggcctcttgtgcagcccaccacaccctgggacccagaatggcctgggcgagcctgacctggtctctccttccccactgggctgaggctggcacccagcagacccagcagaaccactgcctcaccatgaattgtggctctgagtagatcagagccagccctcctgccaggaggcggagagggacactcagatgctacgagaccagctccaggatcaccggcctcgagggaaaggcagggaaccagaggatatattagtgggaatctgcccactggggcctggaaggacgtggcatgtcatgagacctgagaaacagaacagggtagctcagcaaagcagggatggcgctcctggcagaggaggcagcccatgcaaacctcccagggttggaagcagcgaggcaccttccaagcacagaggggatgtggaagggatgccccagcagaggaggtgggaggggagcactgaggccagaccacgaagtcaggagaaggattccaaatcctctctaagagcagtgggaggacatggaggaaggatgatggcggggcatttaagaagcttactccaggtgccttacggaaagtagatggaaggggtcaagatgtgggaatgtggggttcagctttggggatgagtgcagagaagggacggatgtgagggatgatgtggattggaataggggtcatctgccccgcctgagcagggagaggctggggctctggaagggcattccggcagctcccacagggcggagggaggagatgcggggctggccctctcctggctcctggccaggccctgcccctcaggacgcaagatcttcccactctcctagccctacccctggggccgaaggtggcagctctcatctcaagaaggaatcttgtgtccttctgaacattgagcagatctaatcctgctccctgatttgggacaggaggtgaccaaccactccaaaagccccgtcgctgggcatggaactccctgggatagaccgtcagcctcacattctgcttggaggtggggtcgaggcagctgagccctggggtgtcaggctgctaggcgtgggcccctggctggggagctccactgtgggctgtccgccagcagccagctcccacctcctgcgctgggtgccctgaccctggcctctggaagcctcagatggttcggagattaactggggctccctggctgctgaggagctagagagggcatgcctgcaaatgctcccagcaggtagccagggagaaggaggccaggccgcagccaaggccccctcagccctccctccctggtagccttcaactgtggtgcgctctccctgatcctctccccaggaaacctctgtcccttcctcccttccacaccagcacagcacatagttccccaggcatgcccactctctgggaggcaggcctgagcaaggccgtggtggggcttgcgatggcctcctggctcctctgggtggctgctgggcctgggatcctgctccggagccctcaacttggccccctcccaggccaggtctcagcagcccctcccagcagtcaggaaccccatggggcactgtggcccagagaccactgaccactggcctgggtggttctcctgcccctgcgtgtgctatggcaaagtccaacccacagtccggggccgggctccttctgctgtccagcctctcagtccccgtaggttaatatgatacatcaggaacagacatggggggcaggcagggtttgtggggcatgtgagaggcaggggtgctccacagtgtccttgtcctccgtgggcctgaggagtgagccccgtcctgccccctctaccatcccagggctctacctgcttttcaggaggctgcaaaattgccaaaatttcctgcccagccctggccagaggcctgcagggcccacctgggcatgggaaccactgggagtaatcagtgtaattcccgacaaaacactggcgtcctcagtaaggacacagcggcaacatttctgcagagcagagagtcgactgatgtggcaaaaagagcaactgaagacagaaggcgacctccacatgcctgcctcctgcacatccccctcctcccccggccccacccactttctctgccagacaggagacaggcggtagggctccccaacggtccccctcgtgtcctccccacccccccacccacacacaccattcttcactacgatcaccaagcggaatagatctcaccttccccttccactgtctaaaaccctcaacggctctccagtgccttcggaagcagggcccagcccctcgcctggcattcggagccctctccacgctggccctggctggcttctccatgcgtcacttcagatacctccccacatggcacccttgctcctgacagcccagccagccttccccagagccggctgccctctcctgctgcctgtgctttggttcaggcctggaatcctcactctccctgtgcagcccctcaattctttagatatctcaggagcatttgaaaaaaaagactcatcctaaaaaatatatctcaaaggaaagaggcagtgacctccttgcttaaacccttcctaccccaaggcatgagaccgcagttcctggcgtgacctccaggccaggagggtctggccctgctgagtcttctcgggctgccctggccctgctccctgtgctccagcggctagcccggctgctccttgcacaggcagcctgtctccacctcaggaactttggacttgccgtgcaactgctcccagcagtgtctagcccatagtaggtgctcagtaaacatttgctgaatgaatggagtgaatcactttgaagatatggaataacaggaaatgggcaaaatgtatgacccagcgtaggcctgtgacccctctcatggggaggcccccagctaagggcctcccctcccctccccccagcagccctgggggcctcctccgcatccaccctacccaaggcctgcgtgtgctggggagaagcagctctcctttcccaggttgcagggggaggggaagcccagggacaatgtccttgagtactgtctgagaaattgatcctggaatctttaaaccttggggggaaatgttcaaagccgcagccatctctgtgcggagagaggccaagggctctcttgtttggggaaacacattgtaatgcgccttttgcttatgcaaagatgcagccaagtttctgttctggaatagacaatgaggaaggagcggctctgcatggcaatgtaaagtttgcctcactggtggcagagttccacccaggggatggtgagccctgggaggtggcctgcggctgctgggcagaggtgactttgtcctctgccaaggtgggggaggggtgcagaaaggggggaaccggtgcaggctccctactggggaggcctactggcctgccagccacagaggagacaggcaggggccctggaacagcagccaccccaaccttcaggaaagttcccatgtccttcgctcagctgagctttgggccaccagaggcagcctgtggcccacctggcaaaaccatgtccaggagcaagccaggcctgaaaagtctgtcagaggcctgggggaggggggcctgctgctctgtggcttctctgggaccccctgaaataagtgaggagaaggctgttctctctgtgccccttcggaggccaggcttggaccaccaggatggaggcagagaagagagtgcagccaggagcaggggacagaggtctgctggcctccgtggaggaagagtttaggcattgcatggtgcctaaacggggctgccagagcctgggcttatcatgagaatcaacgttcccattgcagatcttcttcaccctcggctcctcagcagatgcttcagagggaatgctagaagaaacgtgactcttgctcaaaatatcaaactaccatgaaacggaaatggccaggatcagaattactaggctcagttcatacatcaaaaagtgaggtggtcagagtcccctccttcaatacccagcgcaggaacactctgcccaaggccaccccctcactcctcaggcgacgtctcctgtgcctgtccacactctgctgatacctctgcagatgcctcagggtggggacggggctcctccacttccaggccagctcatcaatgcacagagcccagcagggtctcaagagatgtgctgcacccctcagtgtggcactccagcaggcacgttgagaagacaggtcgcattacaaaccttcccgggtttgtactaacgacggcaagaggctgcccctccccctctcctgaatttggggggttagcagagtgtgggggggatattcccactctgaggtcagatttcatgggtgccagcatgggctctgccacaatcctgctgcgtgacttggggccagttacttaacctgtctgggcctcagtttctttatctataaaatggagataataatagtccctgtgtctcagggttgtttcaggttgaagcaacaatgaaaattatcacgtgcgtccatgtgaagagatcaccaaacaggctttgtgtgagcaataaagctttttaatcacctgggtgcaggtgggctgagtccaaaaagagagtcagcaaagggtggtgggactaccattcgttggtataggtttgggatagacggtggagttaggagcaatttttttttttttttgagacggagtctctctctgttgcccaggttggagtgcagtggcatgatctcagctcactgccagctccacctcccaggttcatgccattctcttgcctcagcctcccgagtagctggggctacaggcgcccgccagtgcgcctggttttttttttttttttttttttttttttagtagaggcagggtttcacaatgttagccaggatggtcttgatctcctgacttcatgatctgcccgcctcggcctcccaaagtgctgggattacaggcgtgagccaccgcgcccggccaggagcaattttttgtgggctggggacggattttacaaagtacattctcaagggcggaagaatattacaaaatatcttcttaaggtagggggggacaatattacaaagtatcttcttaaggatgggggtggggaagaatattactaagtatcttcttaagttggggggagagaatattacaaagtatcttctcaagggtggggagggtgtatcatacaaagtagattcacaagggcgggtccggcgggggcgggtggcaatatcacaaagtacattaccccaagggcggagagggtgtattgttcacaaattcaattgattgatcagctagggtggggcaggaacagatcacaatggtggaatgccatcagttaaggcaggaactatctattttcacttcttttgtggatcttcagttgtttcaggccatctggatgtatatgtgcaggtcacaggggatatgatggcttagcttgggctcagaggcctgacattcctgtcttcttatattaataagaaaaacaaaatgaaatagtggtgaagtgttggggtggtgaaaatttttgggggtgatatggagagataatgggtgatgcttctcagggctgcttcgagcaggattaggggcagcatggaaacctagagtgggagagattaagctgaaggaagattttggggtaacaggtgatattatggggttgttagaaggagcatttgtcgtatagaatgattggtgatggcctggatgcagtttggtatgaattgagaaactaaacggaagacacagcgtccgaataaaaggagaaaaacaggtattaaaggactaagaattgggaggacccaggacatccaattagagagtgcccaagggggttcagcataattatttgcttggttggcgagtttttgggctctatccttgagtttatgttgtcatacaccaggccagactgatttaggtaaaaacaacacctaggtgattcaaaagctttattgctcacacaaagcctggtggtggtctcttcacacggacatgcgtgacaaaagtgaaatccccagcacctagtacaggctgaatgaaactgtcatcaaattacaggagggtccaacagcccaagctgtttccctgggaccccatgcacagaatggtccacctgggcttcgcccttacacccaccctggctctcctcctggccatcaccatcgggagaggtctgagtgaacagcttgcacatgcccctgtgttttccagagctggaggggctgctgtgcccaggcacgtccgcgagtgtgacccagccctggagctctccccgctggctgcgtcgcctttggggaaacaacagccatgccaccacttagggactgaccttcccacccgctgaccggatgcctcatcagaaagggaaatgctgcagaacggggaaggaccagtgctgctgaggctgcaggacgcagaaggacacggccgaggcctcaggccagagcccagtgtcccccaggggcctctcggccactgcgagccactgacagggaaaggccgagaaaagtcagggattctgattcttgctagcagtggctgcaggacggccctgcctccctggaactctgctgagcttgtcggctgtccctggccacagagccctggggggctcagtgaggagtttcctttcaaagaggggccctaagtggccagggctcgtgccacccccggccctggcatccccccacacgcccgtctcagaggctgtgtggcccggcccatcccgtgactgagctcggtcacctgggtccgtttgagcaccaccatgtaatttgagaacaatgcatttttattcccccacacatcatattctgccgctgctctgtcaccagtgtgacctaaggaaagagggaaggaaaatgccgctatgggaggagagagctgtggcatcaggggacaggaacggtgtgggggagggggcagcaagcagctgccggggtggggggcgggctgctgagcccacaccaggcttggagccggagccctatccctaccgctgcccccgccttagggtgagatgcagatagtccccggggttctgggctccacttcccactgagatgagaccctctgctgagggtggaggccaacccacatggtggccaagcaggtggttagaatggagagggatctcatgttaatgaatgggcctcaggcagcacatggatgcccctcgctccagaagggggtgtgtgggatgcagcagctcctgctggcgagggccagggcgtgggtagctggcactggctggcagaggctgtagagtggacacccatcaaggcatagggcttggactgggcaggggtccagcatgcctaagtggcccaggcgtcagacccgaccacctcagagcaaagctgaggaggactcaggccagcctccctactccccaggcatccatgcatgatgaggaagaagggagaggccctggcagagcaggtatgaacccctcagagactgagaaggcatgacagagggctgcaggccatcaccttgcactgtgcccctcgacctgggcaggggcccccaaggcactcagagcgcagggcaagagtaaggtgaaggctgcaagaagggtcctgcattacaagctcacggcaagggtcgtctgctgccagcgtatccctccctgaaagcgcagtcatgcagggtgctttccaacacccagagcagatgttccagcgcctcttgggcttggcgggaaacggctttgcccttctgtgcagcaggtcacaatccccctgcaccaccagagtctgtttatgtggcttagctcccttgccagactctggcagatggaaagatagatgaaatcctgcccaccgctacacaggaaacccagaaccaaaggaagaggggccgaattattggaagcacaagggtccgtgatcacttctgctcaggatcagaagggccagcatgggcagcccccaggccaggctccctgccaggcgcgggtgggaggtcttgcaggctgcagccaggtttccttcctcctgtctggctgcagggaagtttcccttgctctgaagtttcctcactctgtgaacattcccacggggcaccctatgctgcctcgggtgctgtcccatcctggtaacttcctggcaccatcgtgatctccagtcgccttcgtttgttagctgtctgtccgtctccactaggcagggactgttctgcattcttgctgatgcaacctgggtgctcagtactcccgtgtttccccaggcttcaggaccaaggccaagctcagccgcacgcgccttctcccaccccagcgggctcccagggtggccgagggctggcacctcttttgcacaaggggctcctctgtgtggaatgatgccctcccactttccacttgggagacaccaactctgtgaccaaaaccagctcaaggatcaccccactgtgactatctccactaccaggtggagacagctgaccgtctcctttggctgccaaggccctgtcctcgctgtgccaaggcaagcaggtggcccccatgagaaaaaagcttgtccaggacgggagctggctggggctcttcccagacatcatgggccgagtgaacaactgctcgcctcgctggtcggctctgatcttctccgcctacgccgagtacttccccgcgtgcgatatctttcccttcccacaccctgcgagtgagtgttatccccgctgtgccagtgaggaagccgaggcacagagagattgagaggctcacataagtgggcatgggagtcagtacagaggctctgaggagcaatttggcaaacctgctgcaactagaaactgtatcccgggacctggccattcagacgtcagcatggacgatggagacacagcctctgtcatagaagcgaaggcataaggacacccagccacgaggagttccacacccacagatagagttcatttttatgggagtctctgagatcacagtcgctttatgggaattcatttagtcacttattcattcaaaagagatttactgagcacctactacgtgccaggccttttccaggtactcagtgaaaaatcaggtgggcagaccctctctgggtccgatacaaagtcacctttgtgggagtccctaaccctgctgagacacaccaccaaggagacccctggactggggaggaagacccaggattgcttgactgcaactcagctccaggggcagcctgggaggggcctcagggagtgagagcccacgccaggtcagcccgacagcccggcgtggcacatcatcgcctctgttcttgtggttcagctgtcacctccttgctggagcctgcacaagacaagctccgaggctgcctcaagctgtcatccgggtgtgtggatggctggccctcctcgtccacagggactctaactcccattctgacaaccatcagttccccgcgggaggccaaggacaggatgctgggaggcttccacatcagctatcaggaggtctgcggaggagggaggagggaggaggtggggagatgtccactggtggggagggtgctgcacatttcaggaggaagcagaggtgagatccacccacaagacccctgttcgagtgttccccacctgctcaccatcactggtctgtcggcctccccagccctgctggaacatgtgctccctgcggtctggatcccgtgctcaccacgacatccccagcacctagggctgctctatccgggtgcactaagggagtgagtgggcaggcgggtgggcctcagaacaggaggacacagtagatctatgcagaagccaaggcaaagcaagaggcagagcggatggcctgcggggagaggcgggtgtggccaggggactccaaatgctgtggggaggtcagtgaggcctgagatgagaacccgcggagcatgctaggggatttgggagctctcgatcttcaggccagacagtaggggaggaccagcacaggggccaccttcccacaggtatgtgactccatctgccgtgctctggccatgtctctctcagtctcagtgacctgatgcaggcaagggaacctcacagggccactggggcaaggtagtgaggtcacaggtgtgcctccttgcacagggccagcacgtgcaaaaccagcaaatgtgagttcccctcctcaggtggggaggggtgtttccaaggatagaaagcataagccccaaacctcctaagagagaggagtctatctttgtagaccacaaatcaacctcgctcccgctctccaagccccacaagctccagcagggcccaatctgcgcactgcgattcacgatgcggccaggcctttgcgcgcgctgtgccaccaccaggagtcctcattagaggcaactgcggtggcccttgtccgaggagccttccctgaccagccgccccaggcacccttccctgatgaaccaaggtgtaatcacgtgtcctgatcccgctccccatactcctgtgctctgagctcccccagtgcagggatgcggaggccaggagtccagggagtgccgaacatgactgaggacagctcccaatcccagcatgctcctcccacacccgtgctctactgagcactttcctggtgttcaactcgagtggtgctcccaacagccccgggagttggcactgaccagcacagggcgcagcaggacaggcagtcgcctccttccttctaggctggaaagaacactcaggccacccacacaccagacttgtcctgcagccgtgttctgcttcacctgtgcagtgtggcttcttaatttcaatctgtggcccacattgaaaaataattagatttcccaaaaaaagtagatttccagcttctcatggaagagcgagctggcagcagtggtctgcttattcctacagaaacacaagcgagtggaaccacgaggagctctgcaggggggcgtggcctctccggtcgcccgagtccccaccactcccaacagccttcagccacctgggcccctcgggcctggctactgtgagcacgtgagggcactgccctcttctgagccttgcgtgcagcctcgcacacaccactggccctcatggctgtgtctcctggtggcacacagggccaggctgtaaggccagcgggacaagcgtgaggaacagaaacagtgccagcaacacccccagggccacagcaccactagcagaccctgaaccccgcttgcctccccccacttaagggacccgtgtttcgtgtccagtttcagagatgttcttctctttcccaggaaccagagccagcgactcgtgaactatgacttggggcgacgccttccgcctggctggtttgcatctctgcggccagtttacgagatttccaccacgaccagctgaaaacactcctgtccgaccactgccttccccaccgccaccatgcggtctcagcactcgtgaaagttggtgagaaattgagcccatatgccttcggattgtttgcaaaccctggcaaggctctggtaagtccaggccaatttctggattaaattagaaatgaaaagaggaaaaatatctgaatcctggcatagagagaaatcattcattcaaaaaaaacggtcgtagaacatactgtacagagaatgttctcgtgctgggaggggtcaaaggttatagccgcgactgaaggcgcagaagatccttggattccacgttctccataggcctaggagcgtgtctgccctcagcagaagagatgctttgggggctcaggcattctcccagaacataagcagttaacacagctgggagagactattctgcatgcccggaaacctgctcctcctgctctgccgttctacagcggttaagagcagttcattctatcctttaaaaagaatccccgaagtagcctcaccggtcctttgagctgataaggctagtgtgggggtgggctggggtctgagcagcccactgtgctcagtacttccctaatacgtacacccacgtgcactgatgtagtgaaaggcacatgctcactttggaggcctggggccatcacagctcaaggcaggcactaagcaagtacatttctgcacagcctggtagcaaaaattcctttagcacctcatagtgaatgttctcagctttgtgggccatatggtttctgttgcaactacccaacccactgttgtagcacaaaaatggccacaggcaattcataaatcaataggcgtggctgtgttccaataaaactttatttacaaaaacaggtgaagggccaggtggccctggggccagagtttgccaacacagctttagaatctccagtttaccttgacaaattcacgtgaattttgctttcatgcaagtaatacgtccaaatttactttaatgtaaaactgatgttttaaaatgcttaccatccaaaaaaggggccacttcagggggagatgccttacatctgtctggtggcctctggcaggcctgagagtacgtgttcctggtagcaataggttgagcgctggccttgctgcaggctgggtatcacccactgcaatggtctgcctcctgtctacaaggagtgcggtgggaccaggggctcacaaagacagttcaaggtctttgtagatcctgatatttaagcaacacattgaggccttaggcttctcgggaagagtaggattgaaattagcgctttagtgaaatgcttgaagccacaaaggaagcttcagccttgggcccaagctttatatttcttgaagtcttggcacagatagattttacttttaaaaatgtatctgtagccaggcgtggtggctcgtgcctgtgatcccagctactcaggaagctgagacagcaggatcacttaagcccaggtgattgagtccaccatgcagcatagcatgaacctgtctctaaaacaaatctttaaaaaatgagtcaggcatggtggtgtgtgcctgtagtcccagctgcttgggaggctgaagtttgaggctgcagtgagctatgattgcagcactacgctccagcctgggtgactgagtgagaccctgtctcaaaaaagaaaaaaatgcatatataaacatattacttccacaacggctctgatcttccaaggcattcatccctgcctcccatttacctgagcctgcagaagagtccctgtctgtacctggggacgaaacttgaggtgccacacacatctgagctgcctcctagcatggcagcctcgcctgtcaggcccaagcccactctttaggggtgcccaggcccacacacatggccacagcatctggtttgtgagcagagactagcccaggcgctggcagagcaagtttttgaaaatgtgagaaataccaaagccccagggtcagtatcaggcatgttcagcaatgtcacctgtgtcccagcctggcagcacccagtacttcagggagtatgtttcccaagcaggaaaggtcaaacatgacagtggtctcccaatgccctcgggggcggggggcgggcctgggcagaggagagccccttatcctcccggctgggcccaggggaggcagcaacgcaaggtggaggctgcaggctgagccagagtagaaagctgggaggagcaggagcagaatgaaggcagagggaatagaagtcactctgccagtgacggggctggggggccagcaaagctggatgggccacacatctgcccacggctctcactccatcctcctagcctcacagtgcttggaagggagacccctctgcccttagacgggggaatgtgggcatccccaaggggcctcagcatctctgaccaggctaagggccgctgagcctcaggagaccagactcatcccagggttgccagcagccaggagggctacagctgcgtgtgctcaaactccagtgtaggccgggagcagtggctcatgcctgtgatcccagcactttgggaggctgaggcgggtggatcacctgaggtcaagagttctagaccagcctggccaacatggtgaaaccccgtctctactaaaaatataaaaattagccaggcatggcggcacgtgccagtagtcccaggtacttgggaggctgaggcaggagaattgcttgaacctgagaggtggcggttgcagtgagccgagatcatgccattgcactccagcccgggcgacagagcaagactctatctcaaggaaaaaaaaaaaaaaacaaaactcactgcagagagcctctgtggacaagggcccgccccctgcctgccacaggctcagcacacacccagtgccctcttagcacggctggcttcgcctgggcctcagaggtgtgtggacatgcccaagcagaggctggggaaaggccacagagaacgggagtctgaggtggcatccagggggcacatgcagggcagcaggtgttccctcaggctatggggtctgagcgcagggctcaggtttctgggctcgccctagggacaggctgacttcatagatgaccagggcctatcctcagaaggccccgaccttggggcttgaccctctgcagctctgtcttgaagttcttcgtcatctcacccttgcatgtgtgttttgtaagtgaaggctcctggggcaatgcagcatggtcccatctccccaggacaggctttcagctgcccccagcaggggcaggatcaggcatgtattccccacggcatctcagggcaggcgtggtggtggccatcccgcccacggctggcaggaaaggggcatgtctggtggatggctggccagagcccgtgtttcggcagaggtgaacctcccgtgagtgacacctgcatagagatgggattggccgtggccatacgctctgggctggagcagtgcaccagtaggaagggggcgtgcctggctctacttccccagacgccctggccagggcacagccaatgtgttcttccaggggtggcaggaagctctcagaccccagtgggtgtgcccttcctgctgggggtgcactcactctgctaggaccccgtacctgaggagcctcccctcggcaggattccactctgtgaaatcctctcttcttcctcccagcctccctgagtctggctgtgcctgtcataaacttctggtcagcctgaggcacccatcagggatcagccacaaaatacacatttgtttaatttcagtgaccccacatagaagctaaatgctctaatatttgcatttaaaatagccatcgcacaatttaaagatgaataagaaattcatgctaataattcaaggttccaatttttgttcacttagaacaatattaaaaagcaaataaaaagaacagcgagttgagagacagagagacagagactaaggaagaaaggaagtggcttaatagtccctttgtatggcaccttcctctgctctttgaacaagcgatcccacattttcattgtgcgttggggcctgggagttactactggctctgcctttaggccagtgttccccactggtaatatcctgacgagttttgcagcagccagatattgaggggaaataagaatgcattgcatgtaatacattggctcctttgaattctctatctccccgccacacctttctttccttttttttttttttttttttttgagagagaatctcactctgtcgcccagactggagtgcagtggcgtcacctcagctcaccgcaacctccgcctcccaggttcaagccattctcctgcctcagcctcccgagtagctgggattacaggcacgtgccaccacactcggcttatttttgtatttttagtagagatgaggttttgtcatgttggccaggctcgtctcgaactcttgacctcaagtgatccgcccgccttggcctcccaaagtcctaggattacaggtgtgagccactgcactaagcctatctttcctcttactttgggagaaattcaggtggagggctgctatggctaaacccaagaacagtcagcggttggtgaggaactggagcttgggaagtacagctgccaagtagggcagaaactcagaagattaacttctggggagggcaggaggcatcaaacacatcacccaagggagaagcttttcccctgggaagggaaagactgcaggatctttccctgtggtcacacacacaaaaatgtaggacatcaaaaactatcccaggcggaataaaacaaaaggtcaacaacaggactgggggaaatatttcccacacatgtgacagacaaaaagtttatctacttaagtacacagactcttcagatgaataaaacacccccaaatcccagcagaatcaagggcatgaataggccaagcaaaaaaataaaataatctctgtttacaaatacacgtatatttttaaatgcaggctcattaacatcaaggaaataacaacttacaacaaaaaaacttatctccgttgtaattaaattaccactgctcaaaaggactcagtggtgtgaggaggtggggagacagtcatttgctcaatgaagcgggaatagatgaaaccataacagagaacattccagtgtagaaagcttaaaaaatgggcatatctgttggccagagacttcgctttcagcaactcagcttaaggaaataagtaagcacgagcgatagattcaactctatgaacgtgatacagttagtggcatgtctgacctctaatggagaaataagttttgctatgtgaatatgtcatataaataataagttaggtaaaaagtgtgtgacagtcatatggtgcgatgttatgcaatcattaaaacaacgtagtagacaattaactgctgggagaagacattcacatacctacaggaatttatgctaattttacatagcaaaaaaaatgtcccggcacggtggctcacgcctgtaatcccagcactttggaaggccaaggtgggtggtcacctgaggtcaggagttcaagaccagcctggccaacatggtgaaaccactgtctttactaaaaatacaaaaaaaaaaaaaaaaaaaaattagacggccgtggtggtgcatgcctgtaatcccagctactcaggaggctgaggcaggagaatcgtttgaactcgggaggaagaggttgcagtgagccaagatcacaccactgtactccagcctgggcgacagagtgagactctgtctcacaataaataaataaataaaataaatcatctgtgttaaatatggactatttcaataaaccaaaaaacatgcttttctagatgtaaggaggaagataagaaaactggacccagcaggggctgctggagtgggcaggtgggtggttgcctaaaccaaagagcccctttctgtgcccaggtggcctcatgaagtgctccatttccaagccgcttcccttctggcaagtctgagatgaaaagggcagcttcatctttcccatagaaaagggaatatcacgtcttgtctttaacatagacaggaagcagcccctccagtgatttccactgctcccggagccacaggcggctcccctccacctctggaagactgcggcggccggccttgccggccccgacttcccctacctgtgccccctgcttgacaggccaggctgcctccattcttccagccggccccattcctgcctcagggccttggcgccgcctgccccctcccccaaacctggaacaggcgatccctatcctacctcttcccacatccttccgttgtcgtgagcctctgctcccgtgatatctccagtgcaccagcccctgagctgtagaaagtggcctgccttcccctacccttcttccttctccatctcctaactattttatttctttcattgcatttgtcattatttgaaatgatcctgtttgtttttcacttcagtatcgtctgtgcctcccttcccagaatgcaaggtagcagggttacgtcctgtcatgctcacagctgcaccccttgcctgacatataatagacgccccataaacaccggcccccgtatgaacggcagccaggggcaccagacagaggaggatggctatgccgagaatccaccccatctcagcagctgaacacaatacaccgcacaccgtgtttccttactcacaccatggcgcggggtgggtcgggagggcccgagcctatgttgcagctgtacctactgggacacatggcttccaaggtttccgtggcaggggagacagagatggaggggactccaagctcttaccagccttggtccacaggtgacccaggtcacttcctttcacacaggccactaggcaaaactggccatgcagctccacaccagctacaagggagactggggaggggagcacaggggtgatcgatgaggctgaactgcctgtgccacccctggaccccatatcccagcccaggctctgccacaaagagatcccaaagggagctctgcaggcagaagtcaccccaaatgatgagggaaactgaggcagtgcagggctgccagggtggagctgtgcctgcactcagcctgccaccacctcacctcctcctcagagcctgcattccctgggtccccaccatcagggcccccaccagctcctcctcccagggctcgacggcctttcccagggcacaggctgtgccaccattctctgcatccagttcagtgggcagctcattgcccagggctggcccccagaccccgggctctggatgtgccgttgcccagccccacctgctctacagctccagacaaacacctcactgggagcccagtcccagccggctgctgccacgtctgtccttccatgcttttgctttcgctccagccacggggagccctgtgaccagctgggacttacaagaggagtgtgacaagccactggccaggccttagagggccacttggggttgtggttcgaggcccccatagcacccaagttcagagacagggcacggtaggcagatcctctgtgcacaggcccaaccctgccctgttcagcacagcagctgccagccacactgcggcttccatccaggtgaaaattaatccaaacaaagtactcttcggggtggctaccgtaaaaaagaaaaaaaagacaagagttggtgacaatttggagagactagaatccctgtacactgttggtggggggcaaaatggcacagccactgtgggaaacagcgtggaaactcctcaaaaaattaaagaaagaattaccctgtgtcccgcaattctacttatgggcatatagtcaagagaacggaaaacagagtctggaacacccacgttcacggcagcactattcacagtagcccatgagggggccaccggagtgcccatggatggctggataaacaaaatgtggccgatccacccacacacgggatactggtcctccctgaaaaggaaggacattcttacacatgctgcaatgtggatggccccgaggatgtcatgctaagtgaaataagccagacacaaaaggacaattattgtttgatccacttatgcgaggtacccagagtagtcaaattctcagaaacagaaagtggagtggtgggtgccaggagtcggggggaggggaggaaagggctgaaactcaatgggcacagtttcaattttacaagatgaagagttctgtggacggtggtggcgatggtggcccagccacatgaatgtgcttacgccaccgaatcgcacgcttaaaaatggtgaagacggtgacttatgttctgtatatttcaccgcaattaaaattttttaaattaaaattctcttggaacaaataagaagttaaattaaaaattcagttcttcaaggacaccagccacacttcaagtgctccagagccccggtggctactgccccagaaagggcgagacgagcatctccccagcaccgcgggaagctctgtcgcacagcagggctctggaaggtcaccctttctcagaagctcccacttgctcaatgcccctcctccccaagaccaccaaagggtccgacatagcttagatctgtcctcaggactctccgggcatgcagaggctctcagtgaggacgcagggcattcatcgtcagggcaatgccatgctccaggcacggccgcgccttatctccctcgcccacgctgcgctcttgcagtgggagctggggctcagatcagaggcagagaccccccgctgaccctccgccgccggtctcccacgccccgggactctctgccacgccccgccgcctctgcaggacacccccactgtgcccatgacaagcacactgtcaacacgtttgctgaatgaatcagtgctcacttctgtgcaacaggggacaacagacacggcccaaatactttctcaacttctgagacttgtctcctaaaacggtttctctgttgtgataaaactcatctcaatttaagaatttttaaatttctcatgcttttctagaaacgaaccttcccattattcaaaatagggggtacggctggatcactagggtttgaataaagttggacggcaaaagtgagagaacgttctagacatcctccaaccagctgttgtgacagagagaccctgggcaccaggagaaaggttgatctgcctctgccagcctcatgaaggactcaccacgggccccacatttggtcagcgcccttggtgggctatcagaagtgacccctcctggactgtcactaaacagtgccactgtcatgataacaaaaccacattttatgtggaaactgaaaacgtgttcaccctactgagagactgaaaagcacattcactgacattatctcatgtaatcacatcaacccccacgatgaaaacactggcccattttacagatgagaaaactaaggctcagaggacgggagcagcgttcccaacgacgcgcctggaaaaggcgaggcctggagtcgccatcggactgtaattccaagcccagtcctttccccgctgggttggaaggcgacataatgctaggggaagaactcatattgtgaaggcagccaagattttatacctgccagtctcacagacctagcatgaggacttcccaagataatttagcatggcaagtgcccagcatgggcccggcacagtcacatagtaggggctcgataatgtagccattatggttttattgttattattattattattattattattatttttgagacggagtctcgctctgtcactgaggctagagtgcagtggtgcgatctcagctcactgcaagctccgcctcccaggttcacgccattctcctgcctcagcctcctgagtagctgggactacaggcgcccgccaccacgcccggctaattttttgtatttttagtagagacggggtttcaccgtggtctcgatctcctgacctcgtgatccgcccacctcggcctcccaaagtgctgggattacaggcgtgagccaccgcacccggccgttattatgattattgcattaaaggtacgtttcaaaaataagatgagggtaagtgtgacaacgctctcccaaataaaacgaattctgccgatgcagcggacttcggccccctgtacggataaggctgggctccagagggctagctgactcacccaagaccggtcaagaggaaagtgagcatgaaggtggtgtctctgtccagtgttcagctcactcacatcccctcctgcccctgaggtatcttttcaccagggccctggggactctgacccatgtgtcagcttggctcctggaggggctcacccctggtccgaaaagcagagctgggcagcagatcctgagcagacctgcacaccctgctgcctgcctctagcccggccccagaggacctcattcatccacaggtgtggacacgcagcacggggttctagaacttcccacctgcccggcttccacaccacctccagccctccctaagccccggcttcctcccacaaatacccccctgcccctagggccccactggcagcatctcacattccaggccgtgccctggtcctccttctcacccccttcttttccctgcaggactcagccaagccagtctgctcccctgggagcctgcattttgaagactggacgcccctcatccccacagtggctctgaccacatgaggcagagagaggaaaggtctgcacagcctccacccacacacggttcagcatcctggcacctcctgcttaggttgttgggggtatggaatgagggggaggtggttctttaatctcttagtgttaggcagaccatgggcaggtgcccagaagacgaaggtggcacatagacacccctttcaatagcccagactcacagggagaaaggaattccctccccaattcctcccactgcgagctttaaggaggggccctgggttggtgtctggccctcgctctaatgcacgtgaatctctactttaaacagaaaaggggcttctgtttggagcgagaagaaggcagggctatccagctggggctgaataacgtcactttatgtcttactattatattagcttttcaggtaaaataaggttgcctttttaaatgattttagttttaaaagtggcaaacatcaagaaaacatatttttcaaatgacgggacattgaatgacattgtcattcaaacgactggagtttgcacaaacccgccttagcctgtgaagagcctcaccaagttaccatcacccacgatgtgcagacgagagaactgaggtcagggatggtcaacttgtctcacctggggacccagcaagcctccctgagactgtgtcactcacctccggctaacaaggaaatcggcagagcctcaggggacctggcccagctgggcctctctggcctgcccagcccctggttgaccctccccgccccaccctgccccctcagccaccccactcacaatgttcatgagtgtcagcaggtacttctgtacgtgctccttcccgtggaactgcaccacagagtcatccacgcccagcaggacctcgatgttgtagtcatcgtccgcagcatgcctgcgtgccctccgcctcgagctgttggcgtgctcctctaggacgcccagggcgcggctgaggctgtccaggctgtccagggaggcccctgcaaggagaggacaccgtcttcagcggcagggcaaacccacccggacacaaacctaccaggcgccagcttggccatcctctcatttaaaactcatagcaccctgaaccgagggtattattccattttacagaggaaagcgaggtgcagaggaagatggcagagacttgccaagctgtctcagacacagcagggcccagacaggcacctctgtgacttccaggaccgctcgttccccagcccctggtggcaaccccagccacagcaggggccacagtggcctccacacgatggatcagacctgctgagactgtgagagacccagcccagcatcaccgtctgccttatggagcccagggctggcattcagccatggagaggtcgggaacctcagcccgcactgcctgacgctggagtgggcagagccaccccttgcccacactgcccgatgctggagtgggtagagccacctcttctcccccgaagggctgccaggtgccaaaggactggtgtcccaggtgtcatcgccagctgttatgactggggaaaccgaggcccatcctgggctgtgcatgttccccagtgtctccttgggcccctcccagaactttctgctaagtcctccactgaagcgaggccccacatctctgggccaggtcccgggccccctccccaggtgaacggtaccgcctctggcctgattgaattgtgcagagaccaagatgaacccctctgtggcagctccgctgcagtcggccctgggcaggcactgacctcctgcccccagggtgtgcccctggccacttggggctgccatcctggggagtctgccccggatatcgtccctgccttctgtgcagtgctgtctctgctgtgttctgtgtcctgcgggcctggagaccaccctggaccaggcttcagttcccagccctccactgcccgtctgaaggccacagcaaggctggccaggctgacctgcagcatcgatggcagccccagaccacactgcccaccgccccccaagccccagtgtcctggaagccccctttcccttgcactggtctctgtgtctaagccaggtcccagccccagggtctccatggcattccccaggcaggtcctcagagactcctggcccgggacagacccagggctgcaggtcatcgtgacatcactgacccacagggcggtggccaggccccgaggcccctgcagctgagggagaccagcgtccctgctgcaccacctctctacaaagagtcttccagaacaacacttttcacccccaacgcctctctcctgctgcctcttccaggcagggacaggcactccctccctgtgagggtggcccaggacaggccctggaggcagaacaaggcccctgcaggcggcacggccactcggacagtgaggcagcctggtaccaggccctcatcccggcacacgcttcctcacccagtgctgacagcaggccactcggtggacgtggccatttccgttttacagatggggagacccatggcatcccagcatggccgactctcggccagaagctctctccttgcaccctgcagcctggctcagacaagacagactgaacatgaagtttcaggcacaaacctgcagcccggctgtgggcaagaccaagacagacagtggaggtgcgaggcggagggtgagggctgggaaagagaagaggagtaagtggggccagggctgagcagctgctggggttccagtaccttcgggggtccttgtgccacccccagctccacagttctgtgtcccctcggcgcacacacacatgcacacacacacacatgcacacacatgtacacacacacaagcacacacatgcacacacatgtacacacacaggcacacacacatgcatgtacacagcaaggactttccagggccactccagggacaggggtggggccggcaggcctgcgggcagggctgtggggagccgagcagtccacttagctgcctggatgactcagggccatccatgccgttcccagaggaagcgccagcaactcaagcctgacaggggggttgaggaatcgccactctatttttgtacatttatttctttgcatttccaacgaacagagacagctcaccttcagaatcaccttgggaaggagagtgatggcaatttccataggaaaactcttcctccctggggaacaggccgggcgttaccctctgcccttgtcaaactaggggtcacacacgggcggtgccctcggcaaaaccagaccacagaggcactcgttgaggtcacgtggtgccatctggttgatagtatttgaaaactgggagatttcatgttttaaaaatctagaacatccagcttctcttgaggaattaagagatggggccaccccaggggtagcccgggtctgtgaattgaggggccacacctggagacaaaacacacagggcttggctcaccaggccacctgcctgccactgtcaatgtcattctggcaccagaaggtatcacagtatgtcctcctggccctaaccccagagtccccatgcagggacccctccagacattccccgtaggagggcatgggtgccgcatcgggacagagctgggctggggcacgtcttgaggctgcttctgccgagcaggcagagtttttaactaaactgtgtgttgcaagcccattaaaaacagcaaaggtttctaaagatttagaatctgaatttcacctgaaatggaattattattgttgccatcattattttaatcgtgataattttggggtgaaatttggaaattatgttctagagcatccctccacccaggaccagtgcctagagagacggcccaaggcccaaaggcaaagtgggtgaggagaggaagacaggggcctgggccacctggcaggtgacagccacgccctgcgtctggcccctggaagcctcagtggtgctcaggctggacaggacaaggggagaagccctaagagcagggggatctgcaatgccctcagacctggggcaacaggagctctggcccagcccccctcctgtcctcctctgtcccaacaagacccggcagtcaggctgaagccccagcttgtcaatcacgagtgccacctcagttttccccacaataagattgaccctgaccctgtcaatcacgagtgccacctcagtttttcccacattgggcttaacccaggccatgaagagactctgaccacatgctggcccttgcagacctgttccccaaatagagccttgctatagggagctctggccagtgggcctggcgtggtcctgagtcgtcttcctagtgatccctttgaagtcaaccttggccttgggcctgcccacctgcactggttgcctacctggtctaacagcccctgttccacttggtccctccaaggcagaagagggctatttgctgctctcccctcctcccctgggagctccctgtgtagcccagccctgctgagctgtggtgactgggagctcacacagcctctgctgtatccctcggcactcaccccgcctggatgagtgatcagcgcacccatctcctgcagaggcaggaggatgacactgcccttggccttcctttcctctgtgtgcagccttccccacaagaaggcactgggccccctgggggtgctgattgaccaagccccagaagtcatacccaggtgggctgcagctaccctgaagggaggtgtctgtggcaggatcccatcttttaaataggtaacacagagctttcgagttcctggcattccctgtgctcagggccccttttggatggcagctggagatctctttgctcacatcgtggccaaataatgacactgtgggaagcactccagagccatcctgttttagagtctctagaatggaacaaaaagactctatcgaagagtcaatcaataaacagggagaggatggaatgaggggaggcagcagttctgtccagggaattccatcaggggaacgggtgggtcacagtagccacgggctcatccacagtgccacagtgcacagggcacgtgggcaagggctgcaactgccagcatcctaggcacaccccgagtctccaggcaggggtgtgtgcacagcccttcacagtggcagctccatacccccagcagccatccaatcccctcgccaaggtggaggcgtgtcaccatcagcatatcgtcctatttcagcatcagggaaacaaaccaaggagcaggaaaattacatgactcggacaagccacaccaccagagaggaggagtgggcacgcgcccaggcctctgagtccaacgttgtccacatgcccggagcccttctgtacttcaccagcactgaggggtgatttgcgggaatgagaattgtagaaacaagtatgattagactagagaagagaaaacctgggactgagtctgcaacctcgggagcatcgtgggatggtgcgggctctgagggtgggtacagtgggcaggtgtgggatctgtgggcaggtgcagtgggcaggcacgggctctgtgggcaggtgtgggctctgaaggcaggtgcagtgagcaggcgtgggccctgaaggcaggtgcagtgagcaggtgtgggccctgagggtgggttcagtgggcacgtgtgggccctgagggcgggtgcagtgggcaggcatgggctctgtgggcaggtgtgggctctgaaggcaggtgcagtgggcaggcgtgggccctgagggtgggttcagtgggcacgtgtgggccctgagggcgggtgcagtgggcaggcacgggctttgtgggcaggtgtgggctccgaaggcaggtgcagtgagcaggcgtgggtcctgagggcaggtgcagtgggcaggcgtgggccctgagggtgggttcagtgggcaggtgtgggccctgagggcgggtgcagtgggcaggtgtgggccctgagggcgggtgcagtgggcaggtgtgggccctgagggcgggtgcagtgggcaggtgtgggccctgagggcgggtgcagtgggcaggtgtgggcctgagggcgggtgcagtgggcaggtgtgggctgagggcaagtgcagtgggcaggtgtgggctctgaggtcaggcaggggctttgcagtgctaagggtggctgggtgttcgctgtcccctgtgcgaagctcagtcctatgccttttctgggctggcctcttcacctgcgatgccctttttgctgctgccgctgtgctggccaaatttaggccccctgaaagacccagaaggaagggagcccgctgcctcccatgggactcagagctcttgaaagacaggagcatgttctgcccccatctgcctcctgcacagccacactgcgtgccactaggggacgacagggacaggggccggggcagggatgcttaaaacctgaggaccacactgttcagtgacacggccgactgctgtcccctctccatgggatggccgccccctcattgctctcttccttcaggtgtctgctgaaatgtcagctcctaagggagaactttccttatttcatcccaaattgaaatcagccctcccctgatttctcccgacagcaccccgtgctcttccttcctgtgacactccactgcaggcaggtcttgtctcatttgtgaatttgcctgggcattaactgactttccctctcagatagagaaccctgggggatggagaccatggggtctggtgtgcctcagtgtccccagtgccccacaggtaaccgcagggctgtgaggggcctggagccatggcagagaggtgctctgggaacagagggcccagcagaggcgagctgggggcctctggggagttgggaactgggatagaaggagaggcaggtgcagcagggccggaggggccacactgggggtggggagccgagaacaggagcaaaagtgtggtggcagttggagaagcatgagatggaacaaaatccagctacaaattacttgcatatggcataaccaagtccaaatgaccaggaggagttaaaacaagtggggcaaagaaacgtaccatgtaattgccaaccaaggcatttaaggagataaactgataaaacaaacaactcatggaaaaaaatacaaaagatacgaaactttatgctcctaaagcttcaacctggtgcaaggaaggagagacaaggccacagtgataggagcactgtaatacatttattccagacaagtctgatacagcattaggtagggatagaaactatttgaattaataggaaaacctaacgttcaaacccaacagccagaacacgtgaccttgtcaagcacacacgggagaagttccacattttaccacattaggacacaactcaaaaactcaaaagccgtgcccacagtcaccattactgagacacattaggacacaactcaaaagccgtgcccacagtcaccattactgagacacattaggacacaactcaaaaatcgtgctcacagtcaccattactgagacacattaggacacaactcaaaaatcgtgcccacagtcaccattactgagacacattaggacacaactcaaaagccgtgcccacaatcaccattactgagacaaaatcagagataacaataaaaccctaaaccctaaacatctgaaattaaaagcaccattctaataggcctagactaaatagaaaatatacattccactcatggctcaagtagaaaacctgaagaaaccaataacctcagaagaaattgaaagagcagtcaaagaaatgcttccatagaagagtttaaccaaatccacaaggaacagatactcctcatctcacataaaataatgcaaagatcaagacttcttgaacataggaataacccgcaagaaagcagagtggaaaaaagagcttatcagctataacagcaaaactcccaagtatctaagaacaaacaaaaactaatgaatgttcaacgactacacaaaaagtagtataatatagtctaaggtctccaaaaacacaaaagaagacctcagtaaatgaagctacatggacataatcctggactggaagttggtcctcctccaaatgaatcaagaaatttggcataatctccatcaaataattgttaaaataattgttaaaattattctccgtcaaataatctccgtcgaataattgttaaaattattctctgtcaaataatctccgtcgaataattgttaaaataattgttaaaattattctccgccaaataatctccatcaaataattgttaaaacccaacaaagtgattccaacattcatccggaagaccacaccagacagaaaaataatgaaaaagaatgacaatgaggaggcatatttttttcaaattaatgcagtgtattataaaataatattaatgaaaacgtagttgtgtcaatgtcatgaaagaaacagatcaatggagctgaataaaacttccaaaaacaggctgggtgcagtggctcacgcctgtaattccagtactttgggaggccgaggcgggtggatcacctgaggttgggagtttgagaccagcctgaccaatatggagaaaccctatctctactaaaaatacaaaattagctgggcatggtggtgcatgcctgtaatcccagctactcgggaggctgaggcaggagaatcgcttgaaccggggaggcggaggctgtggtaagctgagatcacgccattgcactccagcctgagcaacaagagtgaaactccgtctcaaaaacacaaaacaaaacaaaaaaacttccaaaaacagatccaagaatatgtggggtttccaggttaaaatggcggattgaacacagatatctgatttggctcctttctagaatcccattaaaagttcagtaaagaaatttaaaaaaaatttaaagtcacaagcctccaaggataggcagagcaggaggggaagaaacaacaagggaactgtgggaggctggaaacagatgggcaagtggtaacagacttggtacatcaagaaagctgaatcccaggctggccatgaagacagccacattctacaaagtctcccggagaataagaagggggaaaatcaggttacaggagaggtcatagacaaagaattggaatcagaatgactcagagttctcaaaagcagcattcgatgcaggaaaacagtggaggaaagccttcagaattctgaaggaaaatgattgtccaactggaattctgcatccagacacattccccatcaagtatgaaagtggaataaggacatttctagacatgtcagttctcaaaagatttatgtgacaagcactcctctcaagaagctactgaaaggtgtgcaccatcaaaaacaaaaaaggcaacaaagaaagagtaagacacagatatagaaaacggaagcccaacacagatagagaaaacgggagcccaacacagaagacatggcctgggaggcccatggagggtggcgagaagtgaccctgaggtgatggctctgcaccagatgtggagagcgactgagccatactgagcagcgtgacccacggggtgaactgtcttcaccaagaccccacctccatcaggccatctgtagcccggggacaaaatgcccaggagagcctggcctaggttcttggcagtacttggcttggccatgtgccgatgaggggcgctcccctcctctgctgaggacgcacaacattcacagaagtttccagctttccccccaccgagagctggaggcaggccgtggcgagcttagaagcaggacgtacaggtcagccccctccctctgaccgtatttccgctgcaggtccagcgcgtggtccccacctgggccctaccaggtgcctgactgtgctgagcccaagacttcctcgagaccttgctcacgacttccccaggaggggccttgtcagttcccggagaagcagaagtcagaccacgacctggagactgatctgctcacctccgggagcctccatccagcgggggcagtgccgccctctccttacactgccagcgtgtgccagctctccactttaatattaatcgtctttgatattcatttgcatgtaattataaatagttgctcaagtagcaatacagtgaataaaattagtaaatgatacaggtagcaaacggtgctaggaaacggcggaggtggagcaggaggggacaacctggcagtctggcactactgaggggatcatgaggaagagcaccatgcggctcatatcctaaagatacaggatgtctatcggatagcccagtgccctccttggactgacccttggcccatgggccattgttcggccccatggactggcttgcagatgggcaaacttgcacaggtctgtaaggaggcaatggggagctgccccttgcagcattgcttgggtggagtgaggggagctggaaacaacacgggggtcatcagtgggtgagaggagaagcaaatgtggtgggggcatcccacaaagtgctaccaaggttagaagtttgatatctacatagatggatggatcttaaaaacagagtgccaagtgcaaaaggtaagaaacagaatgagacacaattcagagcgacttacataaattatggatacacagacgcaagacagcaacactcatgttgcaaaaatgtacactaaggaaaggatacggtttgatcacctgaaatggttgctcactgcaggagaaaatcagaaggaagagagcaggctggggagataaatggcttttgtttctttctttgttttaatgatgttaggacaactggttagagggaggaaaaggtcaaattttgacctcatgccttaagcaaaaacagattccaagtggatgagatgatcaaaaggaagtcatggaagtgctagaagaaaatgtagcgaggcacctttttatcatcttgctgttgggcgggctttgggttccaagcctagggctctttcccagccctctccttagctgccccatcccctgtgagcagtttcccactctgctggactctgctggctgaatgcaagggcagatggcacacttgctaggggatggtgtgaggggggatgggcacactcactaggggatggcgcaagggggggatgggcacactcactaggggatggcctgagggcagacaggcacactcactaggtaggggatggcctgagggcagacggcacactcactaggtaggggatggcctgagggcagacggcacactcactgaggcacctgcacacagacagaggtgctgtgctactgcctcaacctgccaaccatgtggatgggaacaagtcatcctttttccagtgcttaggagtccccaaaacgtaagtcctaatgaccgccctgcagagccagaactgccacactgcccagaagaggagagggaggctcagggaattagactaaggccatgatgttggcaaatggccaggccagaatgccagcccagttcctgcacacaagcactgccagggcctgcaggggccaccaccaggctcaggaggaccaaagcctggagcaccagcagcctctcctccaacatgaggagccccacccaggggaggtcaacgggaacaaggtcatcccctccatttcttactaaccaagagagagtcgctctgtggctgtgtattcccctaaagataatcattaagatgaaatatgtttatgtggaagtgtaatcaggacacagcagaaagccctgcttggaagcaggcaggctctttggaggctctgggaagcagaaggcaggctcagccccacgggggccatcagcacagagccccactggtgtactttattaaaagatgctcattaggattattacatcccagccctttataactttattactgactttgaattaatttttgcaacttcaacagacacagctcatccaatgccatttttatgacctgaggtggatcggagggtggggaggggctcctggggccggcctggccatcaggagcgcatcaggaaccgctgtgccgaatctcaggggcagtcctgacagttctctaaactcccacgggatgggctgccccgcggacagatggacgctccagcccaggcctgctcagcctcagccatgcttcagggagaaaaaggaagcactaaaggagagaaggcctctccgggccagtcctcagaacatacccccgcacagcagaggacaaaggacacccctcagtggtggacacagaaggtcctggcctgcccagcacctgcacaccctcacagagccacctggggttgcacagcacggtggcctgccctgtctggccattacaccttttctgctagtaaaccaccctcccctatttgcaccccatatggctcatggggagccaatcccactgcaccccagctccaggagtgcccaaggggtcctgttaggccactggaacctgatgctgtgtgttggtgtgcacaggaagactcccgtgctttcctctctgctgggaaaatgtgactctgggactgctaagtacctccttcccccaggagcagcagaggcgagagatgagggcagccccgtgtgctgctgacactgttcaggtccccaaatccagctatggctgaaggtgatgcacccctggacatcctaattcttcaggtcaattcatttagctctctgtctcttgcaaccacgagagtcctgtgtgcccttacaaacacagacacagccaaatgtgctggcctgagagagacaccatggtttggctttgcagccacagctctcttgaacgattgaggcatcagaccaggccactctcttctgccctgtgcctgcacctcccagtgtggggcgaggagaaggtctgcagtatttaaggtctatgaccagaaaaggggccaggctctggtccggctcccagatacgtgtccttgggaaatggtgcccagcagaggtgtgaggctgctgaggttgagcccaagccagcagggccatgctgagtgaccagcagctgtgcgagcccctctgaggtgtcctgcagcagggctggggcttcctgtctacagccctcacagaggttcccaaacacaacttccccctcttcaccccagggctggggcctcctgtctacagcccccacagaggttcccaaacacaacttccccttcgtccccccagcacccgccgaactaccgaggctcctctgcacctgccccgtgccactctccagcggcctctgcagcccactcacctccaaggattcacgggggtctcggggccttcagaggctggggcgggtgacaagagccagcaagccctgcccctgcctagcatctgcttaagccagggagggtccccaggactcaccacagcccccagggctccaagccttccctctgctgggcagttggcccagggaaggggagctggcctgggtaatgtcacgggggcaccgcagcacgcggcagccaagtggtgggggccgatggagaggccggcaggtcttttattgaaaatattcactgtgaacttcagaacaaaacgaagatccccacgggtcccaaaggaagggagaattcccaggggttgtgttctgaacgcagaggaggtgggggccggcaagtggggtgctgacagccagtgccacgggacccatgtggccggaggcttggccagtggctcagcagatgacaggcggaaaatccctgtcaccagtccggtacatgctccagagcccctgatttggacatcatctggaagcctggcattgctccccggaaggcctcaggtacctcacactcagaaggtccagggcctgctgcctcctctgcccgcacgtgcacctccggctgcactgccagctgcatcgtccacctagggagtggggcccgcatgcagccaggtccatgccaggagcagaacctgcctctccccctccctcaaaggcagctccctcctcactcctcagggtctctggaacctacccctccacgctctatgccctctgtactgcccacgctcctgactccagcagcatctgcgcctcccccatctctgcactcttcaaatccaagttccaaggcatttctttacctgccaacctcagtttcccttgttgtggccttcacgtcctttgatgttgagccctgcgttcatgcagggtgggcgtgggccctgcaggggtgaggtcctggtcccctgggaagagcttgcagccaacacaagcgggaggtctcagatgctgcccgaccctgtgcaaatgaggccctctcctacccggccatgagccacgtgcagggactcagcacctgcctctgctccctcctccttcctgacccctctaggtcaggagtccaggcacacagcagtgctggggtgctgcagccaagcacaggctcttcctagctgattgtgggacctggggcagccctgcacggtgggccacactgtgccaccaagctgccttcctaggaggaagagttcctcagatgcccaggcaccagggacttcacacacctcctgtttcttcttcatggtagccggtggagtgggcacgggacctctcttacgcaaatgagggaacaagccctgggcccaggcaacaggcacccctgcgtgaccccagcatctggctctgtcccccgcatcccgagcttccaatggcccatggtggtgattgcacctggtccagcagccaagagggagctgaaagtaccagggccctggcccagctgaggaccttgctgccatcacccaccatgacccttgggcacaaagaccccccactttcagtcgtggcaccaagcacagtccatgtctgaccaggacctgctcaaggagcaggagtgaccgaggacaaccccggggaccaccccagccctcccccatgctgggggtggaagggtggtgaggcctggggcctcttgatgctcccatgccctgatgtcccatcctccaggacgctcccatgcccctgcgcctcctgagggggcagggaaaccccatgtgggcgggcagcagccaggctccctggatctgcccagagaagagccccccgcagaggtgatgcaatgctcaccacgcccccctcagctcaagaccctggaacttgccagaccctcagccctctctcccagtgagtgtcagggacctccctttcccctcaggctgctgggcccccaaaccacatgtcctccttccctctgctccagccccccatggggctgaggagcaggcctgcccaacctttgtttctggtctctcctgtccttcacgcctggctgtgggatcttctctcagacctgcctctcccacgggtaaatcccaaggtgcagactcagagacagcaccgagaggcccccagtgcagccgccactctgagcccagaggccaggccatccaaccctgcagggacgggggttcctcccatttgtcttcctgtgtgaactccgtgggtccagaagcctgagtttgggggtggtgacaattggccctggtggaccccacacactcctgtcccatgatgcttcctgccctagaatatcccagctgcagttgaggagggaaggggctcctcatactccccacacagcacccagaccacggtgttgacgaggcttaatttgatcagccctatttcgagaagggaggaaatcagaaatcagagtgagtgctgagtcctgaaaatttaatccccaaggcagcctcacagggcctttcctccccaaccggggcaggtggcagggatgcactacaagcccagatcccagggccaccctgagaaccaggaggggagggagggccaccctgcctgcagagaggatggcaaaggccctgcttgccgggccccagctgccctcaacactgcaagggctcagaagactggaccagcagctggccgggcagaaactatagaaatcatcctaattctactttaaaaggctggggtttcctcttcttgcttaaaagctggtgtgacccttccaggtagcagccagcggcaggcctgtggctcactgagatgggctgggtgggtggccctctggcctgtgctcccaaccagctgcccatgtgctcctgcctgccctgcagaggtgacgtggctgccatcacagcattgcatgttgtgaactgactcctgccaagccctgagagggcatcaagtctggcagcagcccctgcagggcccagctgcctccgaacctccagcatgcttctcccagggcaggagcaccctccccagagcacccagtcctgttgccactttctgccaggcaacccctccccctgcttccaggtccagcctgactttcctcctgtttgcaacagttcctacctgcctgccctgggcccatgccctccaccaggacaagtcactgtctccttctctggctcccaaaaccttcattttcattcatttgttcattgttcattcactcgtcaagtattttgctaactaccatttgccagccttgcgtggcaccacctctaggagagcgctctggggtgtcaccatcacaggctggcctgctcagtgatcactcctcagacacatgcacacacacacatgcacgcagtcacatacacacatgcacactcacacgaatgcactcatacacacacacacgaacgcactcacatacacacatgcacactcacacaaatgcactcatatacacacgaatgcactcagacactcacaaacacgcacacacgaatgcactcacacacacgcatgcagtcacatacacacatgcactcacacgaacgcactcacacacgcacactcacacacgaatgcactcacacacaaatggactcacactcacatgcacactcatacgaatgcactcacacacatgcactcacactcacacgaatgcactcacacacacgcgaatgcactcgcacacgcatgcactcacgcgtgaatgcactcgcatactcacatgcacactcacatgaatgcacacacacatacactcacagacgcacactcacacatgaatgcactcacacacacgaatgctcttacatgcacacaaacgcacatgcatacattcatcacatgtgagtgtatgtgagtgcatgtgcgtgtatgtgagtctatggatgtgtgtgcatgtcacacgtgtgtgcatatgtgacatgcacactcaggcacacacatgcacacacacaaacgtgcacatgcacacacaggctctacagtgaactcctggaagactgaggtggcccttgacccctctctaagtccccaggtacccacatggggcttggcaaaatgaataaataaacgggccaaaaacgcctattggataaatggaaaacttagttatccttatgctacttctgagcaggtggagacaggacagggtaggacgaggcgcagcgtggatgcgggcggattgtctgtatctccttggtgggagcagttggccgtggagtctacatcggtttccttcctggccgtcatttacagggagagcatgagggcggcgtgaggtcagcggggcaggtggatgctgtgcgcttactgcagccatgcggtgggtgcacgctaccaccgtcttctcctctttttcttgggagctgtcgccatggctcccggcacaccctgacatccgtaggcgccatcctgacaacacgctgccggccgcaggcctcacaccacagcaattctcactcgggcctccctgaccctcgacctgtgggtccctgctaggctgggcgtgtttcccgatgccccatctctctgacctagacatattttgttcacatgttgaacagagagaaacggtctgcatttccagaaagaaatatactctcccaattttccttggagcatgcggccctcttggcttgtcttttgcttattccctcttcactgagaaatattttgctcccgtgagaaaagccatgtgggcagggggatgagagggcacactgcctccagcccaaggtggccagtggtgactaggagggtgcaggtccatgttgctgggtcttatttttgtaaggaagtgagaaatctggatttgcatgtgaagtctctgatctctaaatactggcaaaaagcaatttaagaataatgtaggtgctgtgctgcttgtgaaatgaaccaaagctgggtccccaggtctgtctgccacctcagctccacgcccagaccaaagctgtgtcctcaggtctgtctgccacctcggctccacgccctgagcaaccgtttccctgtatcctcctccgtctggcctggagaggttttgagcacagtaggttctggccaaccagagtgagtccacctgcctctgcctcacagtggctgaagcttcccgggccgcagttcacgccccacttgtttctccacatccctttcccaccttgaaggacagctcctgatggatgtgttttatggtggaatcctcacgcaggggcctgaggaacactccctggttatccacacggcaactaacactcagcacgcaccaggctcctcctccctctcatggactctcaattcagccccgcacagccaagggctcacccacatcatgtgcgcttcagacaaaggactaatttccttaatacataaagcgctcttacaaatcaacaggaaacaatccagcaatccaaaagggaaatggacaaacggtattgatacaaaagtgctgggtagagaagggcatgctccctttaaatgatatggaagcagggaagtgcatggtccctggctaagggctccaccctcacggacctatgtgaggacaggcactcttgcctttgtgcccaaatgtcacatttcccaagaccaccctggtccaccatgtccccatcctgtgcctataaaaacccgagaccctaacaggcagacacaggcggctggacgtcgagaggagcgcatgaggggaggaacacacaggcggctggacgtcgagaggaacgcaccaacgagcaccagcacgctgcaggccaccgaccggcagaagcagaacgacacggagtttggccggggcagtcagaggagagcccaggctgcttagcggcccgactccagggaaagccctttgcaccccatcctccttctggcttcccccatctgctgagagctacttccactcaataaaacctcgcactcattctccaagcccacgtgtgatctgattcttccaggacatcaaggaagaacccgagatacagaaagccctctgtccttgcgacaaggtagagggtctaactgagctggttaacacaagccgcctacagacagctaaagtaaaagagcacatgcagcacacgcccactggggcttcaggggctgcaaacattcacccctagacactgctgtggggtcggagccccacagcctgcccgtctgtattctcccccagaggtttgagcagagggacactgaagaaggaagccacacccccatagcacgccctgcgaggaggacaagagaacttctctcatttcaatatgaggggacaattgtcagaaaagaaaagacagcagcttttcttttcttctttatctctttctttctttcccttccttctttccttccttccttcctttctttctttcttctctttcttctttccttctttcttttttttttttgagacagagtctctgtcacccaggctggagtacagtggcgtgatctcagctcactgcaaccaccgcctcccggattcaagcagttttcctgcctcagccttccaagcagctgggattacaggtgcctgctatcatacctggttaatttttttttttttttgtatttttagtagagacaggatttcaccatgttagccaggctggtttcaaactcctgacctcaggtgatccatccaccctggcctcccacagtgttggtattacgggtatgagccaccgagcagcttttcagtgtatgagaagacgctcgacctcacccttaattaaagaaacaacctgcatcagattgtccaaataaaaatgtacggatcaggggtacatgctgagagaaacggatccagccaaccatcctagggttgtggtcatccttatcaaagttgaaaatgcacaaaccttttgaatccacaattctagttatcaaatttaatcctacaaatgtcctcatacaagtagccaaggaaataagtgtaaggatatccacggctgcattataagaaacggtgaaaagaagtaacgtccccatcagtcaaggtctggttaagcaagtgattcacaggatggaatgcctgagcaggaggaatgggcaggtctggaggggctgctgtggacgacgtccaagacatgttccctgataatcgcaaatgcagggtagcacacggtgtagtctacagtgtgcaggaaaaagtcagaaaaacgaaaacacagtatctacaggacacaaaatcccttgagccagagattctaatcctaggatttatatatgtgtgtgtacacatgtgtatatatatatacttgtgtgtgcacaggacatcctgaaaggacacagaagaaaggtgtgcagtggctgccctgcagaaaggagctgagttccaggacagccaatgggagggggatgaggacagcaatgagcatttcatatggctgcaatccttagtccagccaaaaagcaagccacgcacatgcaggagaggccaggactctcccagcagctcccccaggggtcaggggcagagggagcccccagcctggcctgctccctgacgactctacacttggcagctgaagggggccaccctgacagtcaaggcccagctgtgatctggggtggaactggtctggcaccgatctgcttggcctggctctgggtgctggcacggcagtatctggtgggctgcagggcccccagctggggccctttgagtgatgatgagcctgctgggctgggaccacagagtgagcaggaccagcatcccctcaaccccagatgccctctaggactgcagggcccagacacagagagggaacctgacgctcatggggagggctgagaggcaggcagagggggaagggtgttcctgaccacggcccacaggaccagcagtgcagagggcctgggagtgagggaagcccctgctgtgccaaggagggagggccaggagaggagagatggccgaggccgggaggagggcagaagtgcagagagactagagggggcagggcagccctggcttggggctggagagggagccaggaaggagggtggaaggcaggggaggcagcgtgtggacaaagactgagagggggagtcacagcttgggtgcagaaagtggggccagggaggattccgggtttctgacctgggcaaccggtcaccctgggaagccttccctgcaagggaccctcgggaggagccgcgtgggaggaggagaaggccgtgtggggcgtgttgggctgagatttctgtggggacacaaggacagacacccatgagacactcaggcaggagtggtctggagcacagagagagggtgggccggaggccccaggtgtgggcggcctccaggatgaatcagctgcagagcaccgcagtggcgcacacagatcagtgtcctgatctgaaaagtaggcataacgatgctggccacagcccacaagtaagacacatagaaaacctgaggcccacagaggtgacaggaacgggccaggtgcacggacagggctgttcctgactcagctcactccaccagaacccagtctgggcaccagcctgttttcttgtcctctccagccagcagggcagaattgggggtggacttgccccagcctgaagacctccggggccctggctcctccctgctccacctgccatagcccaaaaccagtgtgggtgtgaagcggaaggagactctgcagcaaggcccagctcttatgccggccactgccttgcctcctgcctgatgcagtctctcggcagcaaggcaggtgccctgagacctggaggtgcccccagccccagaacccaccatgcgcggctgggccgactgtgcctgcccttaaggcaggcagaacactaaccaaagccagcggacatccactgcctgcggagcatctggggaaggctcctgtggggctccagacccggggcggtgccttcaccacggcctcctcatccagcatccacaactctggagctaggaagcccggtgctccttcccagaggagggagccgaagctctgccagtctgcactgaagtctgtggtgtgcggtcacctgagaacagctcagtcagtctggctggatcctgagctcctcccccggcctgtgcttgagaggtgacagccagcacgtgagcaagtgccctgggttctggtcccagcaaagctacctccagctgtgcacctcggtcaggcacctccagctgtgcacctcggtcaggccaccctctctccgtcagaccctcagtgtcctgatcagtgtccacaagtaagacacatagaaaacctgaggcccagagaagccaaggaagtccttacaggcttctgtcagagaatcggaggaaaggaggggacgccagagaatctgggcttaagtgacttggccgtgatcaaaacacaggcagagtcacaaacacgagaccccgctgcccactcccgacggagaggtaattccacaaacacgagaccccgctgcccactccacaaacatgagaccccgctgcccactcccgacggagaggtaattccacaaacacgagaccccgctgcccactccacaaacacgagaccccgctgcccactcccgacggagaggtaattccacaaacacgagaccctgctgcccactccacaaacatgagaccccgctgcccattcccgacggagaggtaattccaggtcagtggcatccagccttccccggcccccaggcccccagctgccaccaagaaacactctttgtaggggtcctgccccactggggtgcagaggtacatcccccaaggcccagccccgcaggaagcccttcctctgcagccattcttgaaatcacctccaagaaaaaagaaatgcttcagcttccaaagatatccccaggcaggaaatgggccgcaggcagcatgaatgtttaattacgttaattgtccaagtccagcgcacatcatccctcctaagtaccttatgggaaatcgtaattaggcgtgaaatggctcattttcacaactcccctttctcggggttctccagggcgcatgcccctgtcagctggccggacaggcctctcttgccaaggcttaccctccttggttctaatttaattttgtgaccttttctctcgacatcctgaccccgtacatccctgcgccttggcacactgcaccaaagcaccatagaattactgagctataagcctctcatggaaatctgtttttgactttgttagaaaacactataatcaaatccctgagagtcaggagggatgggcttggcctgccagaggaaacatatcaccggattaagtgatttagcagaggtggtcccggcgggaggagggcagggcaggctgggcagggctgggcgtgaggtgggcaggcagggtgccctcgggggcaaggggggaggggatgcgcagaggcagaggatgggcaatgtgggattaccagaaagtgcggtctggacatcccagggcctgcaggcttcctgagtgcctacctggccctgggcactcacagggcattgatgccgagatgctcagctgtgcagagggtgtgcaggtctggtggtcacttatgcgctccagggcctgcttctgctgatgccagggcaagacccagcctcaaacacacatcaaatacatacgcttgacgttatgcccgggagggctgtgcacacaggcacacagagacggtgagacttggggatacttgggtccagttactgtcaccttgggtctcacttctgggagcgtggatttggctggcaccactgcactgcggtgtgtctgcgtctatacagacttcctccatttcacgcatgtacctaaaacataccaccattcatgtactgtcaggcactctttcattttgtaaaacaatagggttatcaaggcctgcgcagtggctcatgcttctaatcccagcactttgggaggccgaggcaggcggattgcctgaggtcaggagttcgagaccaggctggccaacatggtgaaaccccatttctactaaaaatacaaaaattagccgggcatggtggtgggcgcctgtaattgcagctactcaggaggctgaggcaggagaatggcttgaacccgggaggcggaggttgcagtgagccgagatcgtgccactgcactccagcctgggcaacagagcgaaactcagtctcaaaaaaaaaaagccgggggggctaccaaaagatgagagggacccaggcctgtattgcacatccacatcagtgacagtgtaatggtacgcagaccccctccccacatgcacacgcattctgaaataagccaggcccagaaggacaaatacggcactcgtccactcacatgaggatctgtaatcaaacgcatgaaagcagatgacaccatagaggctgccagagctgggggagcgggaaatggggagttgctgttcaatgggtgtaaagttttagtgatgctggacgagtaagtactagaggtctgctgtacaacgttgtgcctgtagctgaccatgtggcactgtgcacttcgaaattctctgagaggtctgagctcacgttaagtgttctttccacaaaagcaaacaacaacagcaacagaaatgaagggacagaaggaaaccgtgggagaagacgagtgtctaccgcctcgatgtgctgatggcgtcccggtgtctgcacaaatccacacttgctgaactgtaaggggccggtgacctctacagtcgcctaccatggcgagcataaacttgcagagaagaggatgagaattctgataataggacaaatcaaagcttaacaagtaattaaaggacaaattggtgcatataacaagtcgttccctgtctcgcagctgacatggatcaatgtccaaaatttttatccaaattgttataaatacacatgagagtcttctcggtgcagtgaatagtgaagtcagcagaggcagtggctcacccctgcagtctcagcactttaggaggccgagggggtaggatcacttgagtaccagagttagaggctgcagtgagccatgattgtgccactgcactccagctggggccacagagcgagaccctgtctctaggaaaaaaaaaaagaaaaaagaaaaagaaaaaaaaaaagaggaaattagccaatatcccagagagtgaaggcagaacccgtatcagcttttgccaaaaatgagaactccacagttgcctccgcattctgtcttttaaaaagtgtcaattttacattatgaaatagagtgcatctttttaaagtaaaatcgatgctccaggaagatattccacgtttatcctggactttggtgccctctcgacacttggttttgattaaattaatccaaactccagtttgctaagccagtgcacctgtgtgcggctgttacattgcaccaatgttttatcaaatctccgactatgcccaagtgcggcgccatggaagccacacgggatccctgacagacagaaacatccatactgctcttaaggtggctcaggcactgttccaagcacctcgtctatagttgcccactgattcttcgcagcagctgtgtgagttagctgtgatgcttatcttcattctgcagatggggaaactgagaaaggctatcccaatttcacactgctcggaagtgtcagaaccaggatatgaaccctggcatggctaccaagagtctgtgctcttgaacgctgtgctaggccactccttctggggctgttacattttaactctgacatgtcaagcaaatcactataagtttattgagtcatttcttagctgcttcatctgtaaagtcgggtgacaatggctgcaggtcctgccactcagacgattcccacgcgtgtctgcatcaggatgaggatgagtagatcggtaaagtgccttgtagactgtgatgatcatatttttgtctttgattccactgccagcacaatacctttttttttttaataaagggctgttgaactgcaattcccatgtttgtatacattcttcttctgtttctttggttaaagtttcaagattctcttagggttcaaatgtttaaatttcaaatcctttggctcatctgactaattacaagcataaaatatggcatttccaacaagtctggagaatggaagcacatgaaattatgcacgaccatgagcatctgtgtcgggaggcgggaaggcgttcacccttcaaactcaagtgaaaaaggtttgccgtagttaaaggctgctgacaaataactactgttctgagaaatcaccactgtttactgggagaatcgtttttcagcaaatatatcaagaaaagtaaatatcaagtataatttgcagagttgcagataactccacattttggaataaaaaacttctgtgtctgtgtacaagtgtgcaaaacacagcagagacatttttctttccaatcctgcctaaatactgactgaacatcatcagtgccatctcccatgactgtgacagtgtatcttgtgtgtatgtgttgtatcatattatctgctttgttaaatgctatgcttgttaaaatgtgtcacattaaaaaacaaaaacagcccgggcatggtggctcacgcctgtaatcccagcactttgaaaggctgagggtgggggagggtggatcacgaggtcaggagttcaagaccagcctggccaacatggcaaaaccctgtctcctctaaaaaatacaaaaattagccaggcgtgttggcaggcacctgtaatcccagctactcgggaggctggaggcaggagaatcgcttgaacccggagggagaggttgcggtgagaggagattgtaccattgcactccagcctgagtgatagagtgagactccgtttcaaaacaaaacaaaatgaacaaacaaacaaaacaaacaaaaacaaaaaaacagaaacacacactacactgactacactgaagccctcaagccgctgagcagccatctccaggtccccaaggaccaggcaccaaggtctgggggtggcccagcatccattctcccctttctcagagcagcagcccagtgttatttcctggaattcctggaaccctgcatgcacacagccctccccaagccaaacatcctctccctcacagagtgtgggatttgagccgcaggagccagaagaggaaaaggtagtggtgtcactaaacacctggtcacaatggttaagaccctcctgtgtccaggaccccgactgccaggcccttccacagcccgactccccgtggactctgcaggtttcctaatgtcctcccagtaactcttcctggctcagggcagctggacttcatgcaagctctctgccagaagagaccctctcctgccacaggcgccctccccatcagatgccagagatatcaccagccctcgaggcttaacccctgctctgtgggggattcctgctgctctgcctgaattcacccaggtgggcagtcctcaggtgacttctccagctctgcatggagaaggcctcaccatgcatctcagagagaagtggaggctgcacccccacaggaagtggggcccagtccaccgtgccctggacgctgctcatccactaggactgggcttccgtgtgcagggcttcaccctcgctctcctctctgcctgctccacacctgctgctttgacctccatgaccatggacctgctgacaggtgccccccgacccacctccagcctgcacctccccaggctccagaccccgccccctgctgcctgcaactgcccctggggtgtcacaaggcaccttcatgccaacaagtcccaaacaaacctgtcacctttccctaccccaacccatcagccattgctgctgtgcccatctcatctccacatccaaggagtcaccgcatcctggcaccttccccatctccccgtccatgatgagctcagcccctccctctacctggatgcagcagcctcctcccagacctggccccatccgctgctgctccctgcccttcactccctgtagctcgagtcctcacctgagcttgcccccattaaaatcctctgtacctccctcttcccaagcctagcagacccgtgcgggagtgcgagcacactggctagggcctcctgatgggcctgacctgcctgccaaccctcccagggacctgctcatgttcccgcaacgcccttacagccatgggtccgagaaaacactgctcactctgcccagaatgcctgccctgccctttctggcagactcctattcagtcttcaaaacccagctcccagctcgttaggcccgcaaagagagcaagttactctctctcctagactcaagcaccctgtgcttccttcttttaaaccactgatcatgcagaagtataagctcaccagtttccaagtcccctaaccagaccatgagctccaggggtaaaatcatgcatcagattcatctctgggtcacctgccttggctgagaggaggctcatgaaggtttggcacaatgggatgaaggaatagacaaggagcaagaatacgagctcatcctcatgcctcagaatagcatgaaatgctcagggtgtgtgggacagaactgacgccttcacaccaatggagccagatgccagcctatgtgtgtccaagtcctaccaagtcccaggctgcatggaaatcagagggaccccaaatcgaatgagcgaggggcccttaaagaaactcacctggcccctttgtctcaggtcctaggggttggtgctgccaggaactctcataggagagggccttgttcccacctagtcccaagcatctgagcagggccaacgaaagtgctggtaggccaggccttgccctggagaggaagggcagagaggaaggagaggggaagcggggtggaccacctctgctcagaccaaaggcagaatccagtgctgatggttgccaatagggtcctctctgttgctgggcccccatgaaccatgtgagccctgcacagagctcctgctagatcctgggggtctccctgcactgggattgctccaacagtgcccccaccctcagggcatgggttgccctctgcatctggccaagtgccttcccagacaccctgcagcctcagcctcctgtgaccactcatgtccacctagcctggtcctggtcccaggtgccctcctggtctagctgccactaaacagatgagaagctccctcccatcccagccctgaaatatgctcagcctcaaagcctcttggcacatctcagcttccagatgtcctgtgccttgtgagatattaaccacactctgcctagccctctgccatgaggtcagctccgctcccaggcagggggaagagctgccttgggagcaatgatgggcatcgtccctctgtgctgtgtttggggtcttccctccctccaagtcttggactttgggcccagaaatcactttccctccctcctctctgagcacacaaagggcaggacttgtcttcaggtgcttggggaagagggacgccaattgttccagccactcccgtaagggtgaaccaggagactaaccatcaaattcaccaggaaatcccaacctccaggccctgactgaggcactaagacccaagcaagcaatatcaatgaaagccagaggtgcttaaggtggggaacaagaatgagctgtcagaggcctctgataaagaatcgtttaaaaagactttctttgctgcggctcatgcctgtaatcccagccctttggaagtctgaggcggtaggatcacttgaggtcaagaattcaagagcagcctgggcaatatggtaaaaccctgtctccatacacataaaaaaaattagccaaacgtaatggggtgcacctgcagtcccagctactcgggaggctgaggtgggaggactgactgaccctgagaggttgaggctgcagtaagccgagtccatgctgctgcacttcagcctgggtgacaaagcaagacctggtttcagaaaaaagaatttcccccttcgatgtatgctatggactgaatatttgtacccccaaaattcatatgttgaaacctaatccccagagggatgattttaggaggtggggcctttggggggtaattaggtcatgagggtggggcctcatgaatgggattagtgcccttatcaaagaagccccatggccaggtgcagtggcttacaccagtaatctcagcactttggggggttgagacgggaggatagcttgagcacagaagtacaagaccagcttggttaacacagcaagccctcatcactacaaaaactaaaaataaaaaaaaatatgttgcatgtggtggctcacatctctagccccagctacgtgagaggctgaggcaggaggatcgcttgatcccaggagttcaaggacacagtgagctaggatcgtgccactgcactccagcctaggtgatgagtgagactctgtctctaaacatttttttaaattaaaaatgtagaaataacataaaagaggccccagagagctctcttgccccttgcaatgcatgaagacaaagtgcaagaaggtgccatgtgtgaaccagaaggtaggccctcagcagacacaaaatctgccagcactttgatcttggacttcccagcctccagaaccatgagaaagaaataaacactatgtaagccacctggtgttgggggtgctttttgtggtagcagcctctactgactaagacagtgtcacttcagctactctcaagaaaggcttcgtcacctggatccagtcgcgtcagttaagcggtgctgcccagctctgggaggctgggggagatgaggcgatgtgtgattctcaaggtcagcatgttggaaagtctagcagggtttaatgaggacggaattaaaggagacggggcctgatgaggggctctgggcctctctgtgtccctgtctgctttgtctggaaaatggtgaaaggaaggaggcatcttggagcatctgtgtcctctggttttccttgatccctggattcaccaggacacaaaaacccagtgcttcttgtactgcaaggtgcttgagaaaggaagagcaaacccacaagctgaagagtcccaggcagccatcgctcccgacacgcacgccgcagtgtagctgtggctcctgagaacggcggtgttaaaggacagttacttaaccagaacttggggtccccctgccccgccccacggaggccttgaacatcctacaataaacacacaccgaagccatgttcttggagagactttggggaggctgtgcactctggaaacagccaagctgttctgtggcttggaagaaacaagcagttccatccactctgggctcacagatattcctcctgagcttgaaggaagccacagcggaacttggagctgctctagttctctggaacatgcagcaggtggaaccgcagacgtctctccagggagctgagtcccggttttcacctgctgggtgtccacggattcacccccagctactgtgtaggggccagctcccctcagggactgctcctgggagaccgtgggagtcaccgcagctccctgctctgtggagcggccacgctagcagaaggaacagagggtgccagtgctctgagtatgccggagggcagtgagtgctgcgggaaggggctggagggcacagggtctgcgagtgccagggcaggtggtgcggggggagctgtctacaaagccttagagcgccagggtaggtcccactggaagggaacatgcaagcaaagactcgaatgaggtgggagggtgagctgagggtgtctagaaagggcatccaggcggaaggaggaccccatgtggggttttgaaaagaagggcaaggaggcccaggatggcaggaatcaagtgagtgagaaggaaaatggaggccacggggtcccagggcgaggcgctgggtcgtgtggggtctggtaggtggcccgggtgctgggtgctgacttctgagctgaacgaagcaggagccactgtgggatttccagcagaagacagacatgatccagcagaaggcatcaaaggatccctgaccacggaccgccccaggacccttccaccatagtgcaggattcctcttacaggaaatgccccagtaggcagatctagagaggcaggaagtggatgaatggttgcctggaaggtggtgggggaggaaggacgacagctaaggggtgtggggtctttggggagggagaagatgttgtgaatataataaaaaccattgaatcgtacactttaaatgggtgacctgtatagtatgtgaattatatctcaataaagctgttagagaaaagaatccctgctgctgtgttgaggacacatgggggtggggaggcagggaggtctgctgggggctcccaaagtcatcagaagaggacaaaggcttgacgcaagtgacaaccgtggagatggtgagaagtgatcagggtcggggtggattttgaaagaaaacctaaaaagatttctcaacaggtttctcatcagtgtgagaggaagagaggggtcaaccctaactgcagagctttggctgtgcaaatggaaggaaggatcagccgtgcacagagctggggaaggccgagggtggagtgcggagagggtgagcgcgagttcagtgaggggcgtgctgaggtggtacttccaaattgaggttggcaagtagagaaatgccttggaacttggatttgaagagtgcagagacagatgaggtgcagattctgctggagtcaggagcgtgggcaatacagagagcatggaaggtggaggggcagttggaatatgagtcttgggtgcaggagagagatctgggctggagacgcaaatctgggagccatttcatggtacataaagcaacaagaggaatgagatcgcccacagaggggtgcagagggagaccaaggagcgtccaggacagagccctgggcgcatcaaccccagagggtgcgggaagaggaaggatcagcaaaggaaacggggatgaactgtgagtgctgtgattagaccaagaaagtgggtgtccggtaagccacaccaagggagcaggagggactagcctgccacgtgctagggatggcgactgaggattggcagggagatgcagcagcatgatgacctcggggagggtgcctctggcagagtggcacacacagaggcctggtccaagtggggttaagacacagtgagaggagaggaatcgaagatggcgtctccacctagggggtgctgctgagagagcaaaaagctgggagagtaggtgacagacgagggaagccgtcaggtgtgaatgcggatagggagcagatgttggaggtgttcagaggacggaagatatgaaaagtcatctggaaggaggcaaacagactgaggggagcagtctggctgctagcggcaccttgctggtgaacatcatcgtaagcaagagcagaagcagggctgagctttgttcaggggtacccgtgccagcatgaagtaggtagaaagtttcattttaccaggactagggcattgttcagtagatgttacaaagcaagagtgactccaatgagggaacctgcagtttaagagaaggaggctgggtaaggggtggagggaaggatcagtggtgtgagagaccgtgacaaggcggcagcatcaatggcctgcaggtttgctggagcacaggtcggagcaaaagggaaccgggaaaatagaaggtcatcagaatgcaacactgcaacggattatgcaggtataggggccgctggcaaaagaaggtttaaggtatgaccaaggccaaatccagtggggagtcctttttggaaaccttgacagctgtggtcatggtcgacctcatgggaaattttgcaaacttgatcctgtgtcaaatgagttcccgtgacgcgtgtcagtgcgtgtggatcttgctgtttgggggagggcagaaactctgcagaccccatgccttgccaccctcgaccctgatacgcgatgccaatagacacactgctgcggaaaccataaacgtcaccagattcagagcttgagcccacctctcccagaggttttgtccggtaaagggaagaggaacagggttcaactctcctggcagaactctatggatgccgcagaagacaacgttaatgagcttggcttaacttacaagggatttccggtcttgtgaaagaggaggaaactcaaatctcaggagagtttaatggcaggagtgagcttgagtgttggtttccctaatagatgggtttagctgcatgggtgaggtagaccaaggccctctgtagaatatgctggagaacaatgattcaagactacaaagaaactgaagtgtgagcggaagataggagtgaaccttcgagaaccggaggccatgccactgccttgtttcgggtggaggaacaaagccttgtcactgtgttgccagggacagagtgcaaggtgcctggaagctcctcgggaacgttagctgtgtccctcatcgcaggcaatgggaccctgcaccagtggccagtacctgctgccccagccagcctctgtgaggcacacactgccagagatgacctcacgctggtggaaaacgaggagacagcagatcaacccagccgggcttccacgtccagcaaaacgaggcgagttcgggttgttattctgctctttcatgagtcagggctttgggcctcactgccttccaaacagagtcaaaatcaatttgacgttcaaaacgacatgaaaattgccatgtcaaaggccattctgtaatttcagtgtattaaaatcaaaagagcacagccttcttgaagaagtttcctttgggcagaattcaagtttcctctttcttttacttgtgcaatttgaatttatttcactttttcaggaagtgaccatttttgcaggaaaagtgtagtcaaaagagataatgcacatgaagtttctttttaagttctgagtatgtcgaagagatttacagtgcattaaaataaactataggcaaaatagtgtgtgtacctatctctacgcattttttaaaaggggcaagtgggggaccatcttgttgatttttcacaccagtagcccctttccgccagcgggaagggccttgccccacccaatgtgtctctggtggatgggtaattcatgcccatgctactccccagtggctgtggtgggggggcacatagcccacacctggtactcaatgccctcagcacagtgattggtccagggggtgaacacatgactggagtgagactaatcatgggtcttccatgagatctgaacattgggagaaaaaaatattcccttcctggctcagtaagctcacagcgtaggcctggggctgcgtatgtgaagagccaatctgagaaggaagtctctgcagaagagagccaagtcctaggaggaggagagacgctgagccttggcagcctcgtgtgggccagcggtgcctgctgtcttgctcgcgtgtgccagcaaatctccttttcttggcttaattggatttggatctctaattataccttgaatgaccctgacatatccagtgtcttctaccttccttattgctgtggccctttaaaaaaagattaggaatcatctgccatgagaattccacttctggaatggtggtgagaggagccccatggacacattcccctcagaacaaccataactggtgaaaagtattgaaaagtcaccatcaacaacaatttaaagtctctagaaattatcctaagagcacacaacaaactaagcaacatcatctattcaagaaaatcaaccaaatcttgggaagaaaaatcccagtaagaacagcaagaatcggtggcacctgagccatcacttgctctctcttccccgcttctagtccttccagttcagcttatggggagttccactctgggggtgtgtggccaagaacacagggctccctcttccctcagatcccagtcaaggaatacagtatttcaccaggatagatgggccaccagcgtttctcatcatctccaactcccagtgacagagggtaactccctgctgagtgtgaccgaaaggccggagcaccttcctccacccagccctaactcagggcaggagctccgtctcaggtgcagcagggcgagagtgctgggctcctaatcaccctaagtccagcctgcttgctagaaaaatattccatgctagggggaggcaaaccaagaagatcagaggctacctcctgcccaatacctggagtggtggcttcagtgaagattctggcggcaagaatttaagaggaggctgacagctctatgagaacaacaacctgaaccacagaccagcttatttactggaaaaaaaaaaaaaaaatcaggagaacagatcgttatgaggatctcttccagggggagaatgaatttcaaagactggcctcaaaatcatccctacccaaatttaattggatcaaactatgtgacaatttatgtctcaggacattgttgaaaataatagagcaatcatccctcaattagtgaagcctagtagctgggtgtgataccaaatgaagcagagagtgtaacagacagatcagagaaagggacagtcatagggagccctgctgaaatcactgtcatcccgggatgaccctgcacacgctcaaggctgtgccctccaacagctgaggcttcccactgtgaagaatacagactttgtgaaaacagtctaaccaaatcaggaaacaaataaatacacaaacaactgcaaacagcctcagagatgggggaggggaatcagtatgcagagctgccacatgacccaaaatgtccagtttcacacaacagaaacacaaatgactcattcacagaaaaaaaggcggcaacagacactgctggtaagaaagcccagatgtcagatgtaacagctgtcagattttgcagcaaagatttcaaagcagccattggaaatatgtctttgaaaaaaggaaaccatgcttatgtaaaggagtgatgatgacaatatctcatcaaataaagactatcaataaagagaaattataaacaagaaccaaatggaaattctggagttgaaaagcaccataactgagaggcttaacagtagattggaactggcagaagaaagaatcttgaaaacagatcaatagacattatgcaatttgaaggacacagggaaaaaagaatgaagaaaagtaaacggaacttaagaaaaatgtggaaaccataaagggcatgaacatatgcacaatgggagtcccagaaagaggcaagtgagtataaaggagcagaaaagatggaagaaacagtggcaaaaagctccctaaatttggtgaaaacattaacctacgtgtccgagaaactcagcaaacttcaaacgggataaatgccaagagatccacacccagagacatcatagtaaaaatgccgaaagccaaagacaaagagaaaattctgaaagcagcaaaagaaaaatgacttgccacatatgtgggaatcccagtgggatttccagccgacttctcctaataatggaagccagaaggcagcagaatggcatatccaatgtaaaaaagctgtcaaccaagaatctttctccagcagaactatttttcaaaattaaggtgcaatatagacagtcccagataagtaaaaacagagaattatgagtagacccattttatcagacatactaaaggaagttcttcaagctgaaagcaagtgacctcagttggtaacttgaattcacacccacacacatacagtaccagtaaaggtaatcacgcaactttaaaagacaatataaatgggtatttcttctcttttcttcccttaactggcttaaaaagcaataatatagaagaagatgtatataattgtattattgggcccatataatatataaatgtaatatatttgactaacagcacaaagcaggtgaacagaaacacagctactggagtaaaaaaatgacaccagatgggaacttgaatccaccgcaacaaatgaagagagccagaaatggtcaacaggaaggcaaactgttgatatatatgtactctcctctcttttttcagcttctttaagcatgaaattatataaagcaataattacaacaattgttaggtttgtagcatatatagctgtgtggtaggcagaactgtggccctccaaagatgttcacattctaatccccagaacctatctatctgtaaggttatatgtaaaggaaaattaacattgtaaatcagatgactttaaaatattgaaattatcctggattagccagatgggcccagtgtaatcacaagggtccatagagggggaagggggaagcagaagagagaaactggagggatggctgcacgggaaggacttggcctgatgttgctggcataaaagacgaaggacagaagtcatgagccaaggaatgcaggtggcctccagaaactggaaagggcaaggaaacagatcctccccggaggaggacccagaaggaacaaaaccctgccaaaaccctgatttaaactcagtgagactcatttcagactctgacttccaaaactgcaaaataataccattgcattatttaagccactaaatttgtggtaatttgttaccgcagcaatcaaaaaccaacacaagttgcacagcaagaacagtacaaagatgggggtgggccgggcgcggtggctcacgcctgtaatcccagcactttgggaggccgaggcaggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaaaaaacaaaaaaaacaaagatgggggtggaagaatagagctatataagagtaatgtttctatagctcacaggaattaagttaatataaatctaaagattctgataagatgcatacgacaagggagaggacatcaccaaagtgacagaatagaggactccaaaattctgcccctccacaaaaacaggaaataagctagtaaatctcagaatcgacttttttggaactccagaatttaaccagaaacctacaacaaccagggaatgcttaatgaagaaagcagctactgaattttggtgacagtgggttatggtgttttaatttacttgcttaccattatcttattctccaactcagcagtggccatgaagatggcagaccacattcctggtgtaggttgctgataccaacctacacatccaaggagctcaatgactcccagtttgaaaactcaaaagaaagaaatatggaccttatatccagagaattgtggttgtgggttttaacccatctgctggcttgcctttgtttcaactgtctcggagcttccccaggactgaagtggtttcccagacagtgtttgtcaaaagtatttaaaggtaaatgtattagctgcagacacctggggcacaggacaatagttggggcaagacgcacaataaacatatctaaaggcttggggaggaagagggtagggaaggagatatttgaggaaataaggtttttggaaagctcttgtgcataccagagaatctaggattctaccactgacatgtctagggtgagatgcatgctcagaaaaggtctaagaagactcaaaagttttcacctctggctgacatttagggtctgtacaagtaggaagtgaaggctaagacagagttgtaaacagtctggctaagcatcaaaggtgtgctcaaacacagaaccaatctacaaagacgaggagagtatttcttcctaccctggcttttaagaaagtctctgtcaaatcactagctgaccactaagctaacaaaacagagactttggtggccatatataatgaacaatgcagactttacaaaaatagtttagaaaaatcactaaacaaacaagcaacaacacataaaaaacaacaagccctgggaagtggggggcatctgatttccagagtctccacattcaaaatgtccagtttccaacaaaaaatacaaagtatgcaaaataacaagaaaggatggtccactcacaggaaataaaaaagaccttccctgaggaagcctagacacctcatgtgccagacaaagattttaaataaattgtcttaaatgtgttcaaagaactaaaagaaaccatgggcaaataacgtaagtaaagcaagaacataatgtatcacaaaatagagaatatcaataaagaaatagaaattataaaaaggaaccacaaacaattttggagctgaaaagcataataactgaaataaaaatttcaatagatcagttcaatagcagatttgagcaggcaaacaaagaatcagcaaacttacattatcagcaatcatccaatctgagaagtagaaggaaaaagaatgaggaaaaaggaacagaacctaagagatcaagtacaccaaaatacaaaaaatgagagttcaagaaagagaatagagaaacaaaggggcataaagaatgtttgaaaaaacaatggctccaaattccccaaatttgataaaaagaacatgattctacacatccaaggagctcaatgactccaagtttgaaaactcaaagagttacatcaagatacattgtaatcaaattgtcaaaagacaaagacaaaaagagagtcttgaaatccacgagagaggagcagcttgccacatatacaagggctctcaatgagcttaacaactgatttgtcatcagaaacaataaaggccagaaaccaacgggatgacatatttaaggtgctgaaaaaaatactgtcctgcggctaaaaattccaacaaaactatccttcaaaaatacaagaaaaattaagacactttcagagaaacaaaaactgagagagtttgttttctagttgacctgccctccaataagtgttaaagaaagtccttcaggttgaaataaaaggacagaagacagtaactcaaagccatatgatgaaatgaagaatactaataaagggaaccccaaaatcttcgtttgtaactcttctcttttttcctatatgatttagtctatagatgcataaagcaataattataaatctacattaatagacacacatgtatgaaatgtaacaatattataataaagggtggggaagacagagctgtataggagcaaagcattttgtatactattgacactaagttgatatcaattcaaacaaaattgttatgtgtttaagataatagctgtaattcccaggataaccaataagaccatagcttttaaatatacagcaaaataaatgaaaacatgaatcaaaacagtacactaaaaaacaatgtgttaaacacaaaagaaggaaatatttgaggaattgaggaataaagaatatgacatatacaaaacaaatagcagatagcagaattcagtccctccttatcagtaattatttaaatacagatggactaaatgctgcaattaaaattcagagaatgggagaatggattaaaaaatcccaagatataatccaactatatgcttatccacaggggaccaaatttagattcaaaatacacaaatagtttgaaaatgaaaagatggataaagaaatgctatgcaaatagaaaccagaagagacctgggatggccatactaatatcagacaagatagacttcaagtccaaaaattttacaacaaagaacagcattatatattgatgaaagagtcaatccaccaagaagatataacaattataaacataaacacacctaacaacagaatcccaaaatctatgaagcaaaaactgacagaattgaagatggaaatagaccattttacaataatagctgaagacttcaatattccactttcaaaaatggataaaacaaccggcacatgatcagtaagaaaatagaggacatgaacaacactgtaaatcaactagacctgacagacatacatagagcaccccactcaacagcggcagaatgtgtattcttctcatgtatgatgatcattctccaggataggtcatatgttaggtcacaaaacaagtctcaataaccttaaagagactgaaaccatacaaagcatcttctccaaccacagtggaataaaactagaaatcaatgacagaagaaaccctttaaaaattcacaaatatgtagaaatttaacaatattctcttaaagaaccattaggtcaggtaatatgttacaagataaattagaatatataataaataataaatcttgagacaaatgaaaataaaaacacaacatacccaaaacttaaaggacatacaaaagcagtgcccagaagaatatttatagcttcaaattcctacattaaaaataataaagatctcaaatcaataacctaactttacacatgaaggaaccagaagaaaagcaacagaaactcaaagctagcagaaaaaaggaaataatcaagattatagtgaaggtagacaaaatagagaattgaaaaacaataagaagactcaatgaaaccaaaagctggttctttgaaagatcaacaaaactgacaaacatttagccaaactgaccaagataaaaagagagaaggctccaattactaaaatcacaaacaaaagtggggacattactaccgaccttatagaaataaaaatgattataagagaatattatgtacaattgtatacgaacaaattaaataacctagaagaaatggacaaattcctagcaacacagaaactaccaaaattgactcaaggagaaatggaaaatttgtacagatctataacaagtaaagagcttgaatcagtcatcaaaaactcccaataaagaaaaacctaggaccagatggctttactgggaattctacctatcacttaaagaattaatatccatctttctatgaggccagcattaccctgataccgaaaccagacaaaaacatcataagaaaactacagactaatgtctcttataaatataggtgcaaaaatcctcaatgatattctagcaaaccaaattcagcagcatattaaaaggcttatatacaatcaccaagtgggatttatccgtggaatgcaagagtggttcaacacacaaaaatcaatccatataatatactacattcataaaatggaggaaaataaaccacacagtcatcttggttgatgcagagaaagcattagacagaacccaacaccctttgtgatcaaaaaatactcaagaaacaaggactagaagggaaattcctcagcatgataaagggtatttacgaaaagccaaaagtactcatcatggtcaactgtaagactggaagcctgctctcaccacctgtattcaacatagtaccggacattctagtcagagcaattcagcaagaaaaaaataaataaataaaaggcatccacattgcaaaggaagaagtaacacttcttgagggaaaatggggaatgatggctcgtgggtacagggtttcttttgggagcaatgaaaatgatctaaagttgactgtggtgatggttgcacagctgagtgaatatagtaaaaattatggaattatgcgcccgaaacgctgaactacagcatatgtgaattacagctcaataaacccaccataaaggaaagattaaacaatgatctactccttacctctgttctcagagccatttccagcccagcccaggccccaggcaaccctctgtgggtgacgcagcattacctgctttctggctgtccagtgttgtgtagcgcaaggccctgggaggccactgggttggtcatgcggtaaccaagaaggggagcaagtagttgggtgacaaaccctgtacatctgctcctaactttcgaaacctggctgatgggaggccaatgtcaccctctaacgccctcccatagcagcctcggcttgtcttctgacagtggcactgtccacccacaggcatcacgcatcctgcccgcacattgcttccgccagtggagccccagctgaaacactagacaggagagaagtccagagatcctgctcactctagggaaggagaaagacctcttcagcttgtcctgcctcggcaaaggcaaagcctcatgcatttgctcactcctccctcccagggctcagccggcacctgaagctagtgtagcagaaagagcccaattctgcatcaggcgggcctgggttcaaatcccagatcctccactttctaattgtgccatctctgagccttccatcccttacctagaaacagagttctttccacccatgcccttgtgagacagcgtaagtgaaaatgacatccacacggtactggaagcagagctgctagaaacccagccaggcagggtttgaacttgttatctccaaaaagtctcaggaatcgtatttctgcctgatggtgacctacttcagcaaggacccaatgtagaaattactctgccaccaaaaaagcaggcctcagaccccctccatcacctccccaatttatgaattaaacaacgaggccagtgcctgaggggtctgcagatgagagtcagaaaccagcagccccccaccccacagagacaggtccctgctaactagacacaagaattggccttctggggtgtctctgcgtgttctgtgtatggtgacctagccccggccctccaggagggacactacgtgcaggacattttggaaaacagtcttggtgtttcctcaaaaagtgaaacactgtgttatcatgtgagccagcaattctcctaggcatatacctaagagtaatgaacatatatgtacacacaaagacttgtccacaaatggccatcgaggagaagctggccacagagaagatggcccagagaggaggtgctgtgtgcagaagcagctctgggaggaaagacgtgcacaggccaaattcagattactgacactttttttttaatgcagagattgtctgcagaattacctatttttgacttatcttgaaaaactgaggatctggcaacactgaccccgaatcttcctaacagcaacaatgatcagaactcagaggttttgtgtctcactgatttttttttctttttcttttcttttttttttttttttgagatagggtctgactttgtcacccaggctggagtgcagtggtgcactctcagctcactgcaacctctacctcccaggctcaagcaattctcctgcctcagcctcccaagtagctggttccacaggtgcatgccaccacgtgtagctaatttttagatttttttggtagagatggggtttcaccattttgcccgggctggtctcgaacccctgagctcaggtgatccatccgcctcagactcccaaaatgctgggattataggcactttgctgcacctggccttgtctcactgatttctgatcttattttgtattatctttttccttctattttctttggatcaatgttgcctttttctaacttctcacactggaaatttatctctttaatttttagacctttttcttttctaatgtaaatttccatccacgttttgatatttagtgcttttattatcattgagttgtatttttgaagttccactattatttcttctttgacccatgaattatttaaaagtattttttttaaatttccaaataatggggatttttgctttgggggctattaatttctctctcacaggcatgatggtcagggaacaagacctgctgacactattcttttagtttctgtgagatttgcacttaattgaccagttgttacaagtgtttcctatgtgcttgagaaaaagaaataacctctacttgtcagatgcaaaattcatcaatgtcaagcttattatttgtgttatttagaacttccttatctgtgctgggttttttgtctacttgatccaacaccaattggaaaaaaatggttggattctctcaaaaatgatgataaatttgtcaatttctctatttctaacaaagttcacgtcaaatatgttgaggttattttattaagtgactctacctttagaactgctttatcatcttggggaaatgaaccttttctcattaaacggtgacctgtctttccccagcagcgtctcctgtcttgaggtctgttgagtctgagattgatacagcaatgtcggcttgcctttggcggcctgataggtctgtttccatactttactttccactttttcttgcctttacactttactctggtgatagcgtccagccagattttgaatttggggtttgtctcgtttgtcagatatgacagcctctgtctttgaatttgtgagtttaatccatttacatttacctggattattgataaatctgggcttgtttctcccatcttactctatgatctcaatttgtcttggtttttctgtccttttttctcctttataatttgtcttataaaaaaagacatcccggccgggcgcagtggctcaggcctataatcccagcactttgggaggccaaggtgggcggatcccttgaggccaggagttcgagaccagcctgaccaacagggtgacaccccatctctacaaaaaatacaaaaaaattcggggggtgtggtggcacatgcctgtaatcccagctgctagggaggctgaggcaggagaatcactggaacccgagaggcagaggctgcagtgagccgagatcgagccactgcactccagcctgggtaacaaagtgagactccatctcaaaaaaaaaaaaaggcatccctttttctctaatttgtcctgtcaccactgtgctggctgccccagccaggctgcaaccctggggacacacatgcccctccagcagtgagttcagacccttctcaccctttggcctcaggctcctcacttcctgccccctctcctgagaggtgacacgccatgtccacaccaactccaaatctgatcatcggctccagtccagtccctgcaccagctgctcatgggcctttctctctggggtggggctgggagctgtggttcctgctgctgtgtcctgcactactccacatttcccagttcagaggtgatcggagccccctctaatatatgccatcccagggcggggcagcagggcacaaggccacttcagtgtcaacacggatctcactgcaggaactaggaggggcctcccttaggaagaggcactctggactgttttaaccacagtccccacttctccctcctgtctcacagtcccgagcttcatacacacacgctgctgcctattctggaattatgcagtattattattttatattcatgtcgctgggcatatgatgctcccatgacaaggggccctggagcttttagatcaatccttagaaggactccagccagaccccaaaggccacatattatcaattgggtttctatgaagtatacagaataggcaaatccaaagacacagggagtagattagtggtcactatgagctgggaaggggaatggggagtgactgctctgggtgcagggttcccactggggtgatgaaaacattttggaactagatggtgatgatggctgcacaacactgccaaaaaccactggattacacactttcatactcatatgtattatagtccattgatttttaaaaggtcagaggaagcaactcaaatgcttgtaggaggtcagaagaggcccagatgggtgaagtcgggggggcgtgcagattaagcccacaagaatattctctaagctaccaggtcacacacacactccctctcactgtccctgaagcccatagccccctctgcctgactctcctatcaactgttgatggcgtcaaagatgcacagaaatatattttggctgaaagaaacacaacagggcacaatgaggaagggctgccaagcagcctattagcagcatttgtcatggttcatctgggagtctgccttttcccccagccagactcttcagggacagagaccagattgttcatactcagtgcccagcagggcgctggcctggggtgcttgcagacactgactggatgaatggatggatggattgggtggatgaatgagtgtgtagatgaatggatgatgaatgatggatggatggatggatgatggatgaatgaatggataaataattggatggatggatgggtagataggggatgggtagatggatgagtaagtagatgaatggagatcaatgatggatggatagatggatggatgaatgagtgggtagacgaatgaatacacgatggatgaatgaatggataaatgattggatagatgaatggatggacggatgacagatggataaatggatgaatgattggatagatggatgaatgggtagacagaaagactctgatactggaaagtgaatccttcacatccatggcaagtgaaccgggtaacaaagtcagaggcaagaccatagcagcgtcatttgtcactgttgccatttatacacatttttggggcagaatcggtcatgcttgaccacaggtcatctctagagggtgaggattgggggtcaggaactgtggggtgggctcagggctagggctgccgatgtggcctttgtgcctgtgagcagactgcatttccatcagcctcatccccatcttccctctctgcctccaccagtgagttcagatccttcctacaattcaatcttggggtcccctcactttctgtcccatctcccaagacctggctggggcctgactcagaatggggtcagcaaagccctgaggtagagccgtctcccaagattatggcctggctggggcccgcctcacctccattcaaaggacaccatgtggaaaaccaatgtgcccccaagcaggggtggcacggcacagacactgatggcacaggggccacttcttgctccttcctggtgtcttcatcctcggggatcaggggctctgcagcagcaggcagggctgggcagccctggagtgtgtgacacaattcgggcactgtgaccctactggacccctttgcacagatgctgctgggcctaggaactggctgctccccactggctgctctggtaggccctggggtctgcctacacccccaacacatgagcatgggcaggtacccaccagtctccttctctgtccccagcctctcccgcagcttggccttggtccaccgtggacagcgtctctgacacggtccttcttcccacagggagaccgggagggtcttgttctgccctcagagcagaggccccaggctccttcaggtgggagcacaggtgcctttcgcacagggcccagcagccagctcagcccacagaacagtaagccgccaggtcccaagttgtcatcttgtgacccgcccctggggacacgggtgcccaacaggaaagaggacgggggcttattataaggaaaatagtgtcaggcctgccatggagctttgggcctgaggcctcagctgaggccaaggcagcaggactcatccagagacaggacagaccctgggctcctggtgcccagctcagggaagctcctgggtgcggctcggttcactccagcatttcctacatggatgaagatgtggatgtgtctgctctgaccatgggtgtgtgcatgcctgcgtgtgtgtgagagagagagaggagagagagacggagagagtttatgtacgtgtaactaccaaccagagtccaggagtctcacactccactgcaaaccaggcaggcggggccagcatgagtgggggggccaggcacgaatcggcagggagggaggggttgtgttcgcccatccagaggaggcacagagcctcccacccagtgctgctggcaggaacacgcccagggtggccaggccttctgaaggaactgaaaattgagattttcatgtgaaacctcctgatttttaagtgtacactcaacatttctgaagccgttgtacgagtcaaataaaacattgcggggtggggcggcgaggccgcccaagagctgcagggctgaggcctggctttagtccagcaccccgatgtacatacagacgagaagactgaggtcaggccagagcaaggactccgcaggccaggcccacactggcggccccggctgcctggcccatcactggggtcaccacagcccatggggagcaccaaggacaccaagaaagggaggcccaggcctggtccccggggtctctgtcaccaagggcccacattgtgagtttcaaaggtggccgaggtggttcctacaggcctgtgagtccccacactccttcccagttcaaggcctcgggacaaatccaagcccagctttgtcctcgtggtgatgaaggccaagaatgctgggagctcccgggatattgcctagaacaaaggagcacaggcacctgacgttctggacacaagggcagaaccctcttgagaccatcatcggccgtttgctctccaggctgcgggggcctggaggacatccaggcacgggtataggtgccgggagcccggggaacagaacctcagacccggaactgggcaccagatgcaccagccgggggtctgtccgcccagcccggggagtccaggggctgctccgaacccggcgccacgcctgctccctcagtgccgcatccaacagctctgtctgcctgggctggggccctgcgccctccccgctgctggctcccgctgatgcgctacagatgggcttcatcgctgcctccaagaacaacaggacgaccgcaggtttcgcctcacagaaacggaaccgctggaaaggcctctcttgacattcccgaaaggaaaataaaaattcctctgaagtacatttcaactccgaggcagccctggccacatccaagaagctcggtcctgagcgccgtgggctccagtgaaggtccccagcactgaggccgcctcctgacccccatcccggccactgccccgggctgctcaacccttacacggctttcacaaattttgaattagctgccaacagtttaaaatgaagagattgtaagtaaaatcaatttccagcttctcttataaaattggaggccctcctgctgctggccgaccccgtgtctacctgggcccagtgatctctgctggcgtcacctgccaggcccccatcagtgtgcccatacgagaccactgtcctcagcgaacgcctgacccccaggctccaggcaaggttgagaggacagatgctctcatcctgggggctctggccttcctggggccagtgttatccagctctgccctccagagccctctgcacacgctggggctgggactgcccatggctgtgggctctgatttgggtgggcagacctgagcaggccatcatgcttcttattcccagcctgacccccccagaccgccccccgccaacccagacaatgtgtactgaactcctcgtcaacttgacccctgagctcctccccgcagcccaccaggtgctcctgctgtggtttgggcagcacctagtcctttttgccctgctggacgtcgcctggccagacttgcagagccatctcagccctttgttctcctgactccatccctccaagcctggccaccccagcctcggccccagctcctgccacgtgaattgtcaaaggcagagcatgaggaggctgaaggcagcccccatggcacaccccacggagtccctgcagtcgtccaaaaaaggctcaagcctgggcagcattgctcgcagctaggaatctgcagctggactcaaatatgtgtccagaatgatctgggaaaggtccttgagaaaagggccagacacagggaccttcccaggcccggatcccacagaggaaatgattctagcgagcgccacctcgacaggtctgaggtccagacaggggtggagctgtcacaggcagccgggtggggctgtgatctgggtcctcccagcctcacggtgatttggaatgggaatacggttctgccaggcaaggagtatccccctctgaccaacctgtggactgcctaccaggactcccaacacccttcctgcacgatggcgctgaggggctgatccggccgctgctctcattcccatggccacctgatccaggccgcagtctctccctgcacacaggacagcagcctcctgccggctccctgcctcttccgtgctcaccctcctcggaaaccagaccatgccacctgctgcatggcacagcccctcctccacgacggagcccacagaagccatcgtgatctgacctccagtcccctcaggccctcaccctgcccctcctgccacacccccaaacaagccccgtcctcacccctcaggtacttcgcatctgctgccctggccccttttcctcctggggaactgcaacccacactccaggcctcagcccaacgtccagtgactgcgggctcactctgtggcacttcccaagtctttcattgtgcaggtatttgtggactgactagtgcactgtgggctgtatgaggtcagggctgtgcctgtctggtcccagagcctggcccagtgcccggtcctgctgtgcgtgccgggtaaagatctgttggatgaatcaagggagagaggaaggggagcagccctgggattccacaggtgctttatgtccagagacaaccgcgcagggaacagtggccaaggcacgctgggagcagtgctccagcccgacggcatccccagggcagaggctgggattcacgcattgctgccctcaggcaccaaacaggcctgtggcagtcacaggggcacattcctgataccgggtctgtcgttccagcatggacagggccatcttcctcgccatctgcagtctggcatcagacattcccaaataaaggacagacagttaactgtcagaaagtgctggtgcttgggcctggaaggaagggagcccgtgtctactgggcacccccaattttggccactgtgcagtgccctgtgtcctcaacctcggggcctggaccacagctccatgagaccacagggaggaagcagagtcacagaagaaagagtgatgaacagcactggccacttgatttgcagggcacagtgcaaaatggaaacgcacagtcccttgttcaaaaagtgattacgacttctaaggcaggaatgacagagtgttaaagtgggcatagggccctgccggatgggtcacaagccggcgaagtcagtcctgctcaagtgtgaggaagtgggactagcaaaggcccagggccacccaatgtcccatgggcccatgggaccagtagccacccacagctgccaacctgagtctgcagccctgacactgtggcaacaacaggaggcgtcagtgccaagccctccaatgcctgcagggagcaactgttgctcccggagtgagctcctgggcgaccgggcttcctaggcactatgcttattctttcttttcacggatatttacgcaccaaccgtgtgccaggcattcctcaaaatgctgcaaattccactgtaagcaaaagattctccccgaagctaacgtgctaagtgacctggagacacatcctcactcaccctcgctgggccccagtttctgcagccgttaagtggagttccaggccttggtgcttggaaggccctctgtccaacaaacagatggggtcacaggctaccgggttttgccagcccaggctctgagcggggacaggagggcactgcactgggtgtcagcagccctgggttctaagcctgctcctccctcctgatgcaggagtcaaaaggcctggctcccactgtttctacagcttactatctgtgcgaccgtcggcacctcagtttcctcatctgtaacgtgggcacagcaaaagcaccaacccaccgtggggctcattacaagaatcctaggagatgatgtacctgcagcgtgctggcagacgcggtcaacggtaagtgctccaggaacgcgtcacgttcttcttgctccctgctgttcccgctactgcttggacagtggtagccctgcaccttagttttctctctgcttccaggactaccgtgcctattaaatgacaccatgaagagtgcccaccttcgcgcaggccctcggtgaatgggcatgtccttgaacgcaaacttggctccaacggggcaggagaaggatcattcagactcagctacagaaaaacagacttttgtgcaactaacgctaacaaaactggaaaggaaagaggaactacggcctggggaaaagcttgtatcgaacatgacagaaagtcaatatctaaaaagagataaagggcttatcccaatatataagaccccaggagataaacaggcaaaggacttaggaataggagacatgcagagtaatcaaacccagggaagatcactcatcctcgccagtaaccaaagaagcgcaaattagcgcaaaaagcaacgccgctttgctgccggagcagcaaaatattaaacactaaagcccccgtgctggtgaggatttggagaaaccaggagctgctgtgggagccagtctggctctgccccgagtggtgagtctgttaagcgctgggatttcctaattcatttagtcactcagtaggtgccccctgatggctgctcagggccagggctcgagcgcgtctgggctggctcaggccgccatctgccgggtcagcaacagatacctatttgcaggaacagaacctgaggtcagctcccaggatgtccccacccctgagtttcaagagagtttgcaccaggagcagggagcattccagctgtctcgggcagcttttgtgtggggaacagctggtagcgctgcctgcggccccttggggtggacaggaaggctctgcctgcaaaggcctagaggcagccacacaccctgccctgcacactcctaagtacgtgcaggccacagttcctgcatccattcatcccggccagtctggggtccctccccacagtggcaggcaaggggaagctggaccggtcctgctagacaaacaaggatgcacacacgtccatgggaccccaaacctcacactgtccctgacagcccgccccacagagcacagcctctgcctcccggagcaagaggaggtggcagtgcatcccagggcctggctgcctgtggggctgcattgggggctcctgcccccgccccgtgagtctgggaacacatgggtcttggccttggcaccttctttcctgggaaaacacctccctctgggccagggcagtgcagagcagtggaagcgggcagctgtggagtcagagtgatgggtgccaattctgactcctgcacgtggcccagaccacctaacctgccacccccaccagcacacctgcccggccacccccaccagcacacctgcccggccagcctcaggccaccagccagcctcccagccacgtgacctctcaggggcaggatgtgtccttgattccttccttcacaccacgtcccggaagctccacctcaaactcatcctgaacccactgcctccaccgccatctgtcaccgggactcctccctgcttccacaccgtccaccgaaaaccctccaaaggcctccaccgcacagggaatgaattctcaccccgtaccgtgaccgtcccttcaaagcgatgagtgccacccatccctcccggccctgcacgcctcccactcccccattacgtcctcagttccaggtactagctcttccttctgccccttggtcacgctgcggtaactccagcctcagggctcctgcatgtgctgttccctctgcctggaacacccttcccagggctgggctttcccatcatcaccaacctggggcgcctccctcccttacctgccttctcacgctgccctttcaccccgttttactttgttcacaggattctccactgtctgcgagcatctgctcaccaggtctcccctgcggggctgtgagcccagagaacagggactcgatcgggttcctccgctgctacagccccagcacccagtcctgtcagacacatggtggacacatagcaagaacgtgacgagtgaatgcaggaaaatacacttgtggcagcaggcaaggtgccctctctgagcctcagtctccccctaagcagtagagctgctaatgctattattcccccatgatttggggagcagtattattcccccatgatttggggagcagtattattcccccatgatttggggagcagcattattcccccatgatttggggagcagcattattcccccatgatttggggagcagcattattcccccatgatttggggagcagcattattcccccatgatttggggagcagcattattcccccatgatttggggagcagcattattcccccatgatttggggagcagcattattcccccatgatttggggagcagcattattcccccatgatttggggagcagcattattcccccatgatttggggagcagtattattcccccatgatttggggagcagcattattcccccatgatttggggagcagcattattcccccatgatttggggagcagcattattattgagcattaatgaacccgcatggcattcaggtgcccggccttttcccaaccagaccagcgcaccagccacctctccacacaggcccagtgcccaggtcacctcctgtcctgtcctgcaggctctctctgggtgtgccgacagtttgggatgggaggcgtgggaggcgtgagctgcgctcctggccgggttctctaccagctgtgctcgtggcgcagcccacacctcacggcaagccccagccaaagggaccaagtcaagagctctgagagacatcccagccgaagaatccagcccttgtcccaaacgtgtgtgtgcacaggcacacgaaagaaggtgagacagaaggagagaaaaatgaagccagagagcaggagagagagaagacagacgccagcacgcccatctgactgcgcgacctttccccgctcagagctccttcagggcccagagcacagcgctgcctaggattaatttcaaagagaaacgggtcaaagaaaattggaaatttttatagaaaatatttcaggcttggagctggctgaagtgtctgccaacctgcagagaattctgagaggagatggggcctgtggtcagaggcctccggctggcacaaactggcagagtttggacctcggacccaaatgcagtttctgagccaggcctgtcctcgctgctgctggggaagagcttcctgtccccttcagatgtccctacagctgcctctgcagccctgatgctggtacccaacgcctctcacctgtcgccccacccctctctatccccaagaggcctctgtctagggacccactatgggatgcagtccctttgtccccattatgcagggtgcccatgtctctttcaccgtcatccatggggcagccagggcatgaaggaagcctcacctgggtcccaagcaggtcccactgctccttgcccaaacttcaccccagccagcaggctcctacatccaaggcacagatgtcacagacatgaaaagatgccctggacacatgcctctctcccagaagcctgcctctgccatgctggggacctgaaaagagggggcatgcccagcccacagttgctgatcaaacgccagatgcccccgtgagcagatcacagcttcacccctgagccgtgtactgtctgcatgccagggactgttaccttgtgcaaaacccgaaaagctctttggaggacattcccaacacagatccaagggaaggaaagaaagtatcaattcactgtgtctgtggaagatggcgaggcagaggagggaaaggggacggagagcaagtgtcgcagtgagcactgggcaggcgccctgtgccctgcgtaattccagcagcccctgtgccactgcacccaggtacagtggagatctcagcacccaggttctgagatcctgaggggctgggtgagctgctctgggccccttagtgagccagaacaacagcatgtcgggtggagctgagcacactgacccctgcaccaacagcagcatgctgggcggagctgagcgcgctgacccctgcaccagcgctgacccctgcaccaacagcagcatgccgggcggggctgagcacactgacccctgcaccaacagcagcatgccgggtggggctgagcacactgaaccctgcaccaaactgcccgctgcccaccccactcacccacctagtgctggaagcatctgtgggagcagccctaatgcagctcctcagaaccactggccggtcttccagaactgtcccctgcactcgagttggggctgcagccaagccagggccaaggccaccatcctccgggtcaggcttgtcacctgcccacggtgctccaccaaagatccaggcccttgccagccacatttacctggtcggctccacccctgaaccagaaaccatgtcgggaggggagaggtggcgggggaagggcaagcctgagactcagggactaaatttatgtcggaggcacaggggagttgctgcgcacgtgggggctgtcaggcggagtgccaggcccagacgccgtggagggggagcacaccctggcacgtctccactgtggaataaggggggcccagccctcgctggggctgcaagcctcgcttctgccttcacagcccagggggtgggaagcacccacagggcagcgctctgagcagcagactccagccagagagccagccaggcccgggagctggcccctcctgctctccccggctgaccccaggcaactccagcctcggagaatgtgcagcctcggctttcccagcgccggcccccgcccaccccttccgcgtgggccacatcaccgcgctggcatctccaacagccatcccaagggcccggtctgcacgaggacaggagcgccgcggcgtctgccaagggtgcgctcagccctgaagcacgcctcccggagccgcctcgggtttcacaatcagtgcttctccctgggtttcccggggcctgggctgcaggctcagctccagggtggaaagagaggatgagctgagaagactccagggatccagcgccgaggcgctgaactcagtgagtcggcaacagtggcttggcagggcccaggctgaccagggtatgagagagagcacctatcaccacgccagaggccctggcctcaggggtctggggagtcacttgggaagtgcccggttggagacacagagacaggtctgggcacaagacgctggccaggtccagggctcaccctgcaaatccagccaaagccctctctccattctcccttaggacccaaggttcaacacttagacatgtcagctgaatcatgacccccggacgtccatgtcctaatcccccaaaactcgtgagcattaccttatatggcagaagagactttgcaaatgtgtttaaatcaggggtcttgagatggggaaagtaacctggatggtcccagcgggccctaaatgttatcacaagtgtccttctaagagggagagctggctatagaagaggagaagccacgtgaccagggaggcagagactgcagcaatgttgccacaagccaaggaacgccaacagcccccaggagctgggaggggccaggaatggattctgccctggggcctcccgaaggaaccagccctgccagcaccttgatcttagcccctaaaatcctatttcagagttctgagctcccgaactgtgaggaatgcaggtgtgctgttttaagccattaaggtgtgggtaacctggtacagcagccacaggaagctgagatggacgtcgacagctacagggcagaaaggctctctgacctggcattcagcaaattggcaccccccaacaaagcacacggccctcctgccccatcctgggccccccagcccccacctgggccaagcctcacatccgctgtgtcagtggggctggctatctgctcgccactgaatggatgagtctcgcctgctccccagtcctgtggtctgacagaacagagctcctctctctctcctgtgccattgctccagcctcccccaccagcctccctcacactgcaaccagtacgagcttgctgaaacactcaactctttgtgagactggagggcgccatccccaccttgggtcattcaaggctgctgcttccatggaggctgccccacagctctctgcctccagccctgggctctgcacacccagggggaactgtcatgcctgaggtccgcccccacccccgccgcccactcttcccccaggatcccctgcggcctggaaaactcctacccaactcaaggcaaagtcacagggtggagactgtgggtcaggaggggctcttcctggcctggtggggaagggctggctgtgggctgcaggtggcagccacgctcagccacatggaggagctgcccagtgccggcgcttgtcctctgtctcctggagggccttccttggtgcagcgaggctgagaggctcccgtggtggcgtgcctcgtctgcccgtcagggaggatgctgcagcctgacagcagcaggcagaggcttggcaccggcggtgtctggggtggaggcagccaaggtcactggcacgttgctgtctgacttctcttccttcagcccagcagggtgtgtgcacagcagcctggtagcagttccccaggatgggaagcacctgcccctcctctgtcccaaggccaggccggggcgagccccaggagagcagcccacagaggagggcagaagatgcttctacctctgcatcacagaaagcatgggtagccaatgggggaccgtgttttgtttggtctatatagtgagcacgggaggggaccccaggcatgacagctcccactgggtgtgcagggcccagggctggaggcagagagctgatgtggaggcttctgtggaaagagggctttgtctggatttgctggctgagccctggacctggccagcgtccttgtgccaggacctgtctctgtgtctccaaccaggcacttcctgagtgactccccagacccctgaggcctggtcctttcgcatggtgataggggctgtctctcgtacccgggtcggcctgggccctgccaagccagctgttgccgactcactgagctcagcgccgtggctggattcctggagccttctcagttcatcctctcattccagaaattttaagccacattttaacatcaggaaagttcacataaaaagtctgatgtctggattttcttgataggatgttcagctgcaccagacccaacttctaccaaattgaggtcaagggagttgaggagggtctgtccctccttgcagggcctcccagacgccctgtgcccatggcaaggccagggctggacaccacgtgtggctgcattcccactgctgtttctttttagtggagatgtattcttggtctccacgtttccatcaaaaggagagaaatgaaagccaggccaagggtgggtgcaattatctttttttcctccactgctgtccttgttggcattgcctgccaggccctgcaggctctgagtttgcagctcttgtctttctgcaaatggcactgtgtgtctgaaacagagaccacatgctcaacacgtgactcggggtctttctcactgtgtggcaaccttcacagagtcccaaggtcagtctctgggaagctaagacaggccctcagtgtcagcacagggttggcttctctgtgcacgtggtcttggagtcagccgctccaggtcccttaacgcgggcggtgggggaggactgccaggctgagactggcacttagacatgcagggaagagctcccacacgacagggtggagggtccagtgagggaggcagcaggaccagggcctgcctgggctgtgcctctgggctatatgccctggggaggcctaagtgaagcctacagtgctgctcctccgcgtgacccagacgggcgcctcccgggtgtgctgtgcactgcgtggccagccttgtacgtgagggccattcacatcctgtagctggctgcatggtgcccccaaagatgctggatcctgatccctgcaacctgagacgggtaccttctatgggaagaaagggctttgcagatgtgcttgcagtaaggctcttgagatgagaagcctgtcctggattactcgggtgagtcctaaatgtaatcaaggcatccttgcaagagggaagcacagggacacgtcagaagaggagggggcgacatgacccgggggcagagattggcatgatgcagccacaagccaagggaggctggcagcccccaggagcggggatgggccagaaacagattctcccctggagcctctggagggagcacagccctgtccacccttgatcttggctcagtgagattcatttcagacttctggcccacagagctgtgagagaggcatttgtattagtccgttttcacaatgctgataaagacatacccgagactgggcaacttacaaaagaaagaggtttattggacttacagttccacatggctggggaggcctcacaatcatggcagaagatgaaaggcacgtctcacatggcagcagccgagagagagagagcttgtgcagggcaactcccgtttttaaaaccctcagatctcgtgagacccactcaccatcatgagaacagcatgggaaagacccacccccatgattcaatcatctctcactgggtccctcccataacacatgggaattatgggagctacaagatgagattcaggtggagacacagagacaaaccatatcaatgttcctattgtttcaagctccgtgaggactccctcctcaacagtcccacacaggatgagatgcacacacaccagagaggacaatgccacagggtgccctgtccctgtaccccagcacagtgtccctggacacagagctggccttgggaagggcagagaacagggattggagatgcctgtcagaatgcctggggggacacctcaaccactgctccccaaaaggccacccagcctcagagctcggcctccggtcctggccaggttcccaggccagcagcactgagcaggacccttctgccaaggccagcatggccagggaggagagaaaaggaccctccccgctccctcaccccttgcccctcctaataacatcctctcccgggtgttgcctaagctgcccagtgcacacactcatccctggcctgtctgtgaaatgctttaaaaccgtcattttctatccgtttcccccaggcaatctgcaatccagcaactgatcttggatgacagagactattagtgaaaatgattccctgaggctccatgagtccccgagatcaccctgagcagcccgtgggcttctcggggaaaacaggacatcctgaaaaggaggcacccctgacgctgcagggatatcctgccacccagacagatgcccatcccccactgggacacccagggcaggtgtgtcaccttccccggcagaacataaatagcagggtgcttcacacccacttccagacgttgcttttggggaggcaggaagaaactgccagccagcacctcctgccagcttctgccagggccacactgatatatcagggttccctcagaattcactggaagaaagggtcccctatacacacacacacatacacacacacccgcacccaggtcctggagttgtgtgccaggcaggctgtgcccctcactatgcctggccacaggacacagcttttatgtatctcccagttgccactctgggccctgaaaaggcccaggcagatggaaagctggacgcctgaggtcaccgtgggccctccacccagctccggcactcactgggcctggtgcccttccagtcagtgtgtcgatctcagcccagggccacgtgggaacgattaggtgcatggcgtgggagctagctcactgaaggcccgagcccctcatgcagggtctgctgacaccagacaggaacatcaagcaaaggggacttggccccagccccaagttctgggatccagacctatagccccaggcccacgctcacatccacagcctgggccccaggcctggagctaaggctggacaggctcacctcctccccgacagcccattaccaaacccccaccttccagcccagcctcacccctgacctggcagctggcctcacccagcgtcttctaaggccaatggtttctgggcttattctgagattgaaattcctttcctgtgttctgaatttcaagttctcattaaagatatgtggattgggggtgggggtggagggaggattcagcagaagatgccaaacaccagcagaagcccagaaaataaggcaaggccggccaggctgtgggggaagggctgccatgttcaggaagacaagcaccatatggaatctgggatcagagacatggccaagggcacgtggccagctcacctcgcctgagcagaggcccccagaaccaccctgaatcttccaggagaggccagccagaagcaccaagcccacagcacaagtgaccagcccctgagctctcggggacacaggggttgctaatgccactgggcttgcccgacagcagctagctagcaaggagcaaagctggggccctgcccccgggtctggagcactcgctcagccccttccacgctggccctcctagattactcctccttccttccctgcaaaatagtccaagggtggggataagtcgaggctgagaccacagctggaaaaggctgggcaggcagtacccagtggcccggctgtctgcagcatagcagacgctgatttgtcaccaaggaacaaggggccaccggttgcactgattggctccagagtacattgggcttcctgatggaacaattcctttgcaaaggtatctgatgccgtttcatgaaattagaagtatgcctgccaggctgtacccaatttttctgtcaagctaggaagtcagacagacctacagtaaatgaggcggggctgctatggagtgacgggagtaccttagtaaatcacagcacgggggctggcccagcccaggcccctggagcactcgctgtgaacgtgcaggtgtgcccgatcctgggccccagactccagactctcctcacccaggggtcctgaccagaggctgagggctgagctcgcagcttcccactctcccagcaagagccaagcacaggccaggagtccctgaccacacgggggaccctgagaactatgggcctgcagaaccacatcagacaccaaccctggcttcaccacaatccaggaccagagactgggggatgctgggaggtgtgggctggcacagtgaggccagatctgaggcgacagtcatggactgtcaccatggccgcctggcagctcctttcacgtttctgggcccagggcacacgtgggttctgagttgaaaaagacagacgcccatgagtctgtgcagagactgctgaggctgctgggagcacctccagagtccttgtagggcacatgcctccagggatccagaaagagcatgcagggcctttctccctgagcagccaggtgagggttgggacctaccacaggcaccctcccagggaccatggcagcacagagcaggagaggcgctgtctggggctctggaggcctcttcacaggcacagactcagagacgcaggcactggactcaggcctggccgggggcccccgccccgctccacgacacttgcttgcctttaggcaacagaagatgggcccttggacagccttcatagtccaccatggaggccccagacatgaaggcagaggtgtctgggctgcttgtcacccacatgcacccagaacagaggccccagccccagcagccctgctacgccctgccgtcagccaggcagctggcccatttctgagccactgagaccggggctcagcctcagcagccaagctggtctgtggagagctgcctgagtctctgggatgctcccctggggaccagggcctcagagggctctccacacagcctgcccacctgcagtagcctcacctgtgtccagggcctgtggccccccgagaggaggggacgtgggtggccggcgatacaccacatgcacacggccttgctcagcctcctgcgccgccagccccttctccaagggttcgatgaagaactcctcctcctccatccggatcagaccagcctgcgggacaaagacaacaggatcagatttccagcacacaaaagaccaaggaaggggaacagcgaggagaccccctcagggagtacctcccacctgaagaccctgcccagcaccccagctggtgctcagcttgaaccctgggctggccggagggtatgaacatgtggtcccagaggccgccccccgccgcccaccctgtctaggaaaggggcctctgtctgggtcatctccacccctatacaccaaccctgtctgctttcagaaaagttactgtgtttataaagtcaaaaccgtccagagaagcagggagacattcaagggcagctgtgggcctgtgcgtgtccccaggagggcatccaccaaagtgcatcaatatgggccaagtgctgcccccactcccaggagcccagagtccaagacaaaggtcaaaacagccagccggggattgaatctgcccacacacatgttccatctgggccaaacaatatttttaaagctctgaagctaacactcagaatgatgagatttcatgtcttgaacatggaatcccagctttccttggaaacgcaggccctgaccacagcgggtcttggatggaacacatgcccctgcaactggctccagtccctactgccccccaactgtctctcctgctctctgtgtcagccaccagcccagactctacaggcagctgaactgctgcccctgaccccctaggccagccagcaccctccctgactacaaactcctcgctgggtcctcatttccgttgggactcaggctgctctatatgctggcattcaggctcttggcctgccccaccctcccagaccgcggcttgcaccaccccatgcttctcactgggctgggtgcaccctgccgagccacccagcccctgaaccccatgctgccaactcaggaatccccattctcccaccccaccaccccatccccagctcggccatctggtaaacctgtgttcccccttcgaggcctgattcagaccccctcacctctcctgccctcccctgccatccagcctgccctcccctgccataccctgccctcccctgccataccctgccatccagcctgctggcaccatcaggtccacccatcccatgacaactccagctcctacacttttatcttctggtccattatccataaaccaaggtctcacactggaagtgcacactgtgtccagccttcagagtgtttccttcagatcacaagcttatgacccatgcaggggattttaaaagcttgaatttgttgccaaacttaagaaacaggagagttcacataaacgaccagatttccagactctcttgaaaatcagaaaagctggcatttccagcacccatcgacactccagcttagctggcgctggccggggtcccctgtccagttaggagtgtgccctctggtgggcagcccccggcacctgccatctggatgtgcggaaaccacaccccccccaaagtaacctcatgatggcctctgccatatcatcatcttggttgtgggggggcacggtggcgcacgggctgcccctccttctccctgaccccaggtgctcggtgagccccatcctgttgctggctgggagcctctgcagaccgagatgcagtcagtgccccccagggcctgctgggcggctgcccctagcctcaagtgtagcgagggaggctggagatgcctcccggcgcactcagcctgggccctcgggaagctgatgtgccaggcaggggctggtggaggtgcagggcctggaggaacacagagcccagcatcaggcctggctccagaatgaaggatgcctccggcaggaggtgacatctacccaaacccacccaatccctttgtgctggccaggcaaagagtcagagagaggaccagtgctccatatgggggaaaccgcacatgccatggccggggaggtggacggagcacagctggtgggaagagctgaccaggtgggtggacaggagcatcaagggcacggtgcccggtggcccatcactcagggggctggtgagggagattgtaggcagcccagggcttctggggggagccttgatctgattccagttcagaagcatggtggctgcggcagggggaatgggctgcggaacaaaaatgggtctggggtcctggggagaaggtgttacaggcacctgggagaggggtaatggtccagacgggagcatgagagacaaggacgagtggcaggtatgaaggaggtgaggagcgaaatggacaggacgtggtagggtagagccggctgagatgggagggaggaggaagcacctggtgggcttccaggtctgtggctgaagaaccggcccccaaagttacccaggcccccatccctggcagctgtgagggtagtggacatggtggaaagagactctgcgggtgtgatcaggtcagctctggggctggctgggccctgaatgcagtccttgcccacttccttatgccggggagtggagggggattaggcagatgcgcagaggacgaggccatgggcagacagggaggatgccagatgccagctttggagattggagcgatgtggcctcaagccaaggaatgctggcagcccccaggagctggcagaggccagaaagtgtcctcccccagagtctccagagggagcgcagccctgccgatgcctggatttgggtcaggttataccgacttcggacgtccggcctcagaactgtgagagaacgaattcctgctgttttaagtggttccttacagcagccgcagaaaagtaattcagggtcctggtgggtggccggcaaagtgggtgccattctccgaggggcatgagaagaagggcaaggggcgcaggaccctctgggctcaggcatcctgggcttctggggaagaggcctaggaggcagtggtaaccagagttaccagggcaagaccgaggtcggagaaggaggtcagcagggctgtgggaggagagcggaagagggggtgggaaccctgcaggccccacgcttctgactcatccctgggtctcagggctcaaccaggcctggcgaagactcagcagatgcctgtggaatgagcgaaccgatgaccccaaagctgcaggccacgtcccccaagggaggcaccgagcaggcaggcgggaagaacacagccaggcctgtccactggcacaggggcagtgtgtttaccagtgcaggagttgggagggtccagcactgatggtcccggtgcgtggtgtggagaaggctggtgcctcaaatccatcttatgactgaaactcattggatgaagtgcaggaattaaccctggggggcggcagcgggcaagctgtcctggagcgtgaagttctgacttcctggcaccctttctatctggccaggtgacctcaggcaaggtgtcaagctccccaagcgtccagtgactcgtctgtacatgaggcaggtcatttcccgtgcacactcacacaggagcacatgcagcctgggagacactgagaaccaggccacgcctccacccaagtgatttcatccagccagcttgctttccaaatgaggaaaccgaggcctagatgggcagacaggctgctggggacacacaggttctagggatcagaactcacacctacacggaaagggcatctcccagacaggtccctgggccagactgggccgattgagccaattagggcaggacactggggcatgaggaccccttatggcagctccatcttctgggggaacttgcagcccaggtcgggagccatcgatgccacaggcctgaggccctggggttattctggagggacctagtgtgacaatgaggccaggctcagcctggggaagggcagtactctctggccggagtaacccgggggacagtttggggtctccctgaccagcaggggtcaggctcccctccctggctgcctccctgaggacaatcactgggctgagccaacagcactagctccatctgatgctgccctgggccttgcctcctggaagggcacccctgcaggcgactcctcggagggcacaggagcacactggggtccatctgaagcagggcctgggctcaggcttcctcacacagccagaagcctccaagcggtggcattctccaacacagacgttcaacatgctcctcacagccccgcccgtctctgttgaccaccgtgcgatgcgcacaacgcatgctggacgatgaacatggtggcacctgccccgagaccaaaggctgacaccccgagaccaaaggctgacccccctgagaccaaaggctgacaccccccgagaccaaaggctgaccccccccccgagaccaaaggctgaccccccgcgagaccaaaggctgaccgcccccgagaccaaaggctgacccccccccccgagaccaaaggctgaccccccacccgagaccaaaggctgacaccccccagagaccaaaggctgacccccccgagaccaaaggctgacccccccgcgaaaccaaaggctgaccccccacccgagaccaaaggctgacaccccccagagaccaaaggctgacccccccgagaccaaaggctgacaccccccagagaccaaaggctgacacccccgagaccaaaggctgacccccccgcgagaccaaaggctgaacccccccgagaccaaaggctgacaccccccgagaccaaaggctgaccgcccccgagaccaaaggctgacccccccgcgagaccaaaggctgaccccccccgagaccaaaggctgaaccccccgtgagaccaaaggctgaccccccctgagaccaaaggctgacccccctgcgagaccaaaggctgacccccccccgagaccaaaggctgaccccccccgagaccaacggctgaccccctccaagaccaaaggctgacccccccccgagaccaaaggctgaccccccccccgagaccaaaggctgaccccccacccgagaccaaaggctgacacccccccgagaccaaaggctgacccccccgagaccaaaggctgaccacccccgagacaaaaggctgaccacccccgagaccaaaggctgaccccccgcgagaccaaaggctgacccccccgagaccaaaggctgacccccccaagaccatcagctgacgtcctgccaagaccgctggccagaataatgctcggggcggggggcacttcacggaagaagtggagatcattttattccctgattttcaaacacttcagtatatgcatcccaggaatgatctgtctaaaacacacagaagaaaattgacaggagagcaaagcacaaaatgtgagctatgttttgctgcatttttttccgggactttgattttcctgctgccagtgtcaagtgtatctgtttttacatgtaatttttattaattagaatcagtttcctctccccactcaataaatattaaagaaactccagaagcacactaggctgaaaagcactcagttgggagcctgctggtggcctgtctgtccaaccccacagctgtccagcctggggtcttacagaaaggttggtaccccgacctggctctaagtgtgagtcccactctgctcttgaagtctgtggatgtctggcaaacccagccaggttctcccctgggggacagagagaggatcatggggagggctctgtccctgaccttcaggtgccaccgcaggggcccagagcctggtagtacccgggtcatcaagtcaagttgccggcattcagatcctggtgagttacacaacgcctgccctgcctcttccttctatagaacctgctcctttgcagttggattgatggtaaagtagttactagaaatggcaactagatgttaaaaatttataaagatccaaaggcttaacagctctcctctattactctgaatttttaagtattcaaccacagacagcctggaagttaggggttcacaggaaacacaagcatgcatcctgtttccttctgcagagcacccaggctggctggttcccactgccccttcccatggaagccacagctgcagccatcagcagcctcccacctgtgtatgactgggacctggtctgtcactcaaccttgtcaacctccagcataaacactgtcaggtgtgtgccaaggttgcagtggcaacaatcaagcatagaaggcacaaagcataggaagcacacaggtccatgcacagagggacccagactttgccaagggacaaggctgcaagtccctgttgccctcaaactcacctccctccgaaatacacacacagcacgcaccttgccaagagtcccccagatgctggcatctgctaagattcccattcctgaaagtattctaactccaagattctttctccccatcttccttttggtaatgaacctgggagatctgctggacaacggggcaatggccaggcagcctcccctgctgtgacagctgcctggtggaatgacggtctcacagggagagctgcacagtgcctgcagttcccagggcgcctcctctcagagcctgctcgggcactctcttgcctctcccagctccccagggaggtctctaacaaccttgggagctttcagggaagggggctggacccctcactactgaacagtcccaggagtgggaagtgtcattgagtgggatttgagccactccgtcctcaccactggacagtcccaggagtgggaagtatcgagtgggatttgagccactcggtcctcaccactgggggctcctttacagttcagcatcccagaggatttcacacactgacttttccacttttccaaaagggacgccagcgggcaggagctgtccatggggttaggaaacagctgtcctcacccgcatctccaccagctcctcctctgtctcatgggatcctcgccaggtgccagccactcccgtccttcctcttggagagcgaccccttgtctagggctctgtcttggagctatggctggagctgggccttccagggttctgctgagcacagtgaccacaacagagttgcctctgagctccacagaacctgatgactttgcttggccactctaaccttccctggacctggtttcaggccctacagacctttactccagaaagtctcttttttggcctaagctggccggagccaatttccaacaggaccaaggagccccgacagtcacatgcccagcgaggctctaaggaaagctagactccactttgaagggcagggtggggggcgaggcaggcagggagagtaagcactggacgctgagccaggggccctggtttccaatgcggtcatggccagtcctgcccccttgcaggcccccagttccctcatctgcaaactgaggagctggactacgtaacctatgaattactgcttatcctgtttattcatcaccccaaaaagaaaccccgcacacgttggcaggtaccgatcatccttctaaaactctactaggaccaaggagaaagaaccaaaccaaaaaccagaaacccactcctgtaaaataaaggccaaggccgtcccatggcacgcaaggccttccatggggtcccagcagccgtctgtccctgggcgcacccccagtgtcttcctctctctccgggcttctatttgcacctcaaagcctacaccgctgcccttctctcttgttatagaggtcagtaagtagcagagagctggtaaagatctgtcagcaccaaactgagactcccctcgactcaaccagagagtttaaaatgcaactgaaaagggaatcatttttcattataaagttcaatgctttttttcttctttttttgagacagagtctcgctctgtcacccaggctggagtgcagtggcgcaacctcagctcactgcaaactctgcctcccatttttaagcgattctcctgcctcagcctcccaagtaactgggattactggtacacaccaccacatccagctaatttttgtatttctagtagagatggggtttcaccatgttggccaggctggtctcaaactcctgacctcaggtgatccacctgcctcggcctcacaaagtgctgggattacaggcataagccatggcgcccggccagttcaatgctttttaatatataacagctttatggtgctgtgattaccataccatacatctcagccatctaaactatatgctgaaagtgaacaattcaaccataaccactattgattttagaacattttcatcaccccaaaaagaaaccccgtacacattggcagtcactccccatgttttccccaacctctcctccccaacccagccctgggcaaccactaatctacattctgtctctatgaattggcctattctggacatttcatatacgtggaatcacatgctatgtggccttttgtgactggcttccttcacttagtatgttttcaaggttcatccatggtgtagcatatagcagtatttcattcctcttttattgtcaaataataccccatcacatgtatataccacattttatttatccatttgccggttgatggacatgtgggttgttggtttttggctcctatgcataatgctgctatgaacatctgtggacaagtttttgtgtggacatgtgttttcattcctctcaaagtggaattactgggtcatacagtaactgtgccagactgtcctctacaggggctggaccattctcagtgcccccagcagtgtgtgagggttcaatttcccctcatccccaccaatactcattattcttaggctctttgactctagctatccagcaggtgtgaagtggtgtcccatcatgcttcggcttgcatttccctgacaactaatgatgctaagcatcttttcatgagcttataggtcatttatttaactttggagaaacatccattcagatactttccctatttttaataagaccattttctttttattgacctgtaagagctctttatatattctagacacaaatcccttattagatatacaatttatgaatattttctcttgttctgtgggctgtcttttcaactttcttattagtgtccactgaagtcatgaaggactttcttgaagtccagttcacctatttttttcttttgtccacttgtgcttctggtgtcatatctaagactttgcctaatccaaagtaacaaagatttactcctacattatttaagagttctatagttttagctcttacatgtagatctatgatccatccatttacagttaatatttgtgtatggtgtgaggaaggggtccaacttcatttttccatatgtggatatccaggtgtgccaacaccatttgttgaaaagaccattctttcccccactgacttgtcttggacctttgtcaagaatcaatatgaggatgtatttccaaactctcagttctattctaccaatctatatgtctatccttctgccaacaccacacagtcttgattactacagctttgtagtaagtcttagaattacaaagcatgagcccttcctctgttcttctcctcaatagcattttggttagtctggatcccttgtatttctgtatgaattttaggatcagcttgtcaatttctgccacaaagctagctgggatttgatagaattaaatgcattctggagtcatgtttggtacccattagttcacctcctaggccaatgtttaggaaacattggcctacaaagaaactctgcattagaaaccaagggcttggtcaggcatggtggctcacaccctgtaatcccagcactttgggaggctgaggcaggcggatcacgaggtcaggagattgagaccatcctggctaacacggtaaaaccatgtcatcttgagatgggagccctaagtctatcaactaaccaggtgagccactgtgagcaactctgggccctgggagagggtgcacagagggatggcttcaaccctgctgctagagaatgccctcgagagcgtctgtctcagttctgcttggcatccctccccagcaccccccacctgccactttacgcagcctggacttgactttaaaactgagacacctggcaagtggggaaatcacaggtcgaaatagcggaattgccctctgcatctatgctacagggataatgagggttacaaatcagaagacatttagcatatattctggaaaaaaaaagctatgtaatatataaactattcataatttaactttaataaatgggggcaggcaaaaaattgccaaacaagcccacaacaatcagacaaagagtagaggaagaaaaaaggaattacagtttaattgcactcgtttcctaatcttcagaatcttcagttagcatcaacagttactggtaagtttctaaaatcagtagatacaagctgaagaattctactcaaaattagaaaagtcacaactagtaaaactaatgtataccttccaaatgactgaaggcagaccatatagaaaatatggtagactagaaaaacagcaaaaaaaaaaaaaaaaaaaaatccagaaaaacagaaaacataaattagatgacagaagtaagaacaaatatataacaataaatgtaggctgggcatgatgtgatcccagaactctgggaggctgaggcagttaggaatttgagaccaggctggccaacatggtgaaaccccatctgtcctaaaaatacaaaattagccagacgtggtggtgcacacctgtaatcccagctactcaggaggctgaggcgggagaatcacttgaacccaggaggcagagttacagtgagccgagatcatgtcactgcactccagcctgggagacagagacagaccctgactcaaaaaaaccaaaacctaaaactaaacaaacaaaacaaaacaataaatggtcagatgattattattattattattattattattattattattattattattttggagactccagcctgggagacagagagataccctgtctcaaaaaaacccaaaatccaaccgggcgcagtggctcacgtccataatcccagcactttgggaggacgaggcgaatggatcacaaggccaggagttcaagaccagcctggccaatatggtgaaaccccgtctctactaaaaacacaaaaattagccgggcttggtggtacgcgcctgtggtcccagctgcttgggaggctgaggcaggagaattgcttgaacccaggaggctgaggttgcagtgagccgagattgcatcactgcactccattctgggcaacagagtgagactccatctcaaaaacaaacaaacaaacaaaaacagacaacaaaaacaataaatggtcagattattattattattattttggagacagtgtcttgttctgtcacccaggctggagtggagtacagtggcctgagctcagttcactgagacctctgcctcccaggttcaagcaattctcctgcctcagcctcccaagtagctgggattacaggtgcacaacaccatgcctggctaatttttgcatttttagtagagacggggtttcgccatgttggccaggctggtctcgaactcctgacctcaggtgatccgcccacctcggcctcccaaagtgctgggattacaggtgtgaaccaccgttcccagccagtcagattatttcaataacactctatgccctgcaaaataattttacaaaatttacagatttatgctaggctaaaagagtttctcagattttttgaccacttaaggaacagacacacccatgacatattggtgaccgaagaaggcggcaagcccagctgcagcatgacctccttacgtaaaatcatgtatatctctgtgccaaacgtcagcacagtctaataattaagcatgtggcctccgagtcactctgcctcgattcaaatgtttacttcacctctgactgagtggcctctctgtggacagtgtctgcagggttgaatggagataataacagggtttccatggctgatgtgagggctaagcgagatactgcgtctctagcactgggcacagcacgtgataaatcagccgactggcagcaccatcaccatcatgatgatcatggcatgacagctgttaggaaacgcgtaacaaagggtcagcagtgttacgatcgggggtgagtttcactttttattaatattttctgtattttttttgttttacatttttacaaagggcatatagcaaaacagacaattcatgtgaagacaggagagacggaaagggggagagcacagagagaaagataagggggaaaatggaataaacaagatgccgacaagaatgcctcacggggccagcgcaggggccagccaggcggccttctgctaaatcaagcaacgcttgagtggctccctcgggacctggcctgtccagaatgtcccacactcagccctctgcagccagctcccccatctccatggctcctgcacacaccaatgccggggtagcctccaggaaacagagctggccagccagacccagccaggacacagaggtcagtgggtcagacccagactctgggactgcaacaggcctgcctatttgtgacgagaactgacactcgtcccggccagattctctggctgacatttcccaggtctcgttcagcatgaagcccacgtcggggaacgtccccagtcacaaattaacattcacataaataacagggcgctctctactaaagaagaaaaatgactcgtgctgcaggaacatttgccaaactatcaaaaagcaagatttttctttctgagcttccatgtctcaccagctggaccacagcagattgtggccttgagacgtgtggtggaggagagctcatggaataaggtccaacttccccattcaagatcctgccaacaggccgggcacggtggctcacgcctataatcctagcactttgggaggccgaggcaggcggatcacctgaggtcaggagtttgagaccatcctgggcaacatggtgaaaccctgtctctaccaaaatacaacaaattagcgggacatggtggtgggcgtctgtagtcccagctactcgggaggctgaggcatgagaatcgcttgagcccagaaggcggaggttgcaatgagctaagatcgcaccgctgcactccagcttgggctacagagtgagagactcttgtctcaaaaaaaaaaaaaaaaaaaaaaagaccctgtcgacaggccctcccctgggctggcacctgcccacaccagctggaacctaacacctttgcacagctgttccctgccagcctccctgcctccttggaggtctgcacacaccgcccctcccttcctccaaccagcccaggagaccagcacgcctgagcaccagcactcccagagacagagccggcacggtgggtctgtctgctcagggggctggggtggcaggggcacatgtctgggagttgccaacatatgcttccttaccagattccccaggggacccaccctggagagcaaccaaaccctgcaaggctgcactccaagaactgagggcctggggacccaggaccgtcccccagcattcacagcaggctcacccacatccaccaggagatgctgcccaggtagactgccagcaccccctcccacaaaaggtcggggccggcgccttccctaggttgctcgggcagccatcacagggcagcacaggccggggcttgaatagcagaacctattctctcacagtcctggaggctagagctctaaaattaaggtgtgggcagaggcggtttctctcgaggcctctctccttggcttgtcgacagcatctttcccctgtcctcacatggccgtccccctgtgtgtacttctgtcctaatcgcttcttcttaggacaccagtcattcatgttgaatcagtgacttcattttcagttaattatctctttaaagaccctgcctccaaatacagccaatatcctgatctacgggagtttaggacctcaacaaaggaactgggggatctagggagggcgtcactcagcccataacagcctccaggcgccaagtccacacagaatcggagcaggctgctggcagggtccggtggccagagctgggcgggctgttccttggggagccactctggacaggccggaaggtcaatgccaggatcactccccaggggccagaaatccagcatggaggaaagctgccactccagggaagtaggagcccgcccagggctggccacatgggatgcccatctcacccttccttctaaactgggcattctcacatggggacacggggcagtgagtgcaggcgcagggagacaagaatgctgcacagccggtgggtggtggacgggcctcaggacccctccgccagcagcaggccactctctcacggtccagcaggagccctgctccagagcccacgactggagccagctgaggctggtgtctcacattcctgcagagaggctggctaaggctcccgtgtgggggcactccccatgcccactgcaccccagaattttctgggcgatcccaaggctgagtctacgcagctgttggaagacggggtatgcaattctagatgtgtggcgtgttttgaacagcatccaataccctttctgtggcagctcagcccggagagcaggtccccagtctcgaggacccaggaggcagggtctgctccttcccacagcgggtgctcctccaggaggggccaggtgctcagagggaaaccagtgcccaccaagggcccagctgcctggctggctcccagcagtgtggggaagacacactacccgacggacgtcccccttagaagcaggggcagacaggaactcccatggggagagcacaggctgggacgcagcccgcccaacgccagtccccccactccactgtgcaacaaggatcagcctttcctctctcaaagcctcggttcccccagagggggctgcagttgagagttgatggtgagactcagtggggcatgtcctccatgtctgcttgtgcaaagctgcccagatcaggcagttttcccagccagaggaccccccctttcactttccatcacaggctgtcatctccccgggtccctgggccacaggcccctctcaggacccctccggcctcatgcacacacagagcctgtgcactgcctcactcctgcttcctttgaattgggcttcttttcctgctgtgatctctggggcccactgtgctatccagggcacgctgaccgccgaccgtcctctgcccgcctgcccagctgccactcccgggcgggcagccctgccaggcccgaggctgtctgcttccccttctgtccagagttcccaaaacaaaaatcaggccataccatctgacgaaggatcctgtctggtttatttatgggaagagccagggctctgagggccaggttgtctgggctgtggccaggctgctctgcaggccttcagacactgcccagcccgtgtccccacccacccagggtggctccgggggaggggcgggggcagggccccagcactggtgagcccacactggtgactctgggatgtgtatttattctagagccaggacagcagccgccagggccctaggcccctctgtgggtggttggcccactggagagccggagcagcgaggccagcaatgaccaaaggcgccgtatccagaatgcaggcaggctcaggcgcacctgccctccctggatgccactacagattcggggagactgaactcatgggatcaagtgccccacagatcctggtcctcacaagggacaaggccaccaggtgtcacactgggagacagtggcaccccagggtatgaaaggccacaccaggcttatgtccagtaaccctgcctgcacagcacagcacggcacggcatccataccgcagcacagccccgccctccggcagtgccaagcccgggatctcagggcccccaccagaaaccagacaggtgagcaggtggcagctccaggccaggtgctgaccttgtgcataccaggccttccccgagagcaggctgcagccccccagctggttctgactgccacaggactgcgcccctcctgcagggctctgctcacacccacactccctgctcagagacggcctgtcccaccgccccgtgtgaaatcacacccaagcacagcggaacgatggaggaggcagctggaaggtgctttcggtggtcaaatctggggcaatttgaacacaataataaatgatagtaataggttagaacccattgaataaaataaatatccacagatcagtattggtagaaacaaataactgaataataaataagtgggaggggaagggcagctctttctcacagggtaattcaactaaaaatgtaaaagaaatgatgagatagaaaatcatggtagtaaaccccatcggcaacagcacagtcaggactgcggcaggtacgacttatccgtggaggctacaattagtgagcaaaaggataacaagaaacagaatgctcacatcacgtcacagcagctacccacgggagatttaatcatcgcaatgggaaaaaagagtgaaagagtggtttgctcatcaagccactcatctgagacctgaaaaaacctcacagtcacagccctagagctcccggggcatccagtggaatcccagtaggtaacaccttagccaaatgaagaagggcatcactgacaataggagacaactggacatcccaatgtgacagtcccagcgtggtgccctacggagggcacagtgcttctgtgacagtcctgccagaaacacgtaagctcaagccagtacaaggcacaccagaaaaacccatggggatgcaccgtctacaaaacagctgaccagtcctcttcaaaaacatccaggtcatgaaacctcagatgggaggaaacgggagagacacaacaactaaatgccacgtgggatcctgagggggagcctgaaccagacaaccgacatgagtcggaagactgacaaaattcagtgcagtctggagtgctacggttagaatgtgactggtttgttcccaccaaaactcatcttgacatttggtccccagtgtggcagtgttggaaggtggggcctggggtgaggtatctgaatcatggaggccgatccctcgtgagtggcttgatactgttctcaaggtagcaagggaattcttgctctggagaggcttgattagttcccgagcctgggttgttataaaagcaggacactccctgggtttcccttctttgcacacatgggctttccctttgaccctctccaccacgttatgacacagcacaaaaaggcctcaccagaagccagggccatgctcttgaacttcccagcctgcagaaccatgagctaaataagcttcttttctttataaattacccagtctcaggtattccattatagcaacacaaaatagactaaaactaagacactaagtaccaacgcttagtatcaacctacaaagttcctggtttcagtccttgttctacgttgcatacggaggaagctgggtgaagggcacagaggaaatctatgctatttttgcaacttttcttgcaatttttccaagacagcatagatctaaagttatttcaaaattaaaactttaaacacataaaaataaaactgggccccagcctccctcagtgctctctggccggtccattcttcacattggctgcctttccctggagtggaggcgcccactgcatccccagtgtccagggagcaggtcctgtagaaggtggtaggttccagggatcggggagcaagtacagaggccctgagaaggaagcaagcctggcgtgttccaggaacaccagggagaaccgtgtagccggagcaatgctcttgtgcagagggcctatgcctgagccaccctgtgggccctgccgttcccttcagggcactctccaaccctctgccctgtgcatggggccacggatgccccaggagctctagggctgttgactatgaggttgcttcaggtctcagtgagtggcttgatgagcgagccaccctcactggccaggaggggacttccttcacaggtgtgaatgggactgagccaccagcatgatgctgacacgtgggttttgaggattcccactcacatcagacagaatgagtgcggggctctgggatacagctgcccaagcctcaagcctgagtggcacttgtgggctcctgcatcggctgtggggccacctccgggctctggtgttcaggggtgggcagtggcagcagacatccttcactctgtgcctctgtcactggtgcccagggcggtggcccacaccctcaaaggttccgtgtcatttccgggcagtcttccagggctggctgcatccacctgcttggagtgctttcagagggaagctgttgccctgcaatgccacgacccttcccgtgtcctctcttgcctccaagccgtgctggacatcatgctctcctcccaggctggtctgcagagggatggaatgcctgtcacaactgggatccctcttctcttgtcattctgcctgctggtggcagagtgtggaaggcgggagtgtgcccaccattaaacgaggttgaattctgggagtgcagaagtaacagcctcaggactgatggggaagatgaggctgcaagatgtgtggttcttcccttcgctataaaggtccaaacgatatttatttatttatttatttatttagagacaggatcttactgtgtcacccactgcagtacagtggctcaaacacagctcactgcagcctggaccccctgggctcaagtgatcctcccaactcagcctcccaagtagctgggaccacagacgtgtgccacaacagctagctaatttaaaaaaaaaaaaaaatttgtagaaatgaggtcttgctatgttgccagggctgatgttgaactcctgggctcaagtaatcctactgccttggtctcccaaaatgctgggattacagatgtgagccaccacacctggcccaaacattaaatttaacacgaccagatgaggacgtatggctcacattttcttgcacactctgggcaagatccacattggtggtcatcattaatgaagcacggtaaccaccttcaagggaacaacggaagccggcattcccgggggcagagagaagcggcggagtcaggagaaatgccacaaccagcactaaatacatggggctggggaatgcggggcaagaagatatacagcatctccacacaaacaggttccaaagagccacacattgtgagcggtaacagctttgctattaccccccagctgtgggagatataaatatgaaattagctgggacagcacactcgaccataaagaacaggaagagatagctcctgagcctgagcagtaacgagggtctctgcatgcactgagcagacagtgagcaaatgtgttcgtgcttctcctccccgtcccctaaatcttccttgatacatcttgctattccccatgtgggctcatgaatcttgttataaattttttaatcaaattgtctatatagacaggagtcctgcaggaaatatatgcccagggccccatgtatcctagggacagccagccatgcctttgggaacagcctagaaggactgtcaggaaggggcctgggtgggtgggagtcagcttgcccaaggtgactctctctccttgcaagatacatctgagagagaagcccattgtaagcagggccaatccaagctcccaccccaccctggagtgcagaccactgcccagacggcttcctgaggtcctggctggggccctccaaggtaccccatttccaggcctccagccccagccccccaatagcctgccttgaattgtcttctgcttaagtgagttgaggtcagttttgccatccaaagagaagccctcctgttttcctagaggttgtcaggagctacgctggccggtcccctgggcttgggacatcctctgttgttggggggagagggtgggaagcgtctttcctgcagccatgacctcaccttggtgacagccacagcttctcactcacagcactggtgtaagtgctaacctgaagccgctcctccttgtccacggggaagacagtctgaccccactttcctctgctccccgaaaataaggaacgttattggtgttgctttgtcctgacagactcacacgtccttaaaaagtgctaatcttcacaaaagaggcagcggcctgtgccttccttgaggaaagtcagattaattagctgactcccacatgagcagcctctgattcttgcaggctttgtttatggatcagaaatcaggcttgaagtgaaaactgacatctcaatgtgaagagtattttccctgctaactgcagtgagtcagagccgtgcgctgagctagacagatagggaacatggccttcccatgtggactggagtgtgccaacgcctccgggccacagcccaggacaagcgtgggacatcagcctcccattgctaggccagaacaggccagtgccccatagatcccagcccaagacaagcaccggagttggcattccagggtagggttttgtttgtttgtttttctcaagatggagtcttgctctgtcgcctaggctggagtgcagtggcatgatctgggctcaccacaacctccacctcctgggttcaagtgattctcgtgtctcagcctcccgagtagctgtgattacaggcacacgccaccacacccagctaaattttttttttttttgtatttttttagtagaatggggtttcatcacattggctaggtggtctcgaactcctgaccctgtgatccgcctgccctggcttcccaaaatgctgagattacaggtgtgagccaccgcacctggccaaggtttttttgtttttttgtttttttgttttaaggtatttgtgcatctcaaacattccacttaatgactgggaactggggcctgcaatcccagcacttttgggaggccgaggcaggaagactgcttgagcccaggagttccagaccagcatagtgaggcctcatctctacaaataatttaaaaattagctgggtgtggtggtgcatgcctgtggtcccagctacttgggaggctgaggtgggagaatcacctaaaccctgaaggtccaagctgcagtgagctaagatgctgccactgcactccagcctgggtaacagaaaaagacactttcaaaaagaaaaaatatgactgggaaccgggagaaagatgttgatgaaggcacgcagcctacagtcagagctgacagcccagaaacacgtccagccagccaattatttttaatgaatgcccttcctttggtgactcaatcccatgaacagggaagatgggtgcatggctagaagctctgtccaggctccgagggctgcccagcagacccaccctagggggtgccaggatcaacccgacccagggatgctgagcacccatgcaagtctgacccacccacgtggcccaaggaggcagcttgtggaggtccggaatggtggtctggagattgggcacccacagacttggggagtggaagggccaccccaagccctgcccccgcccccactgcagcttccccgcagggctgcacccacatccgcagggtggcccctgccccgtgtgcccagcttccaaggtggcctgcccctgatgccagagaaacttcctgctggccaagcggaggggcttgctttctagggtcagcaggaaatgtcaacattttccctgaaaaatccttcaattccctcattgagtctccagtagacttaggtcatgtatacactcaacaggacaactcttttccaccccaaatgctgacagcctctgaggcagtctaaagaaggaaggaagagtcactgtgcagactcctggcatggaggccctcctgtcgctctcaactactgcctctaggcgaacgggcctgtggggaacttggcgggttcccactggccgcatggatcattgtttccacttcaaaaccaggccttgagcaccctactggaggctgctgggtttgtctgtcatcctcagagcctgagagcatctggcaccaggcctggctgaataaatagattctggattagaaaggaaacctggctttgaaaagacacagagaagaaccaggtccctgcgtcccttccttccaggctgatgttctgggctggcgggtctctgttgggctccccaccccttcaccttctgccctgtcctacagcccagtaggcagacctgatggactggctcctcctggctctccctgggtgaaggggggcaccgacaggaaaccagggctggggagagagacagaaggttttatttctcccgctgtggtggcccccagcctccccgccctgcaagctccctcgtcctgcccgcagctctgtgagttgtgcctttgtcaactcctttctgttgatcccttatgtgtcccaggcccctgactgatccgacatgccctgtagcccgaccaggcagccctcactctcatagtccaggtgctggtcccatctctagggtttgggatgggacttccacactccagcccaatttccaccctgaagcacacgggtgagccagttccctgcaaccaccacagactcaggacacaaagtcccaggctggtccagaacattctgagcagggcagaggagccccgtccatggcggctggggcagtcccgcaagtgagagtcggggtgggaggagctggaggctctggaagggattcaggagcagccaccaaggccaccttccacacacgtcctcaaaagcccttccatattccgctgaaaccactagtggggcctgtgctgggagcaagggaggcgtggagacaggtggggctgtggaaggaggctgccatgaggagggaaggctcctccaacccaggacgccccactgcaggaggaaatgcctttctggctgtggtccaggagactgagggtcctgctcagccacacagcacgtgccaaggtgcagagcccaggggaagagcaaaccgaggagctggcggtgcctcggacgatgcagtgatggtgaagcaggaggatgggggaggcctgagccgtggggacaggagaatgaccacaggatccacacctctgtggtccgtgggacctcagcagacgctttgggtgatgccagagagccatggaggaggtggcggcaggggctgtgcttctgagaatgctgacaatgatgggacccgggagcagccggagctcaagggacgggcaggggcaatgccggggcctgtctgtgctcggaggagggggaggtgggtgagcaaggaggtgggtgagcagggagcgggaaggtcccaaggggggatgctgcctgcagaggccagcagtcaggaatgtcgaagtagatccttcagcgaggctggggcccctgctcggaggcaggaaagtaagggaggagggatggggctggacccagcaattcagcaaggaaagcaggaggcgggagacagtggtacaggcagggagcaagtacagcaaagaggaccagtggcatccgactcggataaggaaggaccgcaaggcaggtggagatgggctcagtgggtaaggtccccaggggcggcctgggcagagggcaggagggagaggcggcgggcagagagaggctgctgcgtgctgtgggtcaggagggtggtgcctgggaagaccagctgcctgcctgctcccagggtggacaggggacaagtcaagcataaagatgcaaaggtgcaggccgaaaaaaggacgggccactggtatcactaacacaaccatcaatgggtttaacattgcagttagagatcaaccagactgagatggaacaaacaaggcatgccgtctgtaacacatgcctgaaacatgctaaaagagagacagagaaaactgcaaacccagaaagcagggtgtctgtagtatcatcaaaatagaactcagagcaagtactaaatgactggaaactcctgttgtattgacaaggcttggtgaaagcacacagtcaccaagctttacaaaccaagggccgcagcatctgccatggttagaaacacaagtggctcaacagccctgtcaaagggaaatgcgaacggccactcccagtgggtgacaggtctcctagaccacagcagaggggcacagactcattgactcgggaaatgggccggattgatttctggatggatctgacgacttacaaccgaaagcaaatgagtattctttacaagcatgggggagcatttacaaaaattgatcccggcctcccctgcctgcctggcctgaatcccccaagcctgtcagccgtagcctcccaccccacctgcctggcaatgcagaaacctgagattgctgcttctcggcaccaagaaccaagaggtgaagttggtatggggacccccttctgccccactccctgctagtactgtccagccagaaggccctccccacagcctgcccctttctcttgactgttcccttccccaatacgctgaggccccatgtctcccaggaccctccctcaagaccccggcttccctctccagggtgacttgggcccttgcatcatggggcataatgccaactccccacccctactgatgaagtcactggcagagtgcccccaacgccctccactataatcccagaggacggagagctcttgctctgagccgagacaacccactgcccaccaccagctccctcagggctctccacaagtcccttctcgcctcccctgctgcgtcttcggcctcctcctctctaaagtcctctctcagcccaacaacagaaccgggtctcttcaatcctgaacaagaagactctgcttcccctccagccacaggacctcccttccctcacagcccttctcagcaggctggcctctgctgctccctcccacgcaccaatgcccatggcctctgtccctcctccccagggccccggggacctccacaccctcctgctcagcctctctctggccgcccccagctgctccggtttccacagcaccagaggccagggtcccctcgtgccacagtgaccctgcaacgcagattccgtgctcccttcagaagcccacctgacattcatagaagctgagcaaacaccaggagacagaggcaatttcagaaattccccgaggctcggggaacccaggctgtccccttcactcctaactctgtggcaggcctggccctgccaagcctccatggagatgagctcttcctgtcccaaggtgatggtgtgaagcgggcctttggaaggtgatgaggtcatgagggtggggaccccgttaatgggattagtgcccttatcagagaggcccagggagcttgtgcaccctccactgtgtgcaaacacagcaagaaggccccagctatgagcgaggaagcagccctcaccagacaccaaacccactggcgccccgatctcacatgtgagactccaaaactgtgagaaataaacttctgttgtttctaaacacccagtctgtgatattttgttatggcagcctgaacggagggacacctgcagagcctgggatgctcagaatacacacgtggcaggaggggtgtggacgggctctacggaactgggagatgcctagaaatgctagaggggttgagggggaggcattcacaagcccttgtaggaaactgagatctgcgctggttaggggtggggtgtcactggaatggcaagatgcagatataaatgctgacaagacccaatttaaacccagagatgctaaggtctgaaaacatttggattatactaggaatcaacgcaaagcttaataacctaaaatccaaccactcggaagttttttcaacattcctctaaatagctcttaagttactggaatcaaaatcataaatctttttaaaatgatgacagtgagaattcagcacatcagaacctgtggatgagaccaaagccaccaccagaagcaagttcacaaccttcttaattatagaccagagtgaaaataaatgaagccagtgctccagtcaagagggcagaagagagagcaaccataaacctaaagatgttgatacaaatagcatgagtgacaagatctcacttctgagtgtgacatatatgtaacaagatggaaaaacggttagtttgtatagctgtaacaaattactgcaaatgtagtggcttaaaaacacaaatttgtccaggcgcggtggctcacgcctgtaatcccagcactttgggaggctgaggcgggcggatcacgaggtcaggagatggagaccatcctggctaacacggtgaaatcctgtctctgctaaatatacaaaaaatcagccggccgtggtggcgggcgcctgtagtcccagctacttgggaggctgaggcaggagaatggtgtgaacccaggaggcggagcttgcagtgagccaagatcacaccacagcactccagcctgggcaacagatcaagactccaactcaaacacacacacacacacacacacacacacacatttattatctgacagttctagagatctgaagtccacaatgggtctcactgggctaaaatcaaggtgtggggagggctgcattccttctggaagctctaaggagaatgtttccttgtttttttccagcttttagaggctacccacattccttggcttgtggccccctcctccatcttcaaagccagcaccggagcatctactgacccctctctgactctgaacttctgcctccatcttctacttttatgaatccttgtcatggccagctcacacctgtaatcccagcactttgggaggctgaggcgggcggatcacaaggtcaggagatggagaccatcctggctaacacagtgaaaccccgtctctactaaaaatacaaaaaattagccaggcgtggtggcaggcgcctgtagtcccagctactctggaggctgaggcaggagaatcacttggacccaggaggtggagcttgcagtgagcctgagattatgccactgcactccagcctgggcgacagagtgagactccgtctcaaaaaaaaaaaaaaaaaaagaagaatccttgccattacactgtgccatccaggataatctccttatcttaaaagtcaactaattagcaacctgacttccatctgtaaccttcactgcccctgctatgtcacctgatttattcccaggttctcgggactgggacatggacaactttgggagaaggattattctgtctctcacagagactatctcaaaagggtaggatttcatggtttttgctttctccttaatacttttctacattattcaatgataatgaccatatgttttgtatgttcaaaagtaatttttaattgtgaataatgtaaattattgtgaatcatgttttgtcagttgttgtgaataatgtttaattgtaaacaatggaaaactaaagaaacaaaagaatagcatcctcttatagcacccattgatgtctttgcaacactttttggctggtcttttgtccccgtccccctgactttgagctgcctgaggacaagccagaccccccttcacttctgtggctctagcagtaagcatgaggactttggcacagcaggctttagcagacgtttctcaaagtgaagataaatccccttataaaggaggccctggtttaagaagaatgatgtgcacactcaaaagtgcactttaaggccaagctccgaataaacacgatgatattattttatttaagagtcttcatacatacaacttaattcagtaacagtctgagaaacgcaagccagcagacagataaaccgttatggctctggctctggcaaaaactcttcatctacgcggagccagaagaaagccaattaaaagtcggagaggtcccgcaggacagaggccggaggatgtccccacacactgagcacaagccccaaacacaggcttccccagtctggagccggcggccagccccctcctggcctcagtgaagcctggactcctcactctgtccaagtgggaggaactggtcccagctgcaagaaccgcctactgtgatctgggcaaaggttctggaggctctgctcgctcctgtcccccaggaaaaaaaaaaaaaaaaagacagcagagggcattgctcaggggcccagcctggctgtcatccctgaacatcctgggctgaaggaaagaattgagcccagccgaaacttgagatctttagacttaaatccccactctgtcacttgtggctatttggcctctttcgacctctgcttttccgtgtctaaaatggcacaatattacctactttacagagttgtcaagggattgaaaataagataatgaaggcaaaggaagtgagctcagtatcattatgcccattttacagattgggaaacaggctccaagagatgacatgactctttcaggattagacagctaatgagtggtggatccggatctgctcgcacagggctgggctcctccccagccccgcactgggacaggggcatctcttgagggctgccctgtggcgcccagatgccgcagggagacaaggctgtgtgcacagatctctctccactgggcagcacctgagtaactgggggagagaagtgggtttcaagcatctcctttgtgaaccactgggcttaagtatgctgaacttcagttttgacgcagaacttggagacaacccatcctctgggaaaagacacaaatgagggcaggacccctgcaccatgtgccctgctgccccagcagtgtcctctcatccagcgtgtgaagaaggagtgcagccggagagccggtggcagcagggcgtgcgggatgccccgctcacagcgtgctgtgcccgggagaggagcgagggcaggcccccagctgcttgggaacagtcagcctgcacacctcgcccctgggtgcccttccaaggcagccctcaggccccaggctccgggactccctgcagaggaactgcaagccagtcctggcccagcacagcccttccgccagcctctggccagcgtcaggaaggggagtgtagagtgagtaggaagccacacaggagcagaagccgggacttctgcctctcaccccactgcatgtatgaaaatagacgggggtgatggccgggtgcggtggctcatgcctgtaatcccagcattttgggaggctgaggtgggcggatcatgaggtcaggagatggagaccatcctggctaacacagtgaaaccccgtctctactaaaaaaatataaaacattagccgggcgtggtggggggcgcctgtagtcccagctgctctgggcgacagagcaagaccgtctcaaaaaaaaaaaaaaaaaaaaaaaaaaaagcgggggagtgataaggccccggacaacccaaactgcagcaagattctctgcggaggcagagctgcctcctcctgggggtcctctggaccaggaaggagccctgaggacttgtggcccagtgggtccggcttcccaacctccaccttgccagcagcaccgatagatgtggccacaaaggtgcattcacatttgcgacctgtggctgaatgcagaccctgggtgctatctcccgggggggcaaatggcagtaagcaagcaaagaggaagtcgacagagagtgacgcagccgtgaggacaacagcacagagtattgttgaggggggcgggggacttcctggaagagatgacactggagctgaggcctaaatgattggaaagaggcagcgatggagagatctggggaagtgggctccagcacagagaacagcacatgcagaggacccgaggtcagaacagacctgccatgtttgaggaaagggaagaaggccaatgtgagtggagtgtggagagcaaagggtgggcgggggcgagggacaggagggcagagtggtgggcctgggtggggtacaggagggcagagtggtgggcctgggtggggtacaggaggtcagagtggtgggcgggggcagactgcacagagcttcctctgctgtggggaggagattggattttctcctctgtgcagtgggcagcccctggagggtggaagagacctgattcccctgtcagttgctctgggcatgttgtgagaattgctgggggcaggatctccctccctctctctatgaaattcctgttcagcagggatctgcctatggctgtatttctgctggtagaagtccctccctgattataaaccgctcaacacatagagaggtccctaggagaaggttcaggttccagtaggatggtgtgagcacgcctcacctgcatcccccactgcctgcagccacccaaatgcactggattcatgagcagctagctgaggaccctgcaaaataaataacagcatgcagattggggaagaagactagaatgtgaggttcagcaaacccgcagagtttactcttcattctctggtattcctcagcctagatacaaggcaggtcaaactccagaagcgggcactgggtacagacagacagagctcgagacaagccctgttgttgtagctcaaggatagaaaaagcatttccgaatgctcagagccaagccaacacctcatttttctttcctatttcctttttcttttcttcgtgttctcacacgccagctcatggcagcccacaggcacctaaaactctaagaggggagcctggctgtgtagctggaagtgctgtggtcctagaaaggtggagtgaaaccccattgctctttcctcttttggtcctcccaggagtgtagttgcaggaagtgtgcaagacagcagggtcaataaagccccagctttctggccagagagatttaacaaggagccgcaggaaactggacagggctaggaagatggcagagacagcagagcttggggaactggcatcagaaagttggttagaaactcctgggctcgtgcttgagccgtgcacgagtgggtctgaccctaaacaacacgccataggttctggggactgacttaggaggtggaccaatgcccaggtcccagacgtgccactgggttgtgtttacatgggattgatcagaataggactgcacaggctttgaaaatggacctgacattgaaccgcaatccacaggcacattggaacttgcagccggaacccaattaacccaagggttaattacctgatcaaacaaaaataatgaccttctccatagcatttaaacaagatccaaagtctcatagggtaatatcaaagtgtccaggatacagtccaaaattacttggcataccaagaaccaggaaaatctcaactcctccaggcaaatacaaccaacagataacaagactgagatagcacatatgttggaattaactgacaatgatcttaaagcagctattataaaaatactccataaagtaagggcaaaaactctggcaactaatggaaagatagtctcagcaagaaacggaagacatatttttaaaaaggaccaaacggaaattttagaactgaaaaatacaataacagaaactttaagaactcactggataggctcaagagcagaatggatatgacagaggaatgagtcagtgaacttgaggatagagcaatagaagttacccaattcaaactgcagcgagtaaaaatattttataatgccaagagccttagagactgtgggaaaataccgaaagatctaactaacagtcatgtcccagaaggagaagagaaagaatgtattactaaacaaatatttggataaataatggctgaaaacttctcaaattctgtgaaatgcataaacctaccaattcaacagatcggcaaacctcaaatgagagaaatccaaggaaacacaatcccacacgttataaacacactctgaaaactacagacaaaaaaaagtcttgaaagcagtcagagaaaaacagtgcattacttataggggaaaaatggttcagataactgcagatttcttatcaaaactgtgaagtccaaaggaagtgcaaaacattgttaaaatgctgaaaaaaaaaaaaaaagaactgtcaacccagaattctatctccagcaaaaatacacttcaagaattaaggagaaataaagacattctcagatgaagcaaaacttatagaatgtgtggccagcagatctaccctaagatggttgctgaaggaagttcttcagacagggggaaaatgatgctagaaagaaattttgaacatcaggaataaaggaagagcaacagaaatacctgaaaaaatataacagattaggctcttgcgtattttaaagaggaatgataatgctgtctgatgtagttttccatgtatgtaggtgtataaaagacaacaacattcaggggaggacagagggacctatatgatggcagggtctcaacattcaacttgaagtggtaaaatattgatttgaaaaagactctgaagagttatataggtttattataatccctggagcaaccagtaaacactatacaaagatatacaaccaaacacaataggtaaattaaaattgaataccaaaacatgctcaaatagaaaaagcaaaataagcccaaagcaagtagaagggaggaaatgataagagtaaaaatcaatgaaactgaaaatatgaaaataatagagaagatcaatgaaaccaaatttggttctttgtaaagatcagtcaactgataaatctctagtgagactgaagaagagaaacagaaaaaaatatgaattaccagtatcagaatatttttaaaaaggatatcactaatgacatcacagccataaaaaagataatggaatagtataaacaattctatgcatataaatccatcagtgttgaagaaatgcatgatttcctcaaaaactataagctaccaaaacttacccaagacaaagtagatagcataaaaagttctgtaactattaaagaaaaagaattcatagtttaaaatcctgcaaaaaagaaatttccaggtctagacggttttactggaaaattctactaacctctcaggaaaaaatggcaccaattctcccattcattttatgaggtcaacattaccctgatattaaaaccagacaaagacagttcaataaaaaaaaaaaccctacaaaccaatatccctcatgaacctataaaccaatatccctcaatgaacatagacacaaaaatcctcagcaaaacactggcaagtctagtccagccatgtataaacagcagagtgcacaacagacaagtcatgtttgtcctggatttgcagagtctggcacaatatccaaaagtcagtgtaacccagcatattaacagactgaagaaggaaaaaaaatatgcttatatcaagtgatagagaaaaccatatgatatgattcattcatgactaaaaattaaaaactctcaactaacagagaaagaaacgtgctcaacctggtaagaatatctacaaaaaaactaaagctaacacaataccgcatcctgagaaactgttttcccctaaaataaggagcattttcacgactcctactcaaccttgggttgagtcctagacagcacctctgtacacacccagcacccagcacagaccctcaggccagggcaggaaagggccccagagagcttccccaaaacccgtgttcctggggaaggtggatgtccaggaagggtgactggcccctaaagcctaggggaagcgggggccctcctgctccagcctcatgaagctttgatctccagtgccaagcccggtgccagcagagagccaggcagatgaactcaaccagggaaaggacacccaggaaggaagcaactccatgagatcgagtctcatagcaccaagtgctcccacaggctctgaggacatggctcttattccaggaccaggcctgacaggagcacagcctgagggatgagagggcagggcagtcttctgctgggtggggaattggccaccagggccagtcccacatctgttgtggccctggcaggatcaaccctgggcctgagtccttggaggtgaggccagcacgtagtagaggggcagccgagtaagaagaacctctcggggaagtcagtggccagccagcctaagcccggcccagaccctcgccctgctagcatgagacagacacagggggcccgcactgcagagctgccccggcccacgcgcccctgccctgctgtgctccgccatctgccccagcagtgctgtgagagcatcgcaccctgcaagcctcagccttcagggacggcaagacctggggcccacaggaggtccaccggccctctcagggctcgagcacccggccaaccctgggtggccactgctcagcactccaggacagctccatgacacagaagcagctctgcccatgagcattcaacagcccggtccggggggcaccaccacgcaggggcttcccgggtcatgctgcaccatccactaatagcaccatcacgtatgccaggctgggagcccgggcgtcccaagcctgtgacctcattctctatgctcctcacggctgccccacagaatctctgaaacacgactcagacctgtcactgcctgcccaaagccctccagcggcttcccaccacatgactgccccggtccccgctgatttctccttcactcaagtgccagccgtggagatctcctctgtgtccttggcacacttcaactcagcacctgcctcagggcctttgcacctgctgctgcctccacctggaatggccttcttccagaagtccaggtcctagctccgatgcctcctcacaaggaccttggtgaagggtgtcccttctccatcacactccacactgccatcctgtcctatttttttgtaacaccatttcccaatcatcgacacgtgggttctttattgggtcactctctgccccctgaccagggatcttacgagagcaaagttgtccttgctgggtccacgtcaccagaccagtgcctggcatctcacaggcatggagttgagtacgggaggtcgccggccctcccgaggctcccttcccctacttcaggatggtgtaaggtttccttgccaaggtccctgtggtgcagagtgggccaagtttgccgccttctggagcgacaacaaggagaaaacaggggtttaagtggaggatccggtgctctgatttctccccagttagtaaagcattcaggctgctcggtggaggtgggaagacaggcgctgagagttgtctgacacaattgtcttagcagcaggagacgctgatgggatgtcgggagtcaccaggaccatctgacaaatgaccgccttggggatccgtggagctcagcggtgcccagagagagcactcgaaatgccagctggaaaggtcacgcacgccagctggaaggggagccgcgcagcccctgggcaggctgaggacaggaacgggcagccgccactgttcacgagcaagggtgcaggggcaccagagcccacaggagctcctgcaatgcgatgaccatgcctgcaggcccccataatagacagcctcattttttttttctaggcaaaactttgggaggatcctttttaattgtatttgcaaaacagtttctcccaacatgatgcccatgtgtatgtggattgggggaaattcccaaggcctctcagagaagtgcctccttcctaaggtggtgtcccagcagatgaatctggctggcgtcctgagtggaagcagggcgcgggctgccatggaaccccaccctcctgcaggttcctggcccctctgcctcctcttccttcccaccccaggggccctgggatgcagctaggccagctgggagccagacagccactgaagccctcggggtactgttccctgcctttagcatccccctcagctgcccattcattcagccattcttctaggaggacaggccaggccatggtgaggccctgggtccagggaaagatacgaagagggctgaggcgggcgttcctgcccttgggtctcttccgctgccctggcagccccgtgcctcctgactgtggactggagttctgcagctgcgccatccacaggaagctacatggagagatgggccagctcagcagagaggcgcaaacaccaattcagttgaaaactctgtgttccccgggtagaggccagttaggagccagcatgcctcccaagggttgtgcagggagacttcagccaggcacccactggggcagacccagtcccactgcttctgccttcagtggccacaggcctggggccattggtggatagagctggagaaaggccacctcttcgggacccaggtcacaggatgtccccccaaagccatcccagtcagatgtctgcagacacctgctcccctggcaacagtgacccagacctgaccttcaactctaactgtgcacagcttcctagcccggcccccaagcctgaagcctggtccctccagacactgcagaaagctggggctgactgtaatcccagcactttgggaggccaaggtggggcgggtcacgaggtcaggaaatagagaccatcgtggctaacatggtgaaaccctgtctgtactaaaaatacaaaaaaaatagccacgcatggtggcacgcaccggtaaccccagctactcaggaggctaaggcaggagaatcgcttgaacctgggaggcggagttgcagtgagccgagatcatgccattgtactccagcctgggcaacacagcaagactcagtctccaaaaaaaaaaaaaaaaaaaaaaaaaaaggctctggccctgccacttgaccgggtgggtcacctctccgtgcctcagtttcttctatttaaaatgcataggggaggagctctgagggcaaaacaccctgggtttgcctcagggcagggcaggaccctggacccagcaggcccccactgcatgtccctcctgtcctccctgccccacccctgccctctggcttctggggttcaagtcagggaggccttgggagtagcctgcggccctggggacagacaagggtgcccctgaatgtcctgtggatctgcccaggttgatgccttgactgctccttcctgtcacccaggaccctccaggagagaccaccccggactacgcctgcccagggctccctgcacgtcccatgtccccacagcgctcaggcgctgagatgctctgctgtctgctgtgggggcctgtggacggccctcctcccccaccaggctgcagctcccagcgggcagggatctaggcatgccttgctcataccacaaggcagaaacacagtgaagaaagacagagaactggtcttgttgtctttgggggctcagccccccagctccaagctggaggatcaggaggcatctacaagcctttccgaagcccccccataggctgccttgcagggtacagtatggcctagagagccccagagggctcccctggtcattaaatatctcaggatttccaggaacaaggagaggttcaagtccacagaagaatctgattggcgtctctgggccacccaccggtgctagaatcccggctggggtgagggatggtggtgcagagcctggctatgcaaaatgtggcctggagcagcctgggggcccccgggagcttgttagagatgctgaatccaggccccatccagaccagctgaactaaaacctgcattttggcaagttcccaggtggtctgatgacattgaagtctgggacacactgctctagaccttcccagggtccctcaaaggtgggtgtagaggccctactgccctgccctggggacgcagaggcatcagggccttagtcctcctggggacagtgaaagggccaccaccccagaccatggccaaactgcaggggtcagggaggcatggcccaggacagcagctcagcagggtgcccaaccccacctgcccctgcctgccccaacccacttgccggctgggtcctctggacctccgcccctttccaccccaggttggagccaaagaccaccctctccactccccagccccccaccccccaacccaccgagtgcagggcccgttgactcctatctcaacaacaacaggaaaccatttttccagacagcattatataaggggaggatgcgtatgttcagcagatgttcactctgaggccgagcctcccccgccctctgaacaggaaggccacgtccccatccctctcccccagggcctggcgctcctggcccaggtggagctggcctctggctggccacttctctggaagggcctcgtccagctctgtcctgtgcagggtcatgcccctccactctgctctctctagcccatgggcaggcgccgcctggctcagaggcacagcaatgggccagggtcagacagtggtgagcagcatgccaagaatcacagggacatccacctgccagcaaagcctcaatgacaacaaaggacctgaacagtggacactgacagggactctcctgcttgaccaaactttagtccagctcctgaaccttctccttcgcccacttccttgtaagatccagtttatcaagaactctgctaagtcatgaatgccccatctctccatatctgatcacccttgatatctggtcaggctcgtcctccccatcacccctctggtgatgtctggtcaccccagcctgtcttcagctagaatcatgttaggtgagtttagctagaatccccgacccctgatgttgctcttagtaattccccatcccctggcccctaccctgctccttggctatcaccccccactcgcccgtgctgtattcggagttgagcccagtctctctccccgactgcaagagcccactctagcggttcctgtgtctatctccatggtcctgaataaagtccgccttaccgcgctttaacaagtatcattgaatcatttttcatttaacaacactctgccttgctgaagggaaggtagaaatgacagcagtggggaggagggagaaggggcatgggaaccctgtgccgctaagggcatactctagaccctctgccccaggctaatgttagaagctgcagaggtgcaaatataacagtcagacgaccatggcagtggtcagctgaaaaatggcccccgaagacacgtccgggtcccaatccctggaacccataaatgttaccttccatggcaaaaaagaactttgtagatgcggtgagtccaaggatcctgagatggagtgactgctggattttccgggtgggcccagggatagacagaatgtttatattccccccaaattccgatgttgaaagctactcccccaaggtgatatattaggaagtggggcctttgggaggtgattatgtcaccagattccatccacacgaatgggatttgtgccccgatcagagggaccccagagagctccctcaccctttcagcatgtgaggatgcaacaagatgccttcttgaaccagggagcagaccctcaccacaaccatatgcacagcttccagaaccgtgagaaataagcttccgatgcttttaagccgctccgtttatggtatttggctatagcagcctgcatggactaagacaggccctaaatgcaatcacacttctctttatcagaggaaggcagagcaagatgagccaggcagaggagaaggccacgtacaggcagagcagagggagatggaggatgtcggccctgaagcccagagcgaagaggccacaagccaagcactgctggctgccacgaggacctggaagagcccaggacgcatcctcccctagaggctccggagggagcgcggccctgccgccacctgcgttttgccctgttgaaactgatttcagcctccagaaccgtgagaggatacaattctaatgtttcaaaccagcaagcttgtagtaatttgcaggcagcctcagaaaccaatacaatggggaactctgatatggactaaaagtggtgagagaattatggtagaagaatggggctgggaggggcagcagtgttgtcagtgagctaaaccctcctcttccagggcaggaagtcaatggacaacatcgaaacccgatacatcaagaaacagcaatagaatagcatttcaggacttcatggcaaccccagaaccagccagcagcctaaagccttaccggggctccctcctcaggagtggcctgtgaagaggggacgcacacgcattcacactcatgcacacacacacaccgagacagaggagggcctggccagagcaggggtgtcagcagaggggacgcacacgcattcacactcatgcacacactcacaccgagacagaggagggcctggccagagcaggggtgtcagcagaggggacgcacacgcattcacactcatgcacacacacacaccgagacagaggagggcctggccagagcaggggtgtcagcagaggggacgcacacgcattcacactcatgcacacactcacaccgagacagaggagggcctggccagagcaggggtgtcagcagaggggacgcacacgcattcacactcatgcacacacacacatcgagacagaggagggcctggccagagcaggggtgtcagcagaggggacgcacaagcattcacactcatgcacacacacactcacaccgagacagaggagggcctggccggagcaggggtgtcagcagagaggacgcacacgcattcacactcgtgcacacacacactcacaccgagacagaggagggcctggccagagcaggggtgtcagcagaggggacgcacaagcattcacactcatgcacacacacactcacaccgagacagaggagggcctggccggagcaggggtgtcagcagaggggacgcacacgcattcacactcgtgcacacacacactcacatcgagacagaggagggcctggccggagcaggggtgtcagcagaggggacgcacacgcattcacactcgtgcacacacacactcacaccgagacagaggagggcctggccggagcaggggtgtcagctccaggaccaggagttcccaggcagaacctgatggtggggcgggggggttcctcacacaccccacacccctgcctatgcccagacctccagcttcaggctctgcatccacacggaggcttcggattgggcgcagcctgggagcacacagaccggccagggccagggccaggactggcatttcccgggctcctggtcccatcctgcccctcccaccgggtcggccctgtccttgtcttgctcagctcgggggaagcacctctcgccagccatctggggcttggctgggcctcagcctcctggctgccacgtctcactgggagctgggcggccgccagctctgagctaagtgagcgcagaggagagtgcagggagcggcaaggccaggctcctccccaccccgtggcgtggcgtggcgtggccggaatactcagttttccctgctttttgagacaagagtagtaaatgcaccgtgctgtactcagagcccaggaagcagccctcccacccacagcgctcctgcctctgcagccccccgggccgtgtctctctctcacgggcccacatcctcactggactgtctcccttttacagatgaggtgagacagcatgcagaggcccatgtgcttgtcccacagggtgacgggccagaattacaagcccctgattctgggggcttccacgctcttccaccaagcccttgtagccttcctgcacccaggtggggctcctgtcccccgccagtgcccccaacctctactccagcagacctccacctacagacaggagtcttgggcacacacttttttgtgccaggcccaaccaagagctgcaagggacataggaatgtcccttagcatggcccgggagcctcaagcccagggcctacctagaagtaactctctttcctgacattaagcgactcccctcccagagcctaatcacagccagctacgcccccttctcccagttattcaagcctggaaggaacctggaagtggtactggattcctacacccaccccccccacaatccccaaggccccaccccggcctcctcctccccctgcccctgcatggagcaggcctcactcactctctctcttctgttcctcctgggtccctgcctcagaccctcccacctaacacagcctctgccccaccccagagggctcctcccaagacacgcgtccacgtcgccatggacaagattaaataccctggcttctggaaagcactgaggccacagttggcttctggaaagcactgaggccacagttggcttctggaaagcactgaggccacagtgctttgggaaggtcatgtcgggatcccagggctgactgcactcctgccagtgaagtgggggtgtccccaaagggggtttgtttcccaccattgggagccaggatcccaggtcaggaaacagagcttgggtgggagggaagccatctctggggactttcctcccatctcccttgtcccgctcacgaggagaagccagagctagaagctggcatgagccctcctagcaccaccagccacagtctccacctccggggacacgagctgggatctgagtggcgcaggtactacgttctagagacgccgtacccaggaccgcccatggcacgcagaggaaaactgaaacaacgatccttccagagacaaagcacagccccagatggccacaggaactggccgcccccaggagctgctgagcacaaacgccactggagagagggcttggtggctgcaccgaagagcagaacagaggaactgaacagccacagccaccgcagaactgggggatctggacagagctctcgctgtgtgctaagaaaggagcaagagacagagggcagggagaaaagctgcgagacgtgggcaagtcccagaagagagtcggggaggtgagagaaggaatatttcaaaaaacaaaattacatgaaagattccagcatggatgggttcctagaggccttatcaatacatatataagaaaaagctccatagctagacccacgataatgaaacctaagaacatcaaagacaaagagaaagttcaaaagctcccagagggaaagagcagatcagatcagtgtaaacagggaggcagcaggcagacatccaagtcccagactggggcgtgggcaccgggcagcagacgggagacaagagcccaggaagtcctgctggcaaagaattcaaaggctcttgcctggagggaagaggctgccccattccgaggccagagccaccgcagcagaggacagctgtgtccctcagaggggtcggcagggacagaggccacaccagagcagcagagatctagcaacccagaagggtgacaccctgggagatgctgagagcagcagggccctcaggagcagggctggggagtcggccacagctcagggggtcattgcatgtgggcatcccaggctcctgcctaggccccctagggctccccagccccacagaacaccctccccactcccagggatggcatttgagaccttcctgctgtgtccctccaggaacctgtgagctccaagagaacagaaggctgcctcttcaaccccagtccagcaaggcccagggcagagcaggcacggagaactgctgtcgaacatgaagtggggacgggacgcagtggtgtacacctataattccagcactttgggaggccaagaaccgcttaagtccagaagttcaagatcagcctgggcaacatagtgagaccccatctctacaaaaaataaatttaaaaaattagccaggcatggtggtgcacacctgtactttcagctactttggaggctgaggcaggaggatcccatgaaccaggaggtcaaggttgcagggagctacgattgcaccactgccttctagcccgggagagagcaagaccctgtctcaaaaaaaggaaatatatttaattttttaaaaagaatacacagtggtgagaaaggatggaaagaagagaggaaaggaaggaaaggatagggaaagaacaaaagaaggaaagaaagaaattccagctaattctcagcaacagacaattacaggaacacaaggacaaagcccagagccccaaccccacgtggcctgggtccccacagcctccagccctcctgtcactctgccagctggcagcagggccacctctgagcatccttttcctcagcactttggcgtctttcctcccagtggtttcttggtagttcctcataaatccatgcgtaggtctggctacagctatccttgtccctgaagatggactcagctagcagagtcgctgatatggtaacacaatatcacacatctcatccaagcctgctcggacgctgcccttctgaccccgattcctgtcaccaacacaacaggaaaggagcttgaagacccaggaggccacagcacagttcctcgtggagggagagagatgcgagcaggtgggcggagggtgcactcatgagacttctataagcacggacccagaggccatcccagcgacactgtgtggggactcctgcacctcttcctgctgcccagaccatgggtggccagcagcactgcagtgttggtgtaatctatgtcccccggatggccagcgggcacagagcatatgtgtgctgagggacacatgccccacacaaacgcccccacatgtgcatcgcatacatcacccacacacacacgtgtacatttcagcacgcgtctaggggaggttagcgtgccagcaccagctgagactccctggccagactcatcgccagctggggagagtggagcagacgtacaggatggagggtagaggtggggctggtccacagtgagggagggaggcaggtgtagactgggccagggaaaggttctggaaacccagactgaaggttccctggggtccctggggctcatccagggctggggtggagccgggacatgaggaacgggcagtgatgaatctgaagccctgctggtcagcagagcctccacctgcacgtcctccccaaaggtcaggcaggcttcaccctggccacgtctctaccctggccattagcaaagaggccccccttggaccaggaggaacacagcaggccagccctcctgcccttcccatccaaggctccagccactctcatggagactctgagctgagacactcccagcagaaagggtcatttatctcagagcttaactagccccttccaattagtgaggaataaaatggcagcatttactctgaagaactgcgatgcgagagtattaattaaatgcgctgccgctgagcctcagcacacaggaggctgagccctcattaaaaaggcatgagactaaagcaagacagggaggagaggcggggccagctagacaggggatggggagagaaggagatgccgggcggggcggggacagccagggacggccacagctgccctgccaggagggacagggcccactgcaaagtgggacagctgcttctagccctctcacaagaaggctggtggggaagaagccaagcacacgcagagggtgctcccgcacacccctcgcctccgtctttttggaatcttgacagttagaagacgacaagggccactgtccagtggctggcatttgtccccatgagaccacagagaggcagaggacagctccttctcagaccagggcaggtggggcaatgccaaggccccctcggctcaggatggagctgagcctccccaggatgactcccctgggggaaacactgatgtcgctgtttgagcgttgagacgttggggcctggcctctgagaggcggggccccgaagggtcttccaggaaggtcagaccccagcccaaaagcagcaggcctgggccacaaagagagctggtccctgggccagaaagccctcttccaccatgcactctgggcaaggggcgtgtgtgccattaggaacacagctgcacgctatttctctcctgtcttcctccagctgaagatttcacacagccctgttatgactgagggttcccaacagctattccctcaacacacaggcccccacacacatgcatgtgcactcatgcactcccacatgcagcatgcatgcacccacatacaaatgtccatacgcatcacatgcaccacgtgtgcactcacacgcaggcgtcacacaggcaccatgcagacgcatgcacacacacatcactcatatgtgcatctcctgtgacacatgcatcacatacacatgtccacacatgtgcactacacacaagtacacacatgcaccagaaaaatgccccatgcatgtgcatggcagacattacccacacatacacatgtgcatcggtcatacatgtgtatcatatgcaggtatcatatgtacaggcatgcagtgcacacatgcatgcatcaagcacatgcattatacatgcacacgcccacacatgtgcacacatgcatgacactcatgcactcacacatgcctcacatttgcacacatgcatcactgacgtgctcacacatcagccacacacatgcactcactcacaccctcctgctgctcccagcctcactgcctgcttgcttactttcccagttcctgccactacctgagaaggtgtttatttggccttttgcttattgtatgtctctaccacctcatcctacccctcccagccctccccatccacactcaaccagtagaatagaagcctctcccctctgttgaggcaaaaagctgtgaccctcttttcacccagaaaccacaggaagcatgcgtgcagactggactcagccttcaccagcccccgcagtcattacgcctggctccccagcacccaaacccaggtccccactggtcagcacgttcacacccagcctgccacatctccggcctggcccacagaatgcctggtcccagactcctaatgtaggaagactgccctgcctgatctcaaggcttgcttctctgcattcaggccactcctgctgcccagcctgacggctcctggagcagccggtgatcagtcaacctccccagccttctgtttgccttgcagagccagccgactcccaggagagctgtagaggctggtcagcagcctcactgtccctgccctgcctggtgagggaagggaggccacggaggaaattccctcccgctccatgtctgcctcgtgtccttctctctcctgctgtgctcctgggcagcagctccctcctccagccttccaggtctcccaatcctggccccagccacttccttgggaaccctaagcctgcctggagtccaccctcctccatttttttgggttttttttgagacggagtctcgctctgtcactcaggctggagtgcagtggcacgatcttgactcactgcgagctccacctcctgggttcacaccattttcctgcctcagcctcctgagtagctgagactacaggtgtccaccactacgcctggctaatttttttttttttttttgtatttttagtagagacgaggtttcaccattttagccaggatggtctcaatctcctgaccttgtgatccgtccacctcagcctcccaaagtgctgggattacaggcatgagccactgttcctggcccacccttctccttctgatagcacagcccctgtgtcactcaggaaccagctctcatccctgcgtcaccagtgggcaaggagggcacatgacccagcctaggccaggtagaatacgttgtcatctgactacatgaacatagctcagggatgaggacttgccacaaggtattccatgaagttaaatccaggaactattgctggaattgttggaaaggaaaagctgtttcccccgggttgttgccctgtgaggaggtaatgcagcagctgcctgcatccatttttctgcctcagagaagagcaggcctgagagtgaaatcgacacagaggagagcaaagccaagggttggggatgtgggaaaaaaaacaactgaaaatttatttgggcacctggatccagccacacctgaagctagatagttctagatatttttctttttgcagattaaccaataagtttttttttcttttttctgaagccacttttacttggatttccaacacttgaggaataacacctgactaatacactctctcttctatagcttcaaactctccatctcccggatcctcatcctcggtccctgagcaaactcaagccacctaaaatcctctgtgctcgaggcagggccacacacacatctacacaagcgcacacgtaaacactgcactcacatctaagactgcacaccctccgcagctgatgtctgccccaccgcagcatgtgtgccatgcgcaccagcttccctccactcccttgcctctcactggcccctcacctggtcagtctagcttccaccaactccccagcgaccctgcaaagccccctcttggctgctgggcctgatgccccctgccatcccaattccctgaaccccctcctcttgaacctctctcatcctttagcaggtgggcagccccgctcctaagactccactgcctcctccacttgtctgcacatggtggggggccaaggagcacttccttccccttctgcctccctcttcctttggtgcccgcccacccaccctaggatgtggaatccacagccctccatacagagcgctcccaacccgaattctacccagaccttgcccctgcacctaggacctgcatttccagctgccagactccttccaagagacagccccagtgacaaaccctctctccaagctacccttcctctctaccacccatctgtgcaagtcaaaagctggggagtgcttttcctcagcctctccctcagcccccaggcccacagacccaagtgcctggagatcccggcctctccatgtttcctgagtagattatgctgcctctattgaaagatgttccggcagaacactggatgatccagaaatatttccattatatgtggcatgggcagaggcagatcacaaagggaaggtacaatacgacccttttgtcattaagtatgtttacacatatgtgcatggacgtgggagacacacaaaaatgttgaaagctaatggcactgcagggatttccattttctccttttggcttatttctgcattctgttttatatgaaggcacatacgacagtttttaacttaaagacaggacaaaaagttgccagccatcgtgagtcaccccaggactgccggtgctgggaatgccaaaatctgatgggacccagcgcaggtggggagaggagcagaggatgcacccacggcccgtgccttctttgaatcagtcctcacggggccatctcaaggtggagactctgaaagtgcagagaagtgaaataacccgcccatggtcacacaggagggagtgcagggtccagttctccctcccccacccaggtccgcactacaggctctgatccacgccctcccttgaggacaaaccctgagccacgctgggtcctcccgcaggccctgaaatagagcttcattgccacatcagacaccgggagacgcgaggaggccgtgagccaattccagatgacttgtcaaggctgcgccagccacagagtcagggaagcctctggctgcctctgtaatataagaaccaggactgaaggcccctctgggagggcactagacgagggcctcggcagctccgcaggcaggtggggcccaggccaggcgggacagaaacccaaatgtggcgatgcaaactggacagaaagaggcctctctgggctgcggctccctcactcggggcctgacggtaccagggggagttaatctctcacacacaagctggcgccagacccctaactgcaggtgtccctaaggagaggtgcctggcaagtcctctcctgggagtggacgctctcctcctgagcacggtgtggaagcagggccgtgcccagcatgggtgcgtgaggactggatcctgcctgcagacaggactggcgggaggcagaacttgagctgcctaggactgaggccactccagagccaagactgacagtctccacaaaaccaaggagccctcacctgtctcatggctggcaggggctgcacaggaagtgacagaggcctggtgccctcgagaggcaggcaccgagccagccagtgtcagggagcaggtctgcacatctgatggaaaatccatccgtggtcccccttctgacaggcctttggctgccttcccttctaaatagctgcgaagggaaatggcctggcagaaggaaagacaatggggccccaggggcagcagtccaggagggcctgggccccccaccctccagctgtaggactcccaagctaaggacagagagaatactttggggaggagaaagaagcagacaccaggcttcgtggcaggtgtcagcatggctgagggcaggcagaacagccgccagcttgatctggacacctggtcctgccacaggccacagcacttgccaggggccgttgggacctgtcactgccctgtgggagctccctggagagttcttaacctgggctccataaactgggaaaagagaacacttcaacttcatctttactaactgggaactgaaagctgccattcccttcaactctggagagaggcagcaaccccagacttaacagcacctgcgcccgtcagggcagaaatcacaggcttcggcaactgtcagcaccgctgctgcagaccagaccaaatggtgtttacactcagcacaacttaaattatagaggctgtaagatgcactcctaggtcttattatttaatgcatcaattaaaagcacacaaaaaagttttacatgaatgttcctggcagcattattcacaagagctaaagggtggaaacaacccaatccatcaacccatgagtggatttaaaaaactgtggtacatccatgcaatggaatcatatctttccatccaaagtaatgaagctctgatgcatgctgcaacctagatgaaccttgaaaacattatgctgagtgaaagaagccagacacaaagggcaaatattgtgtgattcatttatactaatgaaatgcccagaacaggcaaatctatacaggcagaaggtaggtcagtggttgcctaggcctgggaggacggggtaattgggggttactaaagggtctggggtttcttttcagagtcttgaacatgatctaaaattgtggtgatggttgcaccattctgtgaacatactaaagccattcattgaattttacgttataagttggtaaaatacatagtatgtgaattatgtctcaataacattattatcaaaaatgtgtaaggtataataatgattaaaaattttaaaagcatgtgtatgttgatagctttatttttctctttttttttttttttgagacagagtctcactctatagccccaactggagtgcagtggtgcgatctcagctcactgcaacctccacctccagggttcaaacaattctcgtgcctcagcctcctgaatagttggaactacagatgcccgccaccacgcccggctagttccttgtattttagtagaggcagggtttcaccatgttgcccagggtggtctcaaactcctgagctcaggccatcctcctgccttggcctcccaaagtgctgggattataggcgtgaggcaccatgcctggccgatagctttatttcaatcagatttatttcctttgtattttgtagtgtacactaaacacattattttgatcaggggtccatgggcctcaccaggctggcaggagggttcacgacatggaacagctgtgctaactaccaggacagaagacaggaaggtttgctggaagaggggtgatgagaagttggccaggcctatggggttcccagcattcaggcaaaagcccagaggtcctcagggacccccccactgtctgctctgctaatgcaaagcccatgaggcccaaggagtctcagcttcttcagccacccgatcacaccccgacacacactaggccctggttccttcaagtccttaggtcattttcagattcaacttcagccaagacaaatggtcccctcctgcacctgccacaggcactgtttccaacgtgggcagagttgacagttgatgggtgtgtgtgatctttcggagctcctgtcccaggcccacaggatgaacgggaaggtggacatggtgggtagagcaagcaggaaatgatgatggtcaggaggggccttgaatgctggttctgggggcctgtgctttaccctcaaagtggaggagccatggggagcatttcgggtggggcacggaagggagaccgcgtgcttatcatgggcagctggaagggagtgggagaaacgggggcagggagaagacagggcagatgtcctggagacagaaggcaatggggacccatagctcctcctgacacatcagcctggctttcctctggggcccatcctctccccgacccactcccagagggtcagaggacagacgccagccctggagccacagcagtcctgtgacgaggcctggccagccgaagtcctgctccgctgtcctggccatagtgatttgcctgaagcatgtgacccaacctgagccagtgagaactcaccactgggctctcccagaaaccctcggggaacctgggcctctctctgccgggcggctggtgcactgcccaggcaggacccacggggagggcggctgagctgaaaccgtgcgggaggcctgggctgccgccctgagccccgcattccccctttggccccagccgcttctgccccggttttctgtcacttgcagtcacaggagtgtggacctggggatggcctgtgggagggacaggggcacaggcaccagctgcacaggtgtggatgggaggacaggagcgaggccagccgcctctgggccacaccctccggattcactcccaaaggagaacggccaggcggccaagtcctcccagctgaggggtgcggaggaagggatcagagcgctcccccaacaaaggctgcctctccgtcctgcacatcccctcgccacactgacctccatttcccttcttggggcctgcccgccacgagactcttctcccattccagactggaaatcttttccgcatcttgactaattgttttcaggtgggaaggatttggtggagaaatggcgtttgtgtgtgcgtgtgtgtgtgtgtgtgtgtgtgtgtgtgtccacccccagccgggcagctgccccaggaatgctgtattggcgggaagagctagaggacccttggcctcagccatgtcctgaggggctctcggtgatgtcagcggctcctggcctcttccagtaaacatctgttcttattctgacccaggaattccatttcagaacagtaacggcctccactggcaacacatcccaggccggtgatgcctggggcagggagagcatcctaccccggcctgtgccccgcccccggccccgccccccactcccatgcccgcccaagccccgcccacagagctctcaaaagggacaaaatctgcacctggctccgtgtgtccaagcgctttcacactgtggtccctcctagcagcgccatcaggaaaatatgatcttgtagtaacaggcccttcgctgctcagtgctggccctcgcttcatttaatcctcatcataacccaccagagtagttaccgtcatcagcttttacctttcacagatgagaaacaggaggctcgctcgcccagggagggagggagcagaaaaccaagcccacgtgttggagcgagatcgcgtctgactccagcgcacgggaccttgcaggggctgatggccaaaaactgaagtcatgggaaggagagggagagggagagggagagagaggggaggaagaaatgaccgttccaaagcccatgcagcactcatctcaaaataagagaaactctcaggtgcctacacagggagtgaatgcgcgtgaagcccgccagggtaatgatagggagcagcagagactcccaaggcacctggaactgtgggacccttctagagggttccatccttgctcagctctagccctccagcacataggcccggcagatttcctggttctcaagagaaactggaaatcttgagctttgtgagaaattttcaaacactggaaaagccaaacaaaactcatctgtgggtggacatggcccgtggcccaccagtgtgcaaactccgccctgcacaatgggaaccctgaagtgcagaaaattatctcattgtgaagggtaaggcagggactcaaaacagggctcctcagtccacattcatagagtctccaggttgtaccaccgaatctactcgccagccttctcctgaaagtgtctcactgaaccacatcccccgtagaaactcagggcatctttcaaagaccgcagttttcctgccagcctgcaaacaaccctgtgcatgcccggtgcactgctccccaaccacaggggacacctaacagaccacgagggactgagagagcctccttgactgaaagggaaggtcaaccgccgccactcatccccataaaaccacaacatgggcacatcctgcgttcgaagctctacttgatgcaagagagcagggaaaggaaagccgtgccaccgtggggaaatgggcctgggagatccattcaggccaaggtttgtccactttgggtctaccaccaccagcattcacagaagaagcagcacctggttctcaattcccttagaagcggggctagatgctctgaaggcatggttgtagctcccacacaaaattactaaagacataaaacgaaaacatgttgaaaaagaagagacaatattatgaactgcagaaagtaactgcacacgtagagaatcctcacccccaaaaacatccaaaaaaaggaaccaaataataacaaggaagttcataaaaagtctagatgcaaaataaatagagaaactcatatatctgggaacgcaaacatgggaaacatccaagcgagagatttaggtttgttttgttttgttttttgagacagagtctcgctctgtcgcccaggctggagtgcagtggtgcaagcgatctgagctcactgcaggctccgcctcccgggttcacgccattctcctgcctcagcctcccgagtagctgggactacaggcgcgcaccaccacgcccggctaattttttgtatttttagtagagacggggtttcaccgtgttagccaggatggtctcgatttcctgacctcgtgatccacccgcctcggcctcccaaagtgctgggattgcaggcgtgagccaccgcacccggcaagagatttatttcagaaggactttttgtgattatctgtggttcatatttgtgccattctagtaacagagagactgctttgctaagacatgggaagatgcaggtcattgggagcaaaggatctgaagcaggggctgttgccaggaagggcgcgccttgaggacagcaatgctggggcttgggcttgccaggtcaaccatgggtatcaagtggttcgtggcagctctgcacatgcatgtatgatttgcactaatgtgtcatttttaactctgttttctccctgggaataaagatgtctaaattctgagaatatcattagtctgaaagaagcaggtcccaggtattctgagtaaataatcacctactgtattataaattaaaagtgttcccagataacaatctggtgtaaaatataatggaaaagaccctattgacaatggcaataacattctaagtctcttagtaataaacctactgggctatgtttttaaacatctgaatcaatcttcttatttccgtgagaaaattaaacatcatgaagatgtcgttcatttgttcagcaaagatttgctgagggccttctgcaaaggggacactactttaggcatttttttaaaacctcacgatggtgatacttgccctatcagatgtcagaacatattgtcaaccaacagcaattaaagacccctggactggtgcaaaagaaaaacagaaaaggccaggcacagtggctcatgcctgcaatcccagcactttgggaggccaaggagggcggatcacgaggtcaggagatggagaccatcctggctaacacggtgaaaccccgtctctactaaaaatacaaaaaattagccgggtgtggtggcgggcgcctgtagtcccagctactcttgaggctgaagcaggagaatggcgtgaacccaggaggcagagcttgcagtgagccgagatagtgccactgcgctccagcctgggcaacagagtgagactccgtctcaaaaaaaaaaaaaaaaacaaaacaaaacccagaaaggccagaaataaaccccatatcctccatgaacttcacagatgatggaatatacattccaaagtcaagaagaaagagtgaattagcaaacgaatggtgttgagacaacagcatggcaatttagaaaaaaatgaacacttaaaaccaacaccttatacagtataagaaacacatttcacttgaattaaaggagttatatatttaaaaatcaagtcaggaaaaaagcaaaacatataatggagtatttctttgaaaggctgatacttttctacaggctgagtaaccagaagaaagcaactagagaggctgacagagctgaccgaagaaacaaaacaccagcccggcagaataaaaaaggaagctctgcaaatataaacccacccaagctagcagagggttaatgactagccccagggagaaccaatcagcttcagaggaggaaagttgggggccgtaaccaccagccattaaagaaacaagtttcaggccgggcgtggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaggaaacaagtttcaacaataacacgattgcctgactcccaccaagggtcccaggccagcccagccccagcggactcctgcaggccttggggagccaggtgggcacctgcaggcaggttgggggaaggctgtgaggactctgagcccccagagtctatcaggacaggctgacaccaagacagagacggcctacatctacccaccccataccatgcccagtcctggaccagccatccctggccccaaaggccacagcgtagtcaccacagctgagactgccccaatcagggccacctgcaatgtccagcagcctccctgcaactgccccggctttggtttttaatgtccctagtcccgagaatgcagaagctctgcaaagagaagaacgcagcaactctggcaacctgactgtggaggcagacacctggcacacatttcccctcccccagtgcccgtgatctccacccagcgctgcgcaccctccaacctccactccattcactcccagacggagcaaaggctggcctcattggccaccttgcccagcacaccacctgcacaaccttcccagcagccctgctcatcgggccaccctccccagtgaggacacagcccgtgacagcctgggcaccccaacaggaaagacagcccaaaggccaagccgccctatctgaggtggaggatgctctggcagggcagggactcagccttgaccttgtttgctagaaaatgcaccaagaactcagtagcaggccaaggagaggagacatgaattccccttttcagcaattcaccctgcttgtacaggtggggagttatctgtacctctgaggaggtacagatttcatctggtgctccagctgcagtgaaaggagctggctctgggctctgtgggacctggggtgggtcatccccatcgctgtgccctgatttcctcccagcacattgggatggctcgttgttggttcccagaatgtaccaggaaggtacaggtgcagagtgcagctgacgacgaagggcccccagccaggaagggtccccaggagtcctggctgatgaaagactctgggaaagaaaggtgggaacggggagaggacagaaggggcagggaggggagaggacataaagggagaatggagagaaaagggaaaaaggggagatgagggagaagagaagggaggggagtgggaaaaagaggaatgagaaaagaagggggaagagagaggagggaaggggaggagaagctggagggagaggagggggaagggagggagaggagggggaagggagggagaggagggggaagggagggagaggagggggaagggagggagaggagggggaagggagggagaggagggggaagggagggagaggagggggaagggagggagaggagggggaagggagggagaggagggggaagggagggagaggagggggaagggagggagaggagggggaagggagggaggggctcccagcaccaggacccagcacaaccgtcctatgacagttgtctctgcagctgcatttagggctgttctggaaactcaggccttctccctgtcggcagggctgagccctggtctgggacctccccttgttctatcagagcccccaggctgggtgaggtccactgggatctgttttcactcacaatgcttctgacaccaaacatgtggtttccctcacaccaaccagttctccaacctccagacgctagctgggtgccccacagttgagtgcaatgctcatgccaactacctggggtcagcttagccctcaggttaaggcctcagtcccacacagcagccccacttgcggtggcaagttccagctttccacctgtgcctctgaccaggcggctataaattgggcgggtcccacaactccctcctcaggttctgtaatttgctattaggttggtgcaaaagtaactgtgaccttggaatcagacagacatgtgttcattaatagaacagatcacagaactcagggaggcattttacttactatttccagttgattattaaagacacaacccaggaacagctgcatgggagggatgggcagggcaaggtaacgggaagggctgcagagcctccacgccctctctgggcactcaccctcccagaacctccacctgttcaccaacccaaagctctccaaaccttgtcatttaggggttttcatggaagttccatgactcccatccccagaggttggggaagtgaggctgaattctcaacccaacaatccagaaactcttatatcaggaacaaggggactcagaccaaatctgataataaaaggtgtttctatcacccttaacactcaggaaattacaaaggttttaggagctctgaggcaggaaccagagatgaagaacaaacatacatttataatttcccactatcacagggtctcagacagtacctcagtctgtgacccaacctgcattgccccagaagcccagacctcagctcagggccagtgtgctgggatcagtggccagtggccagccatcgtgcagagaggggagggcagaggggagggagggaggggatgggagaggaagggagggaggagtgcagagaggaagggaggggaaggaagggaaggagaggagaccaggagcctcccagggcctgggcacctgcctgggagggcactgaggagcaccaaggaggatgcctaccactgcccccaccttgccctgatcaggtctgcaggatcagtgctcaacgcccatggagctccaggtggccgccaagtgtggacagccctgcagcaaaggccagctactgccctgggagccctcacccccttatcctgcccgcttgcctgtgaggacccctccctactgtgtggccttggggatagccatgcgacggcggctgccttccttctgccggggctctgaatttccaggtgagagacccgagagcagagggccaggagccgacaccgctgtggcagcttcccgcatcccaagccgggccatgcccactggccatcgcttccttccacctcaagccccccatggaattccctttgactgaggccagccagcctcatccccctctgctccctcactgacacacaccttgtgaggcaggtggtgtcttaactgggaaaatggagggtcacaggccagcaagagaagagccaggccccaagtctggtctgtgagcccccactccccacagccctcgctagtgagcacccgtcatgctgtacaaaagactctcctgtgtagcttttgaaaagtacagaccccagggctcacgcaggtctgataaagcagaatctctcaggatggggcctatgtacagatgctgtgcaaagctcctcaaatcccatgcccatcagtgggcaggcagagagatcacacaatggaaatgctcttctgcaagacaagccacagatttggtttttttctgtttttttttttttttttttttttagacagagtctcactctgctgcttggctggagtgcagtggcgcaatttcagctcactgcaagctccgcctcctgggttcaagagattctcctgcctcagcctcccaagtagctgggactacaggcgtgtgccaccatgcccagctaatttttgtatttttaatggagatggggtttcaccatattggccaggctggtctcaaacacctgacctcaagtgatctgcccgcctcagcctcctcaagttacacaggcgtgagccactgtgccccgcctacagatttcttctaaggagggaaatgtctttgcttggaaaaacaccttctagaagcacatgggataacagataacagtgggactggaagagcaggagactctgcagacagtgccaccacctcagagcagcgggcaaagtccgctgttaagacacaggaggagaatggagggattgctccagagaaactggacagagggagggagacgccactgggagggaagaaagaacccacagatgaaagtggaaatgcccccacacatggcccaaagggctttccaagaacagggtcctgttcttccagaagtcacccgcgtggccgggaggtgctggctcccccaccttctgcaggaaggctgcccctccctacgagggcttcccatggtgcgtaaatggggactgggtttcattcctggcccagcaaagtggacagctgaggccgaggctgagaacacaaacaccccggaatcgcaacacctctggcttttggaggtgagagaagggagcgttaagagttaagacacattttatcttgatttcagctcctttactgataaaaatgggatcttagaaaacgagaattcagaggatattgccttcacatgaaatccatcttaatccacagcaagcgctgtattaagcagagaaataccgggggcgttgccgttaaagccaggcacagatgaggatgcgtgtagccacggctgtgacttaacatcgctctgaaggttccagacggtgcagattggagatgaggatccaaaattatcagtgtttacagagtgcaactgtatacctagaaaacccaagggactccacaaagatatattagaattaatgagttcaatcaagctgcttgataaaagatagttctataaaaatcagtagccttcctgtgtaccaatagatggaaagtattcaatgagcaatggcaaaaagaaaaaaaatccttgaaataatcctgatttttaaaaatggatgacctgtataaaaatatgtatatataatacttcatggtacaacatcaaagcagaatgaaataagctgaaaaaatatactatgttcctgatgaatactgtaaattatgtcaattcctcctttaattagtttctaagtttaatttactatcaatcaaattcacgagggatttttctacccgacaaaacaattctaaaattcatttgaaagaataaacatatgtgaccagccaagaaaattttgtaagagaataccagcaaagggggacgtatccagccagatgttccaaagccacacagtccaacagaaatagaactcgagctttatatgtagccatgtttttaaaaaaaaaagacacaggtgaaattaatttcagaaatatattttatttaacccagtatgcccaaaatattaccatttcaacctgtaatcaatactttaaaatgatctattaaacattccacattctttttggggggtacgaagtctctgaaatccaatgtatattttatactcagggtacctctcaattcagaccagacacattttaagtcttcaatagccttgtgtggcttatagctactgtattggacagcaaagcttcaaagtacttaatactttgactattagagccttacagttctaataataaacacagcttaatattggtacaagaacagaaagatggaaaagtagaatgtatctgcggtactgcttaacctgaggtttcatttgcaactgactggcgatggtgtactataacccataaaatagacagatgtaaatacataccaatatgctcacagctctcaagccccttttcatcatatgtccagaagctctgtcccaatcagaatggccactagcaagccttagacaagccttgcatgaaacgtgaagacaccctactttccatgtgctcccaatccctgctttcaaacagccgcgtgggagggatgggcagggcaaggtaacgggaagggctgcagagcctccacgccctctctgggcactcaccctcccagcacctcacctgttcaccaacccaaagctctccaaaccttgtcgtttaggggttttcaaaggaaaaatacccgggtgtaaagatgacaggctttaacacttggaaatacttttaatacattgaaatttcagattagggctttcaaaggaaaaatacccaggtttaaagatgaatcccggacattctgcacagagctggtgaaggctggtccccccaacacgcatctttccatttcccaacccctgaactgaggatgcaatcggcgggtctcaggccccggccctggcccccgcctcctgggccacgacacttccaacgcagtccctcactgtcaacaccctggacactcaaaatgtctttgaagagtcacgctgtgaggtcaaaaagttagggtgcacgcagaaaggcgcatgtagctttgcatcggtgaggcaaatacctatccctggaggaaggaccgctacttcgtaattcacaagaggaagacccccggaggcggacgaagccaaccgaactcagttcccgggagccgtgacaagcgacggccaggcagcagaaatggcccacccattaggctgcagacagcatcagagaaaccaagcactgtggcagtggggcccgcgcctccagggaaccacaaggcacagagttgcagtttaaatgggagtgtctcctctttcttggtggcgtataaagtaatggtgtgtcccgtaaccgatggcaccttagagctaatgatatgcagacacggccaccgctttctcacccccgggcctggggtaggcgcttgctgcacacccaccctttcactgccactgaagtgcgtgcggacagaacccatcttttgctattggaggaactaaggttctcaggatcgtggtgcttgtccaccctgccggtcacgaggagcacagcggaccatgtgacccgcaacagcctccagcccacaataggcccctgccttccctgggttaacccgtgaaatgcacaaggcagggtggggatggcgtagagcctgcctggcttcagcagcacccaggccttggtcctggacactagggttccctgtgcctctgagcggaagctgtgcaccccactctgcagccctggagtcgtcgtgcagtgtaattgaaattcatggacaagcccgaggagccagctccgggctcggtaataacttctccatattaatggcagcaccgcagaccctgtggacagctgatatttaatatgaaacatacgcagcagagtgtgcagctcctacctggatcctcccattccggggtaaccaccagtaggggatgggggtgtctaacgtggcgccaagattgagggggctggggtcctcctctcccctgagtacctcaaccccacttaaggcccctcttctacagagtgcaggaaacccctcccgagaaatacataaacacatgctggcccatgctcactcaaatgcacaccctcccatgcagacacactcatgtgcacacacgtgtacacactcattcagacgtgcacaaacatatgcacccccacacgcacactgcatgcacgtactcctacatgcaagacatgcagaggcaacatgtacatgcacacactcccgccatgcacaggcccaggacacgcacacgtccacatgcagccaccagcctgctgtgccggcagcaacacagggacccccagggctgcccaagccagagaggcaggtggggtaaagaaggacatgtctgcctgccagcacagacccagggtcccaggagggctgccatgcacacttgcctctttgggtcttcagataccacagtgggcaggcccagaccatagctcaggcagccacgaggcaaagccagcctcgctgctgagcggatgtccctggctgattcccttactcacccaggtgtggcccctgtgagcctcacagcaggcctgggtgaggacctggccttcacctcccagctgactctgcacgagggcctgaattcactcactcacccaggtgtggcccctatgagcctcacagcaggcctgggtgaggacctggccttcacctcccagctgactctgcaggagggcctgcattcactcaggcatgactcgctaagcactggagacatgggggacagggaagccacggcgagccattgggcaggagaagcctgccacacctgaatgagcacatggccgcgcacatttaccagtgccagaaacatacccagccacacaatggagtgcagctctctcagggagagctggccttgctgggctccggctgagaccagtgctgactatgccggccttcatgaggggctgggagccggctccactctgcccctccctaaaggattccaggagagacgccagcccacacagagaacctgcatatgtaactcctagagcctcggtttcctacctgtgaaatggggccacggtggctggctcacaggaaaaccgcagggactgggttcaaagccccaggcagaggtagatggtgtggatgctgctccccggaccccctcctgaggctggccgccgcctccagagggactgcgctgcactgctggatccctcaggcatctctgtaggggccctcagctcacgtaaggcagcaggggagggagtcattgccccaccctcccaggggcacctgaggggaacgctggagttctgcctcctgcagccctttctcccggagtctcattccagaccagcagagcaggcgactcaggccggagctggagggccctgaccaggtcacgggggccttgaatgccaggccagtgggtttggatgtttttaagagcagtaagaaccactgagaggtcttaagtgaaggcgtgacatgagttgctgcatggtttctaaaaatccctctggctgcagagtggagaagggttgtcggggagagaccatggggcagtggggggtacaagagcagaaagcaggggttggcaccaggcgtggagggaagccgggccctgagagagctctagaattggagctggctaggggagggcgatcctggaagggtggggtctggaggagagtggggagagccacgtgacttgagtatggggtcatccagggaagggggttccagaggcagccgagcaggcaagcctggagcccaggaggacttctaagcccaacatggggtctggagtccaggagaagggtggccacaaccgtgttcaccaccctgcacaattctcctcccttcttgtatgataggcccctcttcattccagagtttgggagtctgtccctccccctcagtcccaaaggtgggcaggagacctgggctaggcccgcatcacagccatgggtttgaagatgggcctccaatccctcccccaactctcacaggtgtcacccagagaggagggctttccatctcaaaggttgcctccttggaaaacgagttgggcctggagccgctggtgggccgggggttgaggggtggagagcaattctgaaatgaacactgagaggcagggctgagaaatggatagcatgctctgagcccctggattcagccaggcctgaagccaacactcctcaggacccccagataattggggccatgctgtcccttgtttgtttcatccaatatgagcaggggtttctgtcacttaaactgagcaagtcttaaggtgacaagtatggcggaggctgagactggccttagcagctgtgtaggctgcttgcagctggggcccacaggagcctctgctcctacctggggagccccgacaccctagggaacccagaggttcctgcagcccctctttagtcttcctgacaacctctcattgcgatccaggcagtgccaaggtggggtgggaggaaggaagaccctaccagcggcagctgcaaatctcaggtgcccctcaccccactgcacagtcccaggacccgctcacacctgcctgatctgctctagcacctgagcctgctggagcccagtgtgtggcctcgaaggcagcagccttgctgggaaaaatgaaactcatctcaatcccttaggccggcttctgacttctctctgtggcctttatgactcttaatgtccagcaagacagagtgggtgcctggcccagacagcagccccgcaggggagccccagcctgaaaggcagcagccctggatttcttcttgccatgcaaccttgggtctctctgagcctcagccacgcagtggggcagccctatctcacagggttgtggggttcgcatcaagcatccagggaagggcatacacttcctcctttgggccccaggattggaccaggccttggagggcggaccatctccaccgcccagcccatggaggcttcatccactgctgcccagcctggcaggagaggatccccgtgctgccctgagtggggaggcagaggcgggcagggttgcttccatcccacggaagtcccagctgcagtcccccaccagtgaggacttaggccacccataggagctgcagcccagcgcaggtcacgagccagtcaaggccactcagctcccaggcctgctcccggctccactcacactgacgatggtcaaacccacaatgagaacgtctccaggagtcaaataagaaaggtgggaaatgttgtaaagaaatgcatttttaaaattctttttgtaggcatgcaggaaaaggcaacaaaacatagtgagcatggccttggaatcagatttgtgttcaaatactggcttcgaagcttgaagcaagctatctcgacttttggagcctcagtttattcatctgtagaagggggatgatgtcgggatatgttccgtagggtgctgtgaggattaaacaaggcgaggtggcacagggggctcagctgagagcctggcacacaatgttaataggaacacagtcaactgtcacttaccatcattaccttttacgccaaaaggcttctcactgggtttttaatgggcatgtaaaaaccacgtgaaattagcacgcctaccacgctgcccaggagatactggaaaactcttccgcagcaacgtgaggcacaacaccactctgtgcagcctgttttgctcatgccttgtgcaaagggacattttgctgtggatactatgaataacccctcgctgtggatattattatgaataacttccgtctagtcactcaacctcccagagcctgagtgctccacctgtaaccagggatgagatgcctccccgaccagggctctgtgaggacaagaggtgccctgtgtaaagacccaggtccttagcaaagaagcctatcgtggtggcagcagagggggatttaacagtaggacagacacatacgcagcaacaaagtcagaaaaggaaagaagaggccgggcgcggtggctgaggcctgtaatcccagcactttaggaggccaagatgggcagatcgcttgaggtcgggagtttgagaccagcctgatcaaaaggaaagaaagaaagaaaaaaaggaaggaaggaaggaaggaaagagaagagaagagaaagaggacaagcgaaaagaaaagaggctgggcgcagtggctcatgcctgtaatcccagcactttaggaggccgaggcaggcagatcacaaggtcaggagattgagaccaccctggctaacacggtgaaacaccgtctctactaaaaattaaaaaaaaaataaaaaaaaattagctgcacgtggtggcaggcgcctgtagtccctgctacttgggaggctgaggcaggagaatggcgtgaacccggaaggcagagcgcttgcagtgagctgagatcgcgccactgcactccagcctgggtaatagagtgagactccgtctcaaaaaaaaaaaaaaaaaagaaaacagaaccaatggtgctgtcccactgtccaaggccattattcagtgacagcattcaatgccgctcaggcaggtcccagctcctcttccaaccccaatattcttcccagctctgtctggtacatgggacacttcagcaggcctgtcctgcccaggccaatccacacctggtacctctgcacacgctcctccctctgcccgggttgccaacctgcgtcttttccagctggccactcattcttccagcccccattcaaacagccccccaggagcacactctccaagtcctggccagagtgtccgtcagccaccctgacgacaggagccctgggtgggtaccagacctgcctcattgctgaccagtacaggggataaacatatgagaaggtgctggctgaaaaatgaatcaccaaatgaactgctgaatgaatgaaacagtgacaagtcctccccaaaatgctctccatcaggaatgcatagtacacaggtgttggcccaccaacagactgcaaccccatgtcaactcccaccaccttacctcaccctaagtccgcagcaaacatctcctttcatttaggaaattaacctccagcgtaaaatgggacacacctctgaggcccaggatgtcctcagagacagtgggcgatgtcaagggctcaccattttaacccagctcctccagggatatttacagttgtttgcaatatggccaagttctaactaaatccagccaaaggcagtgattttccaaagcaacaagtgatattttctgtgtctccataaaaagaatgacagtggttgcagagccctggtgtaattgccggctctgcagactgtaggatgagcctcagctgcccgagtacgggcgtgctcaggggccacgggggctgggagagtggccactcactcggggcaggagttccctgagtagcaattagagcggaacccatggtgggcggcttcagatgtctggccagcacagccagcctgaccaccacacacccaatccaaaatagaaaactgcagtggcctctgctgtgtgccaggccccgggcagccggacagagcaccgccaatgtcagcctcctccctcagcatcgatccaggcttcctctgaggcccccttgtgctgagccacggtccctcctgccctctccaggaagcagagcttcccagagctccagtcacaggactagagaggcgcaggcagtctcaaaagggatcccctagcctctctcttgtccttcaggcgctgcccccaaaagatcgagcagctcatgggcactagagccttcatttccaaatgcacccctcagctcaaaatagagaaaaccaacttttcaaagaaccagctggagttcaacaggaaaccacagcagaaaaaccaatgattcccggtcagccaaggggcagagggctaactgggcatttcagcatcactgccagctccctgggctggtattacccgcacgcaaggaaacaggaagactgactgccagcccataagtccaccacacacatatcacgccagtatgcacaaggacggacacaaactcaacagatgctcaacacactgatgtgcagaaacccagacacatacgtgcacaagagacactggcacacgcacatgttcacacaggtgcacgggcacccagatgcaggtacacaccaacgttccacaacacatgtgcacacactcacaaaggtacacacacatacacggacccacccccggatgcaagccagagacctgttcaggcaggcaaaagagagaggcgcacgctcctgcctgctgagccttttggagacccgggcgctccccatgcataaatggccccctgctcagaccagtcaaaacaacctgctttccagccaagcccttcagttggagcacgaggctcactaaagcacgggaagggcgcggaaagtcctcagcgcaggccttgccctcccaagggactcccaggtaacccttttccaaaacccaggcgagagcagcggagagaaaggagctagagaagtgcgtactcaccagcccatcgcagttgctgagcgccacagaggaggcttcggctaggccggccacgtctccgacgtagagacagctcccgagcaggggctccacgcgggtggtgcccttctcgccctgccactccatagtggccccgggcgccacgaggcgggcgttgggccgcagccgcaggtgcaggtctcggccaaagaccgtgacattgtagaagaggtgactgccaggctcctcctcgttgcctccggggaagctcggggtccggaccggggcggccctgcgggctcgtacccctgctctggacgtagctgccgacaccacgtgggacaccaagcggccctgggcgtcagtgcgcacgggcaccgccaggatgcgctccgctccgtgccccaggggcccgcctgcaacgggaaggggcgttagatcggcggagaccacggagccccagtgcctcagagacccgccggcaagccacgcccccccagaccccgccccactgcgaagggaaggggcattccgccaggcgaccccagaagccagcctgcacctccccggctttcctgcaaccgggaaggggcgttaacagggccaccactccggggctccgccactccccagccgttccctcctcc

SEQ ID NO: 14 - DNA, 3149 bp, Homo sapiens
cggagaatgggcctaacctcacggagaatggggccatcagatacaccaaagcagacgctcggtggtcccaaccacctctcataacactttcccaaacttaagacgcacatgtccacgccaatgtattatcataggcccttccccccctcttaaagcctcccacgaagtctgaacctggtactgatatacgcttcagccctcagaaggcaaccgcttgattctctgcgcaggcgcagcgttctcaacaccgccaacgggcacaaagccacgcccccacggccgaactcacgcctacgtactcagtcaccagcggaaccctctccaccaggctccgcgtcgaggccctacggggcgtcaatacgcacgcgtactttgtgtcccaggtagctcgtctcttagccatgtacgcctctgcattccggtcactgggagcggggccgtgggggctgcacatgcgcactgcgagtcctcgcctactcccagaaaccacccgggcgcatacgcggtgcggccgctgcttcaggtcggcgggctccagggagacctgggtgggcagcgtcgccgtttctcctttcttgggcagtatttttcccagcgccacgcggaggctgggccattatgaggtttgtgttgcgtcggggcggtccgtctcagaggcgctccggggaggagtgggcggctgaatggccagaggcccagggatccgttcaggtcagcgctggcgtccgggcctgagtttggaggtggcgggtgccttacaagaatgctcgcgtgatcagtgtgttggcgtttgtgtacacagaggacattattaaaattactctttgtgtgaatggttctatcccagagtaggccactggggcattgaaaaaagcccagttacatttttaggaaccagagctgcacgctaaactgttttcttttgacagtgaaatctgtcgtttttggagtttgttaggaacatggttgaaaatgggtggcagtgggttcgagaatctcgtctttgaagttttcttccttctccttagctctgcatttccaggacctggtcactattcaggacacggttccagcgcagtgcgcgttagccatgtctcaggtaagtttttgtcctgcaacatcataggttttaagtcctgggcacatctaattttgcttacttgggtggtaaagactgacaccggtacaaggctcaggtcttttcattcagcaacacgtgggactatagcaacctctcttctcagagtccatgtcctgtactttagtgttcatttattcactgaatgaattaatctgagtctccactgtcaccagtcttcttttaagcactgtgtggtgggtcagagatacattccctggagaagacaagagcctttatccggggactgtcgtcttcctgaagtaggggtgaatactcagtcatctttgaattcctttacagctccagactgagaggacgcagcatagaaaatgcttatgagtggttcagactcagtaatggtaatctgcctttggaaattttggggaatgggaatgtgattgatatcttaagcatgaaagtccaggttaacaaagtcaggccatttactaggacattagtgaaagagagtgttgtggatcacaggttccagtttgacgttgggcagcttaaagtcacaggcttcatctgtggaattccggaaaatacctattggctttctgtaaatgaggaacaagaagtatgctgcaagggagaagatggatgagctggctatatttcccaaaaaagggttctcttcagggtgtttgcatggtctctgaaattttgtgcaaatacaaccagatttgattcttagcccgctaaatgtagtcaccaagacattttgtttgaaaaatagattttcttctcaaaggggaaacttacattttcttttagggaaacaggcagtattttccctacacattctgtttgttatgatgactcaagctgttcatgaagttgttaaattatatttatgtattttaaaagaaaagttgttaaaaaaatttcaaccgtcatataacaaccatgcagaaaaaaacatttttaccactttattgtttctgtattttgatgtgaagtatttgagcttaaggctttttttaaccaccagttcttatcccatttcctccatacttccaatgcttccttaactctgttgatattttcaccatcaagatagatttccatcacttctgcaagtatttttcatgtagttttccctgccctggccctcagaggaaactaatttcttgttttgatgacagtggatttgttttgcttggcttcacgtaaatggagtcaagtagtcagtaggtgtgtgtctggcttcattaactcaacataatgattttaatgttcattaatgtccattatttgttgttgttttgctgagtattccattgtgttaatatattacagtctacttactcattttcctgttgatagacatttgggatgtttctagatttttggctattattagtaaaactgctatgaatattattgtgtaggctgagtatcccttatccaaaattcctgggaccagaagtatttcagattttggattttttttgttttgttttggaatatttgcattatacctactggttgcgcaacccaaatctgaaatccaaaatgttccatgagcatttcttttgactattacatcaacacttaaaaagttttggattttgaagcatttcagattagggatattcaacctgtatatgtctttttgtgatcttttagaagatgtagtggtagaaaaaatactggcatctgggcacagtggcgcacacctgtagtcccagcaacttgggaagctgaggcaggaggatcacttcagcccagcatttcagcaccatagtgcagcacgatcacacctgtgaatagccactgcattccagcctgggcaacataacaagactgctgtctcttaaaagaaagaaaatactggcatttgaagaatatcaagaaaaaatattcatttaaaatattgtagtctgcctcatttatggtgacagaattcaggatagcaagaggtgtgtcttgaagcaatcttggggaatcttggaggtgttggtaatattcagtttcttgatcggggatctgctgatgggtgtattgc

SEQ ID NO: 15 - DNA, 1345 bp, Homo sapiens
cggggaccatttccattttgttaaggggctgaacgcggttcaagcctagcagattggttccaaaaacgtcgtgttattcactgcctctgatcagtgacattcccatttgcagctgaaagaggtattaattcgccagagtcacaacacggtcggggttcctcgtcgctgtcttattccaaaataagcttaacacagaaagataatgacactcccacggactggcacagaaggccgcgctccgaatgacatcgcgatcacagaggcacagacagcgtcacaaagccccacgcgtactcacaccgaaggctcagccgtcgcgcgtttccctcccaggccccaggaactagtaactagggacgcttctggtctctaggcgaggagagggggagagcgcaatctttgcgcctgcgcacactcctgctcttacccgccggaaccctgggccacgcccggctcgcgtaatcacgcactgcgcaggcaccgcccgctctgctctaaggtccctctcactccttcagcagcccgaggacaatcccctcaacactaggccacgccttgtctccgcccctctcgtccgacccctggagagaggctggcgcctgcgcgatggggggttccagcgtcgactcacggagtccttcggatgagagcgtctgggtgccagacgaggccgggggtttgttttgggtggtttgggagtccgagctcgagggctgggccaggaagggcaggcgaggcgggcggctccgacgcgggtcgcgaaggcccagccgcgtcctctgtccccaggacgactacatttcccagaggccagcggggcgcgcgtactcgagtctgcggggcggaggccgcggctcggggctgctgggcgttcggggcggcttggggcggcgggaccactggagtgagctgtgggagagatgggggtgtgcctgtgtgtaaaagatctgtcagagtgtgaggctccgtgagagggtgtggtttctgtgtgtgtgtgtgtgtgtgtgtgacagaccgagagtccagtgtgagaccagggtatgttcgtgtgtgacagagcgagacgggccagtgtgagagaccagtgagtgtgagagagatagggatgtgcctgcatttgaaagagagcgtgtgaagctcagtgagaggttgcgaggtgtgtgggtgtgtaagtgtgtaacagaccaggtgtccagagcgtgagaccaggatgtattcgtgtgagagagtgagacgggctggatggagtgtgagagaccagtgagtgtgagagatgggcgtgtgcctgtgtgtgaaaggccggtcggtcggtgggtgaggctcaatgagaggccggtgtgtgttc

SEQ ID NO: 16 - DNA, 27815 bp, Homo sapiens
cgtgtctgaagactatggaagcttgtcaaaggggtaaccctacaactcctgtcactttaacaatggtccacagcaatgcttttcccccatttctactaggctaggccattgcacaataccttaagctacttaaaagagttttaatacgttataaatacgtacatatttgtccttctagtttgttaccatccttccctgaaagagcggagctgtttataggaagcacaacatttgagtcccattcactgctgtttgtattacattttcacaaagcctgctttgaaagctggcaaacactgcaagttacatgttaccatattacacatgggaggacccatacacattgttatttttaaatttaacattgaacaaaaaaaaggaggaatcacttaacttggaaacaaaacaccaaagttagtcagtggaatggtcaagagcaggacaagcctgccagggccactgaactccagtcacaagtggtcaaaagtatgaccgagaacaactggatgcaggaacatcagcacaaaatacagatgggaatattctcgggagtggtacatcaccatcttgtatgtgagggatattgtgtcagaggggaattacactttcaaaataaccagggctagtaggtcattagtaccagatggggaacagcaatggtgtggcatgccttgtttaaggcctgcgctggtttatctaaaagtagatttctgaaaagattgtccagtagcatcagaaagagccactttcagaggaaggactccttgttcacccacatcagactgcgtgtctcgttgggcttgcattcatactcaatgacagagaaggggcttccccactggcagtgatcccgcttgtggtaattgtagaacttgacttgccacactgtctcgaaggtcccaatgtctgtgaactgagggaagagaaacatgcctgataaaaaacctcattctgccacgagcaatagatgagagctaacattagtgatgtagctcctggataatcaagcagacccagtccagattctcttggtctgcaaggctcggaaggctttcctttagtggtctagctccctcctttatgatgggagatattttcctaaaaagctgtctgtaaaccattcttctctataaaatctgattcccattgcaaacgtgccactcgctatcatattgcttttaataaaaataactgcaaagtttatcttgtttttcaagtttaattttttgaaaacttagaattttaaagcttactctaaaatggcccctgctggccaggtgcagtggttcacccctgtaatcccaggctgaggcaggatgctagcttgaagccaggggttccagaatagcctgaacaacaaagcaagattctgtctctaaaacaaacccccatgttcatcccccaaatggtccctgctacagaaggggaatggcgaagggaagagaaggaataaagtttactggcttttctcaaaatacaatggtacaaaacaacctgtctacaatacatctacataaaatttccatcattagtttcaattccaaagaaaaatatttcaaagtgataactgaaaatatttcattggaagtgttaaaggccatattttaactattaaacattgaatacttataagtcaggagtccatgcctacatcttgggcttagattatacattacccagaaccatatttgagtatctgctatgtaccttgcatgtataaaaattcgtataaggcaggattgttgctcttaagaagttagcattctacttccagaaggtaggccctgtaaatcactgcacagaactctcctgaggtataaagtacacatttctcttgcagctgagaagagtacctggaataccctggaggccactgggcagatgctcaagtggcctgtggggtagcctgaccctgctactgccttctggagctatttaggggatctggcattaaactgcatgatgcctgtcgttattttctcctctgaccctcccctgtcatgggaggggacagggactgacttggcaggactcttagacttgtctggagccagaagacgtggacagaggaaggcagtgagcattaggagtcttatgcttcttgctgatacaggaggagggtgatcaggtgctttccagatagctttccaagatgctctcaaaattatatcttgcaccattgcctcatcctgctaatttgatcccaaaacaagatctaggctttcctctgggaaatttgcttgatttgaaatagtggatgatatacctagagtccacagacctcccaggtatgaaagtggattacctctttttagagagtcatggcttaaagacctatataagcatacagcagctttattcacaatagccccaggttggaattgacccaaatgtttattcacatgttgataagcaagttttggtatatttataaaatggccttttgctgaacaataaaggaagacatgctgattcaagcagcaacagggatggatctcaaagacatgctaagcaaaataatctaggcccccaaagtacatgctgtatgaatccatctatatagtgacagaatgtaacctacactgacaggaaacatctgtggttatctagagcctagggtgagaaggggaactgatgcaaatgtgcaagagggaactttttaggggtgatggaagcattctgtatcttgattgggatggtggttacatggctgtacatatatgttggtcaaaactaattgaactgtatgcttaagatgagtccatttattacatgtaaactatacctcaaagttaagaaaaatagaaatatccatttttagtgagctataagaaaacaggtattctaaatgctgctaatgggaattgaattagccttttggaaggatcatttgcatgaagttaaaggtgtgagtacattcaggcccagcaattccatttataatttatcttaagaacatcacaaagtttagagtagtaaacaatgcaacactaaaggtccatctttaaggcactatttgtggcatatctatataatggaataccatgtaatatttttaaatgtaaagtatttaatacagtttttattttatattgttacatgaactaagcagaataccatgaagaacatgaagtattaattcagttaaaattaaacttggctaggtgcagcagctcacacctgtaattccagcactttggaaggccaagatgagaggatcgcttgagaccaggagtttgagactagcctgggcaacatagtgagaccctgcctctacaaaaaatgtttgaaaattagctgggtgtggtggcacacactgtgagactgagataggaggattgcttgagcccaggagtttgaggctgcagtgagctataatcatgctactgcattccagcctgggcaataaagaccctgtctcaaaaaaaaaatgtatgtgtatatatgtgtatgtgtgtgtgtgtgtgtatttaatgttagaaatcctgatggactgttttattttctcctatgttctttttttaatttttattatatttttgagatggagtctagctctgtcgcccaaggttggagtgcagcagcacgatctcggctcactgcaacctctgctgcccgggttcaagcaattctcctgcctcagcctcctgagtagctgggattacaggtgtgtgccactacgcctggctaattttttttgtatttttagtagagacggggtttcaccatgttggccagtctggtcttgaactcctgacctcgtgatccacccacctcggcctcccaaagtgctggcgtgagccaccacacccggcccaacttctatattttttagcagagacgcggtttaaccatgttgcccaggctggtcttgaactcctgacctcaagtgatccaccagcctcggcctctcaaagcgctgggattacaggcatgaaccactgcacctagcagattttcttctatattcttatttgtattttcaaaatttaacgattactttaccagaaaaaaaattaaaccaaaactgtatttcccaaaagtattaccaaatagtcattatccttaatataaaggaccatatgcattattagtaagtactacgaggaacattggaataaaaaattggaatggttcattaaaaacaaaacaaaacaaagcaaaaaccataggctgggcgcagtggctcatgcctgtaatgccagcactttgggaggccaacatagtagtaccacttgaacccagaagtttaagaccagcttagacaacatggtgaaaccctgtcactacaaaaaattaaaaacattagctgggcatgggagtgtgtgtctgtagtcccagatactcaggaggctgaggtgaaaggatcgcttgagctcaggaggcagaggttgcagtgagctgagatcttgccactgcattttagcctgggcaacagggcaagacactgtctcaaaaaaaaaaaaaaaaaaaaaaaaaaaaaaaaggaaaaaatgactaacacctgcaaaaatattcaaatgtaattagtaattaaagaaatataaacttttaaagagatactattcctctaacaacttagtgacaatttctgagtgccagaaacaatctaagcatccaacattaggaaaatatgaaaatggtggcatatccatatgataaacttacagagcaattaggaatttagggttgtcgatgattcaaggaaatgcttagaacaatgtttaaaggaagatgaattggaatggtttatatacattatgagctcaaatatgtaaaataagatgtatagaaaaaatgaaaaatattaccttctaagtaaagaaattgaatttttctatccttactcagattttttctacaataaatgttacttttaaaatcagaaattttttaaatggtgaaatggatttatcatcttacaataatatatacagcctgcaagcctaagggattttataaattctattaaaaatatgtacattctaatgaaattatgactttgttcacaataggttagtggtggtatgtataaatcaaaatctcattttataatttaccaagacttttaaagaggatttagtattatttttgaccagcacaaggcattgcacactttaagtgcaactgaattttacaattcaattaacattttaattccaaattataaaaatattttgtaataaaatatacactgaaatataaactttatactaaaaatattttataatacttttcaaatgccagctaatattttgaaggaagcagcttaaaatcatgctaggtaacagagaaacaacactgagatttttattttttgaaataaaagttggttataaaaataaaaagcccaccaagctgattacaaccagacaagaaaaacgtaaggcttatgtctaaaaaaattttcaaaagtctcaatctaagaattctcagtaacaaaggagaccaaagttaaaatctgccaatagcaacagtcatagctaaagatatatttaagtgttcatattaatatttcaaatttggtttattaatgtgggacctaaggtcacgttgaagtaaatgtaactgctggtaactatgcatatgtcttcctctccccgatgccttagctgtttatacttctcattagccgtcttcctattctttcttttggagctctatttcctgggcctcttactacctagctcataatttcttcttgtctggctagaaacagatggggtcttgaaagctgacattcttcttaaagaacaggaacaattatacaggctcttcactccctccccgcccatctgtcccttctaaggagaatgtacccaggcaggctcctgggtggtacaatttatgcacaggtataattctgtatatttgtatagcaccctattttatgtgatactttcacatacatcattccactttagtcttgtgcctggttttattatctccagtttatggacaaaaaaactaagattcagagaggttagatgatttgccctcagtctagactccaaagccagccaatgataggagcaggacaagaacctaggtctcctaattcctagcttaggagctatttatcactgtacaaaactgctgatataaatggttatagtggacagtttttttttctccctgaatgagaaattacatgagttgtcacaggtagaatgctttagggcattgctatggactgaatgtttatgccctcctccaaccccaattcatgtggtgaagcctaaatcctaactgtaatggtatttggaggtagggcctttgggaagtatgagggtcatgagggtggagcccacatgaatgggttcagtgccctcataaggtacatgagaaagatgatctcttcttctgccgtatgaggatacatcaagaaagtgtctatggaccaaaaagagggtcctcaccagactactgccttgatgtttggtcttcccagcttccagaactctgagaaatagatgtttgttgtttcatccatccaatctatggcattttgttttagcagccccagcggagacaacactctacctggacattttatttgctgtaatgttcttacgagttgcaagcctggtccactttttacttcacaactaatgtggaagagaacacatctgattccaaggagaggagactcatctcttgtcctcaataacaaatgaggaatctgaagagcttgttttaaacaattttggtggtcttacaacccactggcatagaatctcgagtgtacttctttctattcaccatgccacctacttctactgcagacatgaaattaatcaagatcacgtagaaatccattggcttgggaggacagaacaatcttattcatagaaacatgatgttactttattagtaaacaaattcagtataaatatgcatctgtgacttttagtgtggtgtgacctatcaatttccactgaatttcaagcctttctattcctgaattgtttgaggttttattagtaaatgtttcccatttctcttcactaaataggactaaaagttctaggtcttataaagtacatttgtctttataagcaactgttaaacttttcctaagtgattgtgcccatgttatattctcaccagcaatgagaatttcaattgctctatatcctctccaacacttggcattgccagtcctttcaattttagccagtctggtgactatatagtgataagacaaagaaaggaaatcaagaggccgggtgcagtggctcatgctggcaatcccagcattttgggaggccaaggcaggtggatcacaaggtcaggagttcaagaccagcctggctgagattgtgaaaccccatctctagtaaaaatacaaaaattagccgggcgtggtggtgggtgcctgtaatcccagctactctggaggctgaggcaggagaattgcttgaacctggaaaacggaggttgcagtgagctgagatcacaccattgcactccagcctgggcatcagagcaagactctgcctcaaaaaaataaaaaaagaaaaaagaaaaaagaaacagcagaaatcaatgaattagaaaagaaagactatagagaaaacaatgaaactaaaatctagtttttttgaaaatatctttaaaattgataaacccctaacaaaactgagcaagaaaaaatacaaatattaggaatgaaaaagaggacatcaccatggatcctacagaccttaaattaggaaaaccttatactaataatttcaacaaaatggacaagttcttccttgaaagacacaaactatgagttgacatctacctaatgaggaaattgaatttgtagttaaaaatctctcaggcccaaatggctgcattgataaattcagacatataaggggaaaaagccaccaattccacataaattctttcagacagcagacagaacagttctcaaataattttatgtagccaatattgccctaattcctgacaaaaatattacaagagaaattacagacagattcctcatgggcatatacgtaaaatttgtttataatttttatttgcttgaagtattggtaaatcaaatctagcaatatatactgagaataatatatcaaaaccaacagggatttatcttctgaattcataagtggttcaacatttgaaaatctaccatattaacagaataaaggagaaaaaccatataattatatccatagttggagaaagagcacctgacagtgcatcattgattctattctcagcaaaggaaagtttttcaacttcattaaggggcattgacaaaaaacctatagctaactttatccttaatggcaaaagaccgagtggtttccctgtcagatgggaaacaaggcaagaatatgtgttcttactgcccctattcagcattgcattccaggtcttagccagtaccttaaggcaagaggaagaaaagggcggtggggagagtaaaacggtctatccagtgaacaactgtgtccgctaaaaatactaagcaattgcctggtgaggtggctcatgcctgtaatcccagcactttgggaggccgaggcgggtggatcaagaggtcaggagatcgagaccatcctggctaacacagtgaaaccccgtctctactaaaaatacaaaaaaattggcccagcgtggtggcaggcacctgtagtcccagctacttgggaggctgaggcaggagaatggcgtgaacccgggaggcggagcttgcagtgagccgagtttgcgccactgcactccagagcctgggcgacagagcgagtctccgtctcaaaaaaaaaaaaaaaaaaaaaaatactaagcaaccttaacaaatagccagtagaataagtgaatttagcaaggcttcaggatacaatattaacttataaaattcatatttcataaagaaatatgccagccctgaacaattatctttattatttcaccaattttacatgaaagttgacattgtattacttaccaatagtgagataaaaccatttttcatatatttattggccacttgtatttcttttataaattgcctatttatatcttttgcttaatttcctacatcttatgattatctcttacacatttctaataatttgttgtataaagtcacagctttcaccaaatactagaccagacagctgtcacgaggaccaacttctatatttggaaggctatttccctccactcacacatactcagcctcattaccacctcatatacctccctgccttcttcctccaaactctcaccagtctcccagtgaagagggccaacaaaagggattatgatgatgattcgtgcagacagactctctatctggcctttctccttggagggactgattgggaattagtcacactgctctgtgaaatggggtttgagaggcataaagttgggtgtcactttattagctcccagtaccagggcctctagaattatctgaagatcattgccattaatctaagtcagatggcatttgactatttcctgacttcagtggccactcacagcttcagcaggcagtaaagggctgtgaaatgtcattgacagtagctgcagtgtcactatgggcagtggcaaatcaaggcaacacagcttaggagactatacatgttatcaatgattttttcaccagttcactttgaagtgtgatatcagaaaagaacagtaacgtttcccccaaatagccagttatcccagaatcatttattcaatgatttgaaaaactttttttttttttttttttttgagacggagtctccctgtcgcccaggctggagtgcagtggtgcgatctcggctcactgcaggctccgccccccggggttcacgccattctcctgcctcagcctcccgagtagctgggactacaggcgcccgctacctcgcccggctaattttttgtatttttagtagagacggggtttcactgtgttagccaggatggtctcgatctcctgacttcgtgatccacccgccttggcccccaaagtgctgggattacaggcgtgagtcaccgcgcccggccgaaaaacattttaaactacttggtatcaactttggactcttaagcaagactcaaaagacaataatagctaggatatgtcatcagagttgaaaggaaatattatcttaaagcagaactgcaaatactaaaattgccagaattttaatgaggtcttagagggctaataagctacctttcacttaaaatatcctgagcactgggtaagtgtggagaaggtcatcataaatgagactgtttcctctcttccaagtactcagagggcagagaggagacctccccaactcctctctggagctgacctggcttggggagacctgagctgtaatttcctgttcacctcctcatgctactactgctccctctgggcctctggtcttagcaggttggattcacacttcttttgctttagatgtaaacagaacactaggaaagaagattaattcaaacagtttcaaaagcactcgattcaaaacttcttcctatttggatctgtaaagtaagaatttctatatctttttgaatagctgaagcacagggtcttcttctgttttaatgtgaaaatgattcagacttagtcattaaaacaaagatgttattacctaccataagtcttatttgcctgtccaggcatccattaaaaggttggagagtccaggcgcggttgctcacccctgtaatcccaggactttgggaagccaaggcaggcagaccacctgaggtcaggagtttgagaccagcttggcaaacatggtgaaaccctgtctctactaaaaatacaaaaaattagctgggtatggtggtgcatgcctgtaattccagctacttggaggctgaggcatgataattgcttgaacctgggaggcagaggctgcagtgagccaagatcacaccactgcactccagactgggcgacagagcaagactgtctaaaaacaaacaaaaaaaacaaacaaaaaagccagccaggtgcagggggtgcatgcctgtaatcccagcactttgggatgctgcagcaggcagataacctgagttcaggagttcaagaccagcctggccaacatggtgaaaaccctgtctctacttgaaaaaaaaaaaaaatacaaaaattagatgggtgtgttggtgggtgcctataatcccagctactcaggaggctgaggcagggagaattgcttgaacctaggaggtggagtttgcagtgagccaagatcacgccactgcactctggtctgggtgacagagtgagactccatctcaaaaaaaaaataaagttggagagccttagcttagttactagatgatttgaaggtatgttttaagaaaaaggtctgcggtccctaactgtaactcgtgaatccagcagtaaaggctaggtttctatatgtgaattttcacatctagaagcagcagctgattgacagttgattgttccccaccatgatcacataggttttggtttgagcactggtcatctggttgtcttttttttttttttgagacagagtctcgctctgtcacccaggccggagcagtggtgcgatctcagcttactgcaagctccgcctccaaggttcatgccattctcctgcctcaacctcccaagtagctgggactacaggcgtgtttgtatcttatttctaataggctgataataaagaaaatgattgaaaatataggttttctgatcaagtcaccagctcctatattaagttcaaatttttattctagtcttgaagctttcagatagccaacacaatccaatgacattttaaagtcaccaacatttcaaacttatgtattaaaaaatatagacactgggccgggtgcagcagctcacgcctataatcccaccactttgcgaagccgaggggtgtggatcacctgaggttcggagtttgagaccagcctgacaaacacggagaaaccctgtttctattaaaaatacaaaattagccgggcatggtggcacatgcctgcaatcccagctacttgggaggctgaggcaggagaattgcttgaacccgggaggcagaggttgcggtgagccgagattgcgccatcgtactccagcctgggcaacaagagtgaaactccgtctcaaaaaaaaaaaaaaaatatatatatatatatgtgtgtgtgtgtgtgtgtgtgtgtgtgtgtgtgtgtgtacatataaaacatatataatatatatttaaatatatatagacaccacactctcatggacaattgtgaaaacttgacatgtccaagtaaatccaatcaattaattagcaagtccctggattattcagatttcgtcaagggaaatgtcatcagtgtgggtgcctaagtcaagtcagaaatgtcagaattaaaactggaagtaggccgggggcggtggctcacgcctgtaatcccagcactttgggaggccaaggcgggcagttcacgaggtcaggagattgagaccatcctggctaacacggtgaaaccccgtctctactaaaaatacaaaagaattagctgggcatggtggcgagcacctgtagtcccatctactcgggaggctgaggcaggagaatggcatgaacccgggaggcggagcttgcagtaagccgagatggcaccactgcactgcagcctgggcgtcagagaaagactcttccaaaaaaaaaaaaaaaacacacacacacacacctggcagtaaagaagatattaaggctgggcacggtagctcatgcctgtcatcccagcactttgggaggccgagacaggagaaccacttgaggccaggagttcaagaccagactgagcaacatagcaagaccttgtctctactaaatataaaaaggttttgctgggtatggtggtgcgtgcctctggtcccagctactagagaggctgaggtaggaggatcagttgccagaggtcaaggctgcagtgagctagaatcatgccacttcattgcagcctgggcagcagagaccccacctctacaaaaaaaaaaaaaaaaaaaaaaaaaaattagctgggtgtgggtggtacgtagtggtagtcctagctactcagcaggctgaggtgggagaaccgcttgagtctgggaggtcaaggctgcagtgagctatgattgtgctgctgtactccagcctgggtaacagtgagataacagcctggtaatagtgagatcctatctcaaaaaaaaaaaaaaaaggaaaaaaaagagtaccaggatactgtttacctctaattaactgtgtgatcctagacatatctgaactcgtcaggcctgagttttcaatgaaaagtgtattccactatctaatctctaaggccacttttagctctatcatggtataaagattacaaatggcgaccaggcacagtggctcacgccagtaatcccagcgttttgggaggccaaggtgggaggatcacctgaggtcaggagtttgagaccagcctgtccaatgtggtgaaaccctgtctctactgaaaatacaaaacttagctgggcgtggtggcgggtgcctgtaatcccagctactcgggaggctgaggcaggagaatcgcttgaacctgggaagtggaggttgcagtgagccgagattgcaccattgtaccacagcatgggtgacagagcaagactccattaaaaaaaaaaaaaaaaattacaaacttacccttaagggtattgcattatgtattttttgaagaaagtcagattctcgaatactgtcatttacaatcacaccaaacaggacagaaggccattcaagtacctgtagaattcctttttggttgggcacagaggggaaggctaggaatgtgtcccagcatcttagatgatttgcatgattttaaaaagtgaaataagattcataaatttgagcaaatttttaaagtggcagtaatccttacattttgattcagttgattttcagatccccttcacatatacgtattttacagttgcaattatttaacattaaatgttatacaattgtatatattgtctaactacatatcattgttacaattttgtcaaaatgttatacaattgtatatattgtcaaactattgttacaattttgtcaaaatgttatacaattgtatgtattgtctaactacatattctttgctacaattttgtcaaaatgtataggattgtatatattgtctaactacatatcgttacaattttgtccttgtttgttgaggcaggatcactctgtggcccaggctggagtatagtggtttgatcatagctcactgcagccttgaatgcctgggctggagtaaccctcccacctcagtctctggagtagctgagactacaggcatatgtcaccacgcctggctcattttttattttttattttgtagaaataggattttgctatattgctcaggctagtcttgaactcctgcccacatgcgatcctcttgccttgtcctcccaaagtggtggatttataggtgtgagccactgtgcctggcctcattgttccaattttaatgatgacataggactcttatcgtgatgtatcatgacaattagactactccccagatgttagatatgtcagttgccctctaacaaaaagtgctttaataaataattttgtatatatgtctactttaataggagtggaattatttggtcaaaagaaatgaatctctatggctgttcccacatatgaccattttgctccttttaaagtatacaaacaatcttacaatgttaacagcaaagaaggcattgtttagaaaaatgatatcattgggccaggtgtggtggctcacccctgtaatcccagtactttgggaggctgaggtgagaggattgcttgagcgcaggagtttgagatgagcctgggcaacatagtgagactccatctccacaaaaaatttaaaaattggcttggcgtggtggcatgtggctgtagtcccagctattcaggagtctgaggcaggaaggtctcttgagcccaggagtttgaggttacaatgagctatgatcatgccactgcactctagcctgggttacagagtgagattctgtctcttattaaaaaaacaaaacaaaacaaaacaaaacaaaaaaaacccccgatgtcattgggaattacttttaaaaaatagatttcctagtttacttttcactaccatttacaagaatgcacatttctacattttaacttagtttcttcttctggaaaatgttttgtcaatatttctgttgaagattggtatttttaaaatatcacagactcttgaagaagtgtcatatttctattgttttattctcactttatactgtgtagagacataatttcttatttttctttatgatttctatttaaaaatcaagttaacttttctagtctattttgatttttccgtaattttagattttataatttaactttcccaccttatttaaccttaatttatatatttatacctatatcattttacaaagaatttaagaaggtatttagcattttatataaaatgaaaaaacacacataatgatggtctgaaatataagcatattaaacataatgcttggtttgagcttagatttgatgctgggctgtctggttgctggtgcaaaaattaaaaaaacacagattgtcaattatcagtgattttaatgtttttgcagaactttttttttctacccaataagacagcacatgactagatgaacaagagagatgcctgcctctccccacccctttcagtgagcactgaaatatctcaggtggatccagaattcagaaaacagtccgaaaaaggagttaaatcatctcatcattagaagggagagaaatattctcagtttcccagaagaaaaaaaagttaaaaagcctttctagctctaatttgtaacaaaacaaaacaaaaataaaaatgaaaacactccacatgaaacatttagggcatttagctgtgagctgtttttacacacagctatttcttagagcaaactttcataacctttgaaagcccagtgtcaatgtgcaactcagttaaagtgcttctaaacttgtttaagggtgttgtttttgatggcttaactggtctatcagtagcatttaatatttctagaggtctaaaaatacattttaaaattctgtagaaatggatgttttcctcagaaaaacataatagtcactcaataaaacccccaaaaggcaaaagtcatgtgctaaattgagaattcaagacattccttctaaatatctttatttttggtcctgacttttatgggaaatttctgtcagactttcaagtaacagttaagttctatggtatgtaaattgtttcagagcataaactataaaaaagttcctaattcacttcacaaagctattaaccctaataccaaaatttaagactgcaaaggccttctaattgttctttgcttttctgtctccacttctaatctaagcactggcactagagtgcttttaaggtgcctatcttatcacattaccagaaaggggtacttctcaaccccttgaaagactggcaggagaaaatgacagccctatctgttggaagtggcagaagacagcatcaggactggcagagaagctggaaataacctagaaaaatcctggaagaaagagatctgcagaaggaatagaaccccaaatctgactataaactctgctgtaatccctagctaactgcatatgaaggatagtgggacatggacaccctacaggggccattgaaaaagcagacaaaccagcaaaaagtcaatccttgaaagataaagttgtgctaagattaatagcttctttatatttacgtatgtatgtatgtatgtatgtatgtatgcatgcatgtattttgagtacattccctaacctcagaagtaggtatcagagtaaagagttttggattggccaggcacggtggctcactcctgtaatcccagcactttgggaggccgaggcaggtggatcacttgaggtcaggagttcgagaccagcgtggccaacatggtgaaaccctgtctctaataaaaatacaaaaattagccaggtgtggtggcacgcgcctgtagccccagctactctggcggctgaggcaggagaatcgcttgaacctgggaggtggaggctgcagtgagctgagatcgcaccactgcattccagcctgggcaacaaaagtgaaactccatctcaaataaagcaaaacagttttggattgatagagcagctggagaaataggggaacctcagggtgggtatatccaaaaatctcagtataagctctccagttccttggctgactgctaagctccatgggcacaaaaggagaccaggctagaaaagcagcaactggaagttataaaaactgagcaaagagatcagctgctgcatactgctggaagatagaatttgaagtttgagtacaggaatgtttactgccagctagaatacaaaaaaccagtaatacccagaagaataaagcagaaactagagttggtaataaactatccacaatgttaagtttgtggccaaaaattacgagacatgtaatgaaacatgaaagtgtgacccatattaaaaaaaaaaaaagtcaggctgtaataatttactctaactagagccaggtgttggatttattaactacttcaaaccagcaattacaaatgtgctcagataaattaaggaaaacatggtctcaattagccaacataaggaatcttgagaaactgaaactataaaaaagacaaatgaaaattctagagctaaaaaatgttatagaatttagaagataagcacaagactagaaatagaagaatcagtgaacttaaggatacatcagtagaaatgatctaatctgaagatccattaaaaaaagaaagaaaattgaacatgtcctcaaagacttatgggataataccaagcttttcaacatatgtttagttggggtcctacaaagaaaggagagaatgaagtattaaaaaagtatttaacaaaacaatggttaataatactccaattttggtgaaaacattaacctctagattcaagaaattcagtgatccccaaggggggaaaaaccagttaagatgcatcataaccaaactactgacaagcagaaagaactctatgaagggatcattttactgtatatgtattatacttaagttaaaatatttcaaagcaaacaagggaagggaataaatataggattagaaaacaatgaagtagaaaaacagagtgaagcatgtgaaaaaaaaagctaggattttgaaaaggccaataaaactgaaatctctagctagactaatcagagggtataaaaataaaaattttgaataacaagagtgaaagagtaggtcgggcgcggcagctcatacctgtaatctgagccctttgagaggacaaggtgggcggatcttgtgaggccaggagttcgagaccagcctggccaacatggcaaaagcccatctctactaaaaatacaaaaaattagctgggtatggtggtgcgcacctgtaatcccagctacttgggaggccgaggcaggagaattgcctgaatctgggaggcagaagtttcagtaaaccgagattgcaccactgcactccagcctgagagacagagtgagactccatctccggggaaaaaaaaaaaaaaaaaaaaaaagaaaaggatcaaagagtaaaagagtagacattattagagatcctaagacactgaagaatggcggagattataaacaactttatgggaataaagttgaaaatttaattgaaataaatgacttctaagataaattacaaaaactcaggaaataaaacctgaatagcccgatatctattaacgaaattgaatttgtaataaaaaatcttcaaataaagtataatctatgccttcattggtgaattctgacattaagaaaaatatcatttctatataaactcttccagaaaatagaagaatgaacactttccgaatcattttatgtagccagcattactctgatacccaaaactagacaaaggcattataagaaaagcaaaccatagacaaatatcccccccggaacatagatgtcaaaaatccttaacaaaatattaatgaatcaaatccagttttacataccgagaataaaccatgaccagtggtatttaacctgggaattcaaggttattttaactttgaaaaagcaaggtaatctaccataaacagaataaaacaccttatgatcatttcaaaagatacagaaaaactatttgaaaacatgttataatacgttcatgattaaaaaaacattcagtaaaccaggaatagaagagaactcctttaacctgataaaaagatttacaataaagaaccttacagctactatactttgtattgaaaaacagaatgctttctctctcagactgagggacaagaatgtccactctcaccatttctatttagcagcatactgcgaaggtcctagccattgcaattaggccataaataaaatgaatacagattggaaagaaaagagaaactatttacagatgacatgatagcatatttagaaaatcctagggatcctccaaaaacagctattaggattagtgagattagctaagtctcaggattcaatatcaatatacaaaaaaaatcgattttatttccatataccagcaaagattccatttacattattcaaaaatatgaaataataaatttaacaaaatatgtataaagtctgtagaggaaatactgtaatatattgtggagaaaattaaagatgacctaagagatatttcatgttcatggtatagaaaactctatattaagatgtcaaatatctttaagttgacctataggtttaatggaaactctatatcccaatttttggaggaattgacaagctcattctaaaatctatataaaacacaaaggacctagattaagcaaaagaacttagaataaacaaagctagaagatttatgctacctgttttaaggactacaatatagatcaaacaagattgttttgggtcttctatgtctttggaatttccaaattaaaaagacatacattgagtatgtaaagcaactagaattctcatacactgctggtggatatacaaaatggtacaacagtgtggatatttcttacacagataaacacatacttaccatgtgatttagcaattgtcctcttaggtatttactcaagagaaatgaaaatatgttcacactgagacttatactcaaatgttcacagcagctttattcataatagcaaaagctgaaaacaacccagatgtccatttattggtaaagggagaaattatggtatatccacacaacataatatgctacccagaaataaaatgaaccaactactgatatgtgcaacataggtgaatctcaacattatactaagtgaaagaagtcaaacagcactgttccatttacatgaaattcttacatagttaaaactaacatattgagatggcaagctcaggataggttaggttgggaggaattaactgcaaataattttcagggtaatagaagtgttctgttatctttattggggtggtgattatatagtagcatctacttgtcaaaacctatgtaactgtaaagttggtgcattttatgttaatcatatctcaaagctgatttcaaaaacttcaatgatttcctatagtcattaggataaatccagtggcaaaaaggttctatatcatccaacccctacttacctctctggctttatcttatactgtctttgcctcactctatgcccaccatgttgggcttctcatccattagaatacatacgctgtctccagctcttgacttttacaactactctttcctcaaatgctctttctttcctcaactcttattcatccttcattttttcctcaagaaaaccatcccgcaaatcttggactaggataagacccttggtatatactctaacagcactacttttttgctatacttttcatattagcaattatttaccttatcattgataatcatgtataaagtatgtttccaccctcaagatcagaaattctatgaaacccgggttatctattttgttcaccactcttccccctgagtccctgatatacaggaaatcctcaaatatttgctgataaagcaagcaaattttaaaaatctaaaaattctaaataaaagagcatatagaatttagcaatatattaataatacatgtttaagtagggcttattgtaaaaaataaggtttagtatttggaagtgtattactttatgtaattcatcaaatatatcaaataagataaattatctccaactactgctactagctgtagttgactgctagcagcagtcaacattattctagaaacattagacaatgcaatatgaccaggaaaaaaaaagacagttatattcagattctgaccatctatatgaaaaacccaagatgatttgctgaaaaattttagtaagcaagttcagtaaggtggtcagttacaaagtatatgaatacatattataaaaacagtgtatctaaaacaatgcagtattggtgtaacaatagatagatcaatggaatagattagggagtataggaggagataaaatttttgcaatataagaaatttctatgaaactgacctttggagaagcatagattatttaaataattgtattaggacactgtgggcaaatactttccaatataaaagtaagaactgaaataatatctaaatctgtaattcatctaaaatttaacaaatgagaccataagagttcagatgaaaatacacaaatgccactgtgtatatgtctatatataattaattaatctgggagtcaaggaagactttctaagctggatcttaactgcaaaataataaaggaaaaggctaacatgtttgactacaaaatttatattttatattgtaaacaaaataaaaattaaaatattaaatgaacactcaagatgtgataaaaatgacgattttaaatttataaagatttttcaaaaaatcaataagatacacttaagcagaaaaatgggtgaaaactatgaacatataatccatgaagcaaatacaaatagtaaatgaatatgtcaggatttcaaattaacagtaagtaaaaattgaagtatttcagtcagattaaaaatatgtaaacatgacaaactatacctagtgcagagagaaatggatacttaaatacagatgataggcgtgtaaattgcctagcttttctggaggtcagtgaggcagtcttataaaatgccttaacgtgcacatttcttctagaaatcaagaaaacattagacaattgtacagtactcagtgatttgtaatgtggttttgtttataataccgaaaaccagaaataatcagcaataagtgactgaggataatttgatacattcataaaatacaatacccatacagactttaaaatgacattccatatatatatatgggcatatatttgacattgaaagatgtatacaagtagaaaaaagtatatatatggaatgatactcaaatatatatatttaatgacagggtcttactcttgtcaccgaggctggagtgcagtggtgtgatcatagctcactgcagcctcaacctcctggatccaagtgatcctcctgcctcagcctcccaagttgctggcactacaggtgtggtatcaccacacccggttaactaaaaaaaatttttttagagacagggtcccactatgttgcccaggctcacacatatatattcaaagacatagaaacaactttctaagaacatttattgacatgttaacaacacttctctcttgcaggaattatacatttccctcatttttgtatttttctgtgttgaaggttctttgacagaacaagagcactttctaaaaatagttcaaacattggatgcaaagggatgagctgctagattatttccttatgtgactattgtggttttaaaaagtataatggggactgggaacactttaagtttccaaaggttagataggcatttctcaaagtgcattcccacaccatcctcttcaggatctggtatgcttgctaagagtttctctgtccccaccctagctctactgagctaagatcactggagagggaacctaggactggaattttaaacaaactcccaaagagattctcacgcataccgatatttgagaacccttgtgatacttcctataaagctagagggcagacagttgaaggttgttcttgcagagggaaaaggctgcccagtttgcaagcagcagtttaggtgaagcttccttttcctgtgctttagcaagcttgcttcatcacctatttattatgtttgcacatatagttaaatctatgtcttgactctatcctttctaccaatttgttttttcttacttggggccatattaccagggtatatcattttattatatatgatatctgataggattaccagatattatatataataggtatatataatataggtatatatatattatataggtgtatatataataggtatatattatataaaataggtgtattataggatattatataagaggtgtatttttcccatgacactttttttggctcctccatttagctttaagtagcaaagtgtcattcaaatcagctttctcttaaccagaatattgtggcctacttggaatcagaaacttttcacagccaattatctaaaccagttctgaagtagactataactgggaaaatggcaatgtaggttctgtctcttccagaaccatctgcttctgcttatggtgtcttttcagcatctacagggtcagtctgtcatgcaaaagagcattaattaagtagttctctctccagcagatgcttgaaggaaatccacaactcaatttccacagtaattggctcccaacacaccttttcttacagagagatagtgattgttttcttttctgtggtttccattttccatggcaccatactcctatacccgcaagcaagccttaccggcatggtgatctggatgggttgccgttctccactcttcgttggggtcacaccttctgtgtcatatgtacccgtataaacaactctgtccccatcaggctctttagacttcagttccagtgggacaagcacaccaccaatggaaatattcctgcaatagacttgagttgaccacatacggttgaaattagcctaggcaccctgtcctgttttggaccaaaactctaggcaggaaacttacagggtttcactaaggggggcattgtggtgcgggagaaagttctgcaagttcagggggcagtgcttctcctatttatgaattaaaaacctacctatccccagccccagacattaggattcagttggcctgggatgtagtttggacactggtacatttattttaaggttatctaggtgatcttaatatgcaggtaggattgagaatactgaactcgtcctctaatattttttttctcctgttccaacaatcaggggtcctatgatttggagtacctcaagccttctacaccatcagaaattctcactggcatcattcttttgtgttaggataatggttctcaaagccaagtccctggaccagcagtatcagcatcacctgcagaccttagaaaacaaattcttaggccctaccatagactaaactagaacttctagggagagctccagcatctgtgttttaacaagcactccaggtgattctgatatatactcaggtttgagaaccacaggattagagttgagaaatccttgatagcattaaaatgtaaccagaaaaaatagttttattcctaacaaattaacttttagattagtttgaacactagaggaatactctaaaaaaaaaaaaaagaaatatattaacagataactccggggataaggttggcaggaaagaagggaaaggaaaagcctggattatatccaggtgcacagaacactgggaaatgtgagaataaagggtgcatggagctgtgggggatgctgacaaatagatgaatcaggagtaccagaaaccatccagatttggttctaggtccttgcaccttggaaggctaatacaagtttactgaattaaaacgtaagctataagtagtatctgatgaattcaaagtccttccacccccgcaataatgcccaccatatgtagtagatacaataaatgctggtttattttctctctgcagactagactttggtaggtagaaacgagaggtaaaggggctccacccgcagttcttccgggtaggctactgcatgctcccacacactttcccgccagaggtctactgggtgcattatccagcggtcgctggcaagaaatcgtccctgccatggataaaccaaaaaacatcctcttgctgtggggatgttgctaatcccaggcaccatcaccagcctgaacagaaaactcaggagaaaaagaacagcatacggcatggaaaaccgtgaaactaggccagagaaggggcggccgctctcttactagtgtctgctgctccaccccagggtcccagccactgaatggcgaagggagtggggagcatccctcagggagccccagtaatcacccctcccctgcctttccacctcattcctcctttctccctccttcagccttgcgggcagaccctgtgggccgcctggaccgcgcgcaggagggctgggattgcggtggctgaaccctgcggacctctcccatctgctccaccccgaccgcctgcggttccgcgcccaaggctggacagaaggcaggagaaatttataagaaacagacaagcaaaaaccctggcttcttgtcactgattttaaagaacccactgaggtcactgcgatgggtggagggaagcgagaatggaggaatacaagccaaagggaaggaaggggacgaaggcggacagggagtgacctcttcctccaacccccgggcccgctgggagcggcgcgaggccagaggcccttgagaggctcgggctgtcctgggggcctcagtcctctgcctgtaccccatgggggaccctgctgccaccaggcgccccgcactcactcgacctgcagcgtgctgggtttaatcttcacctcaaccttgtaggaggagccggtgagcagcttgatggtgcggttctggccgaagcgctgcccgtccaccttgtaaaagaccgggccgtcattaggctggatgcgcagcgcgatggagaggcgcacgaggcccggcaggtcccccatgtctgggcgagggtctggcgcggcggctccggggggcggaggacagcgccggctgcggccgagtggctggagcgcgaggggcggagaggaagcgcggggagggtgagggaggtggtggagctgaggctgccgctaggaacccgcgccgtcgccgccgtccgcccgggcttttgaggagcagctccttaggctgtggcccccctccccactcggcgaggaagcgggcccaagagacggctccaaggccgcgcgcttccccatcccccgctccagtgctgcgccctccacgcacccgaaggctcgctctggcccgcaggccgccgcgcagatccgcgcagctgggggcgagggagttaatcctgtttacgcaccacaatccccttcagctggggaagcggacatttaggctcctcctagaacagccccgggcaggaggaggagaggtttgggaggcactgggaaggcgctggagttaagcgaccactatgccaaggagcgagacccccggaatctggataccgcctcggccagctacgtgaggtggacactgctgctcgcggatccggcgccagccaggcgggaggaggctgagggggggtaaagggaggcgggaaggggggacaggaaaccgctagccggtgatttaaatttcaggaaatatgagtctttccaaagcttaggggaaatggccgaggaaaggcgcaattccacgtgatggagccacgctggatgaggaatggatgcaagaggaagaaaataaccatattcaaggagctacatcttcttgtgggtgtacatttccattatacgtatgctcgtcccaaaaatgacacatacataaatatatgtaatgaatcacatatatttacacagattttgaagggtgagctattaaccctgtaaaaggcaactgacatgagcctaaggcattctggtgacaaaatggccaagaggtgggatgggtcaaaggattattggcagggggccatatgcgacaccgcagagtttagatttgcatattaagcgtgattagacagttttcgtggcagaggtcggtagacagctgacttttggaagcgaggggagactcagggggtgaggactatactgggaatggcttcccggagcagagagagcacctgcttcagcaccacccagatggatagtaccagagccagggagcacacctgggaaatgaagtgggctagtgagaacaaatgggtagggatgcgtttccttggcagtttttgtttacccaagttagactgctcttttttaagaaataataagctatacatataatatatatgtaatatgggtgtttattgcaacattggttgcaaaaataaaaataaaacctaaatgaaatgttaaccaataaataaatggctgaataaattcttatatacccacactatagaacgttacacaactatcaaaataatgaaatataggttgcattggcaaacacacaggcaaaaactgttaatgataaaagtgggatggctgggaaacaaagcctgagggc

SEQ ID NO: 17 - DNA, 108 bp, Homo sapiens
cctcctcacccatcatcagcgcccgcggctttgggtggccgaccagagggcggccggaaagcacctcggtgccccgcgaccctccgaacagaggcggcgggaggtacc

SEQ ID NO: 18 - DNA, 111 bp, Homo sapiens
gcgtgctgggtttaatcttcacctcaaccttgtaggaggagccggtgagcagcttgatggtgcggttctggccgaagcgctgcccgtccaccttgtaaaagaccgggccgt

SEQ ID NO: 19 - DNA, 115 bp, Homo sapiens
aggaagcaaagtgacccctaagcctagacaaagctctcgaaagcccaaagcctcgggcccaccggccagctccccaccccgctgctgggccggacaggtgtaggggaggcggacc

SEQ ID NO: 20 - DNA, 77 bp, Homo sapiens
ctctcagtcccgccggcttaggtaacccaggtcgctgcggtaacgcagtgaccgcgctccaggtccgcgtctcttgc

SEQ ID NO: 21 - DNA, 95 bp, Homo sapiens
ccactgcgaagggaaggggcattccgccaggcgaccccagaagccagcctgcacctccccggctttcctgcaaccgggaaggggcgttaacaggg

SEQ ID NO: 22 - DNA, 100 bp, Homo sapiens
gcgaccccagaagccagcctgcacctccccggctttcctgcaaccgggaaggggcgttaacagggccaccactccggggctccgccactccccagccgtt

SEQ ID NO: 23 - DNA, 75 bp, Homo sapiens
caacggaaacttcccgcgctacggcggctccaacgggccgcttccgccgcattgcgtagcgaagcccccggcgag

SEQ ID NO: 24 - DNA, 113 bp, Homo sapiens
caaagcgtctggggcgctagtgggggcggccagcggctcgagcgccgggggcagcagcagaggaggcggctccggctccggggcgtcggacctgggtgccgggagcaagaagt

SEQ ID NO: 25 - DNA, 70 bp, Homo sapiens
cgctcagccgctctcctcttctctctcccgcccgcccgcagcgccatggtctggcagtgtgtttagcgct

SEQ ID NO: 26 - DNA, 117 bp, Homo sapiens
gggttcggagcgtgcaaaaggtgacctaggcgcgctacgcaccacgcactcagcggtactctcctctcccgggcccccacgggtcccgatgctgggcggggatgcactgaactgttc

SEQ ID NO: 27 - DNA, 120 bp, Homo sapiens
gcgccccacttacatccagcaccgaggccaggtgccgggttcggctggcgagttccttcagctgcacgttccgctccttgagcgaggcgatctcctcctgtttctgggtcaatgtcacgt

SEQ ID NO: 28 - DNA, 116 bp, Homo sapiens
aacgtctatcacccagggaaagctactcttgactccttccacctatcaaaattgcctaagaaaggttgagtctgaccaaggggcggcgcagcttgcaactttcgccaactccggga

SEQ ID NO: 29 - DNA, 138 bp, Homo sapiens
ggtgcatttgggatcagcgactagagacagcgtcgctccaagaaaaagccgggttctgctcccgggaccgacgccgcgccgccctgcgctctcgccgcctgcgctcgccctgcgctggcccgggtcgctgtgctaatc

SEQ ID NO: 30 - DNA, 104 bp, Homo sapiens
ccgaaagaaatccgagccagggtgagggtctgagacgcaaggagaatcccaggcaaggcgctcctgagaaaagatccccacggcggacgtggggcaacaaaacc

SEQ ID NO: 31 - DNA, 98 bp, Homo sapiens
cgagagaggggaaggggctggttggaaccggtggcaagaggctgtggcgggactcaggcctccccgcagtcggctccacaatctgcgccccaagttcg

SEQ ID NO: 32 - DNA, 120 bp, Homo sapiens
gcccaagcctcaccctcacacaggaaagcagatgtgttctggccggaagttgagtggggccgcggggcctgctgggaggtgttgtcctcggaaacgtcgctggcgcggagggatggttcg

SEQ ID NO: 33 - DNA, 72 bp, Homo sapiens
ggtcgccttcacccagcatctcagaaactgcgcgcgggatgaacattcgggtgtttccggcaggtgacgctg

SEQ ID NO: 34 - DNA, 86 bp, Homo sapiens
ccagaggcccagggatccgttcaggtcagcgctggcgtccgggcctgagtttggaggtggcgggtgccttacaagaatgctcgcgt

SEQ ID NO: 35 - DNA, 90 bp, Homo sapiens
gggaggagtgggcggctgaatggccagaggcccagggatccgttcaggtcagcgctggcgtccgggcctgagtttggaggtggcgggtgc

SEQ ID NO: 36 - DNA, 149 bp, Homo sapiens
ccccacgcgtactcacaccgaaggctcagccgtcgcgcgtttccctcccaggccccaggaactagtaactagggacgcttctggtctctaggcgaggagagggggagagcgcaatctttgcgcctgcgcacactcctgctcttacccgc

SEQ ID NO: 37 - DNA, 118 bp, Homo sapiens
gtcgcgcgtttccctcccaggccccaggaactagtaactagggacgcttctggtctctaggcgaggagagggggagagcgcaatctttgcgcctgcgcacactcctgctcttacccgc

SEQ ID NO: 38 - DNA, 89 bp, Homo sapiens
ctgctcttacccgccggaaccctgggccacgcccggctcgcgtaatcacgcactgcgcaggcaccgcccgctctgctctaaggtccctc

SEQ ID NO: 39 - DNA, 168 bp, Homo sapiens
ctactgctaggtcgttgccaaggtgattgaggaatggcgtttattgcgtcgctgctcaggcaacgcaaactacattatccagaaggaccctcgcggtgcctcagggctggccattggcagccgaggagacaggcacttccgggcggagtgtaagacgctggccaatca

SEQ ID NO: 40 - DNA, 109 bp, Homo sapiens
gtgtaagacgctggccaatcacagcctggcagcgggacttccgtcgtcgtcctcggaccatcactttggcatttctcgattttgtctgcttctgaagggaccgcgttgt

SEQ ID NO: 41 - DNA, 80 bp, Homo sapiens
ccgcgtggtctgggctctgtagcgtcccagctgagccggcgatatgcagcgcacttgtggggcggaggtggagggaattc

SEQ ID NO: 42 - DNA, 106 bp, Homo sapiens
caacgttaaaggcaaacaccttctgcggtgtgcttggctcagctcaggcaggaagccctgcctgaaaaggctgcaccttcggctgtcactctgtcctcattcggcc

SEQ ID NO: 43 - DNA, 71 bp, Homo sapiens
gccggtgagcagcttgatggtgcggttctggccgaagcgctgcccgtccaccttgtaaaagaccgggccgt

SEQ ID NO: 44 - DNA, 85 bp, Homo sapiens
cgggaaggggcgttaacagggccaccactccggggctccgccactccccagccgttccctcctccggagaccttgcctgccaaga

SEQ ID NO: 45 - DNA, 24 bp, Artificial Sequence
  Description of Artificial Sequence: Synthetic primer
cctcctcacccatcatcagcgccc

SEQ ID NO: 46 - DNA, 23 bp, Artificial Sequence
  Description of Artificial Sequence: Synthetic primer
ggtacctcccgccgcctctgttc

SEQ ID NO: 47 - DNA, 27 bp, Artificial Sequence
  Description of Artificial Sequence: Synthetic primer
gcgtgctgggtttaatcttcacctcaa

SEQ ID NO: 48 - DNA, 24 bp, Artificial Sequence
  Description of Artificial Sequence: Synthetic primer
acggcccggtcttttacaaggtgg

SEQ ID NO: 49 - DNA, 25 bp, Artificial Sequence
  Description of Artificial Sequence: Synthetic primer
aggaagcaaagtgacccctaagcct

SEQ ID NO: 50 - DNA, 20 bp, Artificial Sequence
  Description of Artificial Sequence: Synthetic primer
ggtccgcctcccctacacct

SEQ ID NO: 51 - DNA, 24 bp, Artificial Sequence
  Description of Artificial Sequence: Synthetic primer
ctctcagtcccgccggcttaggta

SEQ ID NO: 52 - DNA, 22 bp, Artificial Sequence
  Description of Artificial Sequence: Synthetic primer
gcaagagacgcggacctggagc

SEQ ID NO: 53 - DNA, 21 bp, Artificial Sequence
  Description of Artificial Sequence: Synthetic primer
ccactgcgaagggaaggggca

SEQ ID NO: 54 - DNA, 24 bp, Artificial Sequence
  Description of Artificial Sequence: Synthetic primer
ccctgttaacgccccttcccggtt

SEQ ID NO: 55 - DNA, 20 bp, Artificial Sequence
  Description of Artificial Sequence: Synthetic primer
gcgaccccagaagccagcct

SEQ ID NO: 56 - DNA, 20 bp, Artificial Sequence
  Description of Artificial Sequence: Synthetic primer
aacggctggggagtggcgga

SEQ ID NO: 57 - DNA, 22 bp, Artificial Sequence
  Description of Artificial Sequence: Synthetic primer
caacggaaacttcccgcgctac

SEQ ID NO: 58 - DNA, 20 bp, Artificial Sequence
  Description of Artificial Sequence: Synthetic primer
ctcgccgggggcttcgctac

SEQ ID NO: 59 - DNA, 21 bp, Artificial Sequence
  Description of Artificial Sequence: Synthetic primer
caaagcgtctggggcgctagt

SEQ ID NO: 60 - DNA, 25 bp, Artificial Sequence
  Description of Artificial Sequence: Synthetic primer
acttcttgctcccggcacccaggtc

SEQ ID NO: 61 - DNA, 24 bp, Artificial Sequence
  Description of Artificial Sequence: Synthetic primer
cgctcagccgctctcctcttctct

SEQ ID NO: 62 - DNA, 24 bp, Artificial Sequence
  Description of Artificial Sequence: Synthetic primer
agcgctaaacacactgccagacca

SEQ ID NO: 63 - DNA, 24 bp, Artificial Sequence
  Description of Artificial Sequence: Synthetic primer
gggttcggagcgtgcaaaaggtga

SEQ ID NO: 64 - DNA, 24 bp, Artificial Sequence
  Description of Artificial Sequence: Synthetic primer
gaacagttcagtgcatccccgccc

SEQ ID NO: 65 - DNA, 23 bp, Artificial Sequence
  Description of Artificial Sequence: Synthetic primer
gcgccccacttacatccagcacc

SEQ ID NO: 66 - DNA, 28 bp, Artificial Sequence
  Description of Artificial Sequence: Synthetic primer
acgtgacattgacccagaaacaggagga

SEQ ID NO: 67 - DNA, 24 bp, Artificial Sequence
  Description of Artificial Sequence: Synthetic primer
aacgtctatcacccagggaaagct

SEQ ID NO: 68 - DNA, 24 bp, Artificial Sequence
  Description of Artificial Sequence: Synthetic primer
tcccggagttggcgaaagttgcaa

SEQ ID NO: 69 - DNA, 28 bp, Artificial Sequence
  Description of Artificial Sequence: Synthetic primer
ggtgcatttgggatcagcgactagagac

SEQ ID NO: 70 - DNA, 24 bp, Artificial Sequence
  Description of Artificial Sequence: Synthetic primer
gattagcacagcgacccgggccag

SEQ ID NO: 71 - DNA, 25 bp, Artificial Sequence
  Description of Artificial Sequence: Synthetic primer
ccgaaagaaatccgagccagggtga

SEQ ID NO: 72 - DNA, 20 bp, Artificial Sequence
  Description of Artificial Sequence: Synthetic primer
ggttttgttgccccacgtcc

SEQ ID NO: 73 - DNA, 24 bp, Artificial Sequence
  Description of Artificial Sequence: Synthetic primer
cgagagaggggaaggggctggttg

SEQ ID NO: 74 - DNA, 23 bp, Artificial Sequence
  Description of Artificial Sequence: Synthetic primer
cgaacttggggcgcagattgtgg

SEQ ID NO: 75 - DNA, 23 bp, Artificial Sequence
  Description of Artificial Sequence: Synthetic primer
gcccaagcctcaccctcacacag

SEQ ID NO: 76 - DNA, 20 bp, Artificial Sequence
  Description of Artificial Sequence: Synthetic primer
cgaaccatccctccgcgcca

SEQ ID NO: 77 - DNA, 24 bp, Artificial Sequence
  Description of Artificial Sequence: Synthetic primer
ggtcgccttcacccagcatctcag

SEQ ID NO: 78 - DNA, 23 bp, Artificial Sequence
  Description of Artificial Sequence: Synthetic primer
cagcgtcacctgccggaaacacc

SEQ ID NO: 79 - DNA, 24 bp, Artificial Sequence
  Description of Artificial Sequence: Synthetic primer
ccagaggcccagggatccgttcag

SEQ ID NO: 80 - DNA, 25 bp, Artificial Sequence
  Description of Artificial Sequence: Synthetic primer
acgcgagcattcttgtaaggcaccc

SEQ ID NO: 81 - DNA, 23 bp, Artificial Sequence
  Description of Artificial Sequence: Synthetic primer
gggaggagtgggcggctgaatgg

SEQ ID NO: 82 - DNA, 23 bp, Artificial Sequence
  Description of Artificial Sequence: Synthetic primer
gcacccgccacctccaaactcag

SEQ ID NO: 83 - DNA, 23 bp, Artificial Sequence
  Description of Artificial Sequence: Synthetic primer
ccccacgcgtactcacaccgaag

SEQ ID NO: 84 - DNA, 21 bp, Artificial Sequence
  Description of Artificial Sequence: Synthetic primer
gcgggtaagagcaggagtgtg

SEQ ID NO: 85 - DNA, 20 bp, Artificial Sequence
  Description of Artificial Sequence: Synthetic primer
gtcgcgcgtttccctcccag

SEQ ID NO: 86 - DNA, 21 bp, Artificial Sequence
  Description of Artificial Sequence: Synthetic primer
gcgggtaagagcaggagtgtg

SEQ ID NO: 87 - DNA, 24 bp, Artificial Sequence
  Description of Artificial Sequence: Synthetic primer
ctgctcttacccgccggaaccctg

SEQ ID NO: 88 - DNA, 24 bp, Artificial Sequence
  Description of Artificial Sequence: Synthetic primer
gagggaccttagagcagagcgggc

SEQ ID NO: 89 - DNA, 23 bp, Artificial Sequence
  Description of Artificial Sequence: Synthetic primer
ctactgctaggtcgttgccaagg

SEQ ID NO: 90 - DNA, 25 bp, Artificial Sequence
  Description of Artificial Sequence: Synthetic primer
tgattggccagcgtcttacactccg

SEQ ID NO: 91 - DNA, 23 bp, Artificial Sequence
  Description of Artificial Sequence: Synthetic primer
gtgtaagacgctggccaatcaca

SEQ ID NO: 92 - DNA, 24 bp, Artificial Sequence
  Description of Artificial Sequence: Synthetic primer
acaacgcggtcccttcagaagcag

SEQ ID NO: 93 - DNA, 22 bp, Artificial Sequence
  Description of Artificial Sequence: Synthetic primer
ccgcgtggtctgggctctgtag

SEQ ID NO: 94 - DNA, 24 bp, Artificial Sequence
  Description of Artificial Sequence: Synthetic primer
gaattccctccacctccgccccac

SEQ ID NO: 95 - DNA, 26 bp, Artificial Sequence
  Description of Artificial Sequence: Synthetic primer
caacgttaaaggcaaacaccttctgc

SEQ ID NO: 96 - DNA, 24 bp, Artificial Sequence
  Description of Artificial Sequence: Synthetic primer
ggccgaatgaggacagagtgacag

SEQ ID NO: 97 - DNA, 21 bp, Artificial Sequence
  Description of Artificial Sequence: Synthetic primer
gccggtgagcagcttgatggt

SEQ ID NO: 98 - DNA, 21 bp, Artificial Sequence
  Description of Artificial Sequence: Synthetic primer
acggcccggtcttttacaagg

SEQ ID NO: 99 - DNA, 22 bp, Artificial Sequence
  Description of Artificial Sequence: Synthetic primer
cgggaaggggcgttaacagggc

SEQ ID NO: 100 - DNA, 24 bp, Artificial Sequence
  Description of Artificial Sequence: Synthetic primer
tcttggcaggcaaggtctccggag

What is claimed is:

1. A method of screening for colorectal cancer, the method comprising determining the methylation status of at least one DMR of PDGFD, at least one DMR of FGF14 and at least one DMR of ZNF471 in DNA of a human subject, and diagnosing colorectal cancer in the subject.

2. The method of claim 1, the method comprising determining whether the one or more methylation loci are hypermethylated as compared to a reference, wherein hypermethylation is indicative of colorectal cancer.

3. The method of claim 1, wherein the method comprises determining the methylation status of at least one DMR of ADAMTS2.

4. The method of claim 1, wherein the method comprises determining the methylation status of at least one DMR of ADAMTS2, at least one DMR of ZNF492, and at least one DMR of ST6GALNAC5.

5. The method of claim 1, wherein the method comprises determining the methylation status of at least one DMR of ADAMTS2, at least one DMR of ZNF492, at least one DMR of ST6GALNAC5, at least one DMR of ZNF542, at least one DMR of LONRF2, at least one DMR of ZNF132, at least one DMR of CNRIP1, and at least one DMR of ALK.

6. The method of claim 1, wherein the DNA is isolated from blood, plasma, urine, saliva, or stool of the human subject.

7. The method of claim 1, wherein the DNA is cell-free DNA of the human subject.

8. The method of claim 1, wherein the method provides a sensitivity for colorectal cancer of at least 0.6.

9. The method of claim 1, wherein the method provides a specificity for colorectal cancer of at least 0.7.

10. The method of claim 1, wherein methylation status is determined using one or more members selected from the group consisting of methylation sensitive restriction enzyme quantitative polymerase chain reaction (MSRE-qPCR), Methylation-Specific PCR, Methylation Specific Nuclease-assisted Minor-allele Enrichment PCR, and next-generation sequencing.

11. The method of claim 1, wherein the method comprises determining the methylation status of at least one DMR of LONRF2.

* * * * *